United States Patent 9,976,180 (METHODS FOR DETECTING A GENETIC VARIATION IN SUBJECTS WITH PARKINSONISM) - sequence listing, part 43

SEQ ID NO: 564 - DNA, 691702 bp, Homo sapiens
gctcgcagtttcgccctctcttccgctaatgattgcattattatgctcccctctctggggggtctcgcccctcttgggtcgctccggagccccggcctcccctggctgcatttcttaaaaatttgggagcctgggagtgagttttctccgaggcgtgtgtgagaggcggcgggggtgttttcctgcgcgaggggcgggtgaagttcattgcccccacttttcccgcgacctttttcggacccgattttggatcgagttgaggggggcgcgggcgttttcggggggcggggggcgcggcggagaatggccgcggggagggctccccggagcctcccagtctcttgatcaaagcattccgctattctgatttattgcttgcttggtgagttatttttttttcctctaaaggagacctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgcggccgtagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccgggcgctctcactcgcctcgtcgtcgggctccgacaaggaagacaatgggaagcccccgtcctccgccccgtcccggcccagacccccgcggaggaagcggagagagtccacctcggcagaagaggacatcattgatggatttgccatgaccagctttgtcacttttgaagcgctggaggtaagggggaccccccttcccccgggttccctttatgcacgaccccactcggctgcgcccggctctcctgcctccctcgccgcgctccgggctgtctgtctgtctgtctgtctgtctgtctgtctaggctgaggtcttattgttggtggggggagctgggggcgcgggcagacaggcagcaggagggagtcgcaaagccgtgcctggtctcgtttcctcgctcgcctttcccctgcgccccctccctgcaccccctccacagcagatgggcagaaagaaaggggttcgggcatcacaacaatgcgccccctctccacagagagctctgcccccactccttcctcctctccctccccaatcatggcttcttggctggtggaagtctctttgctgggtttggggcgcctgtggacggttctgtgtgctttctacagagtcatatgttcgtgtgtgtgtgtgtgtgtgtgtgtgtgtgtgtgtctgtgtagtatatacctttcccgggtgtcctcgggactggagactgatggggttttgtgatttctttgcgcctccccccattacccccccatattctttttttttttttttttttggtgaagctggggaagggggcgttttctcctggttgggagaaaggagggaggaggggagagaagagggaagggtggaatagctctctgtattctgtatggggttctgttacagaaagggttaattataatattatctatacacatacataggcacatgtgtgtgtgtacatgagcaatttagttaaaggacagaaaaaggtacaccagggaagactggtgggagggaagaataaaatcctagctgctatctgaagggcttgtcaccaattgtccctctccctttccttttttgtgttttcttttttttctttctaagtgattggctttgtgtgtgtctatgtgtgtgtctttctttattccttgggcacctgcagcgttgattttcaaatgcacattttccttccagccaactggctcctagggtagggggaaagggaaaagggagggagggggagactgtccagggttggggggaaactgtctttgcctggacctgtctcctttggtgtggtattggtcattggcctctataaatttaaccgcctaatttcctcccccacctccctgtccccaccccccacacaccatgcacacacacacagaaggctttgagattctgcagagttggtccacctttcttaagcacaaaaccaagatacggtttatagttggcttatagtgtttcatgcacctgatgtgatggtttgaggttcctgaaggaaacttttccctttccatttttttttttgcgttattatggtattgtttcacatgctcagatgcaagctttgttaatgacagcttaaatctcacatacggtaactgtacaggtttagattgctggttctgtttatgtgtttgggtgtcagctttaaatatttttttcaaaggaaggcttcctatcagtgttgtccttttctgtgtgaactgcttttggtttgggctgctggtggtgatggtggtggatggtggccagtggttgggagtaagggaggtattggtggtggtggtggtggtgcaggtggtggtgatggtgatgttggtggtattggtggtggtcgtagattttgatgttagtgattgaatcagttactctctggttctagaattggtgctttattggccaaaattttgagtgttgaggttcaccacttattagaataattccaactgtggctttaagtttgccaaggtgggtggtggttaccatacagtgtgacctctttctgtctctctctcttgttttaaaataggagttgaaatggcagcatgttcctattagaacatgctgcttggaatttggttcatcattgctgtctgtggttgttttggaaagtacttgtaagagctggttacaagtggttctgctttctgcatggttatcctgagctcagcaatcaagaggggccactggattcccacgaacatttttggaggacaagtagggatatatgtgtgtgtgtatatatatatatatatatatgtgtgtgtgtgtgtgtgtgtgtgtgtgtgtgtgtgtgtgtgtgtgtgtgtgtatatctcacttatgcagttctttttgatggttttatttttaacaaataggtatttgactgggcttgtgatatatatctatttatttggcttttgcgagaaaatgtgctcattttaatttattttgtgcctaaaaaacttgtaattttaaaagcagaccaagttcaaaatgtacagttaataccatttctttctttgctctgattatttttttctgctacttttctagattaaaatccaggatattttggttagctgaatactatgtcaccttcatatctaaatatcatatgtctatctatgtgtaggtagaaaaggtctaacttttaaaaaagtttacttaaaattctgtagaaaaaattaaacatacagaagtagacagaacacccaacatccaggtttgagaactaccaactcatatctcatcttgtattttctatatttcatctatttcctctcccacatatgatctcatccatatttctcacacagaaatacttctgtatgaatccctaaaccataatgactccaaaaatcctcagaccccaccaaaacccgcacagcagtattatcacacttaaatgaatgtataacagttcactaatatcaaatatcctgtcagtgtttacattttaagaggcccaacttttgtagggaagccgtaaatacatttgtcagattaaaaacacacaatgggaaatagaaatcatcatatatgtctggttctttggcaaaaggtagttttgttggctgtgtgctatcacattgtgtccatgctggatggtcagaacatatgtgttagtgattgttaaattaaaacctctggtggtccactctattcagtctggaagatttattgaactatcaccaagaaatgtgagggcttattgggaacaggcaactaaactatgagcttggacaaaaatgtgtgttgggggagtgtttgtaaaagttaagaattattatagatgctaagagttatcctaaatacgtagtatgttttcgggccttgtgtttagaaatgaaatcagttgtcaccacatgtcattaaggctgctgctggtatgatattgtgaaaagaaaccagaaatattggcttgcacagctaggtttatagcttgtgccagttcagagcaatagctggcaaacagtggagtagcatactttgtgtgttaatggacacattatttgactccatgattttgttctgagtagctggttttggacttctcttttaaaaaagaggctcctaactcattatgaaatgtgctaatataaatagttccagttcaactgattttactgatactggagtaaaagtgataacttgcctaatgagaacctgcatttttatcttgattattttttgctgttgttggattcttttttgagatgatgaaagctttaggggtagtttgacaagtctcacattttataggcagtgaaactggctgaaacagtttcatattcacagggacacttctcttgagtaattgtgccctgaagttcaagtgtatgattatgaagagcctcatgatagaagataagagggtaggcgaggaggctaaagttgaacatggtgttcttttcattatgcagttgagaagcagaattaacgttggtatatagtatattgtttgtttggatattcttcgagtgacaggatgagagcaaaaatccccagataagatgtctagttttcttaaaaagtggcttttagcaaagtataaatgggaatgttggggtcctactaccatcagtgtgtcctgatgtgttagatagtgttggctttctgctatttgggttttttttctgtgttgtgtctattaggaagccacgtgagtaccatggctgaaaacttgactttgcaaatccattatttttcccctcattcctcttttgtgcactgggttcttagggcagcctccttttgtacagctgaccaagggaagctaagatgaaatttgtggaattagcagaaaagaggccaattggagctttataggcttatgaaagtaaaggaagactcatttctagtggttagagcatcaaaccaagactttgatgcggtcttcacttcctggctctgttttcagggcttcccccacacatcagtagcataagtgggctatacagaatttggtgtacttataacatgccatgttaataggctctcacaatttattatggtcaaatcactttagttgtttaaaaaacaacatgagtcacatgccttctgtcagtctgcagatatttatggagtgcttaatatgtacaaggcactaagaatatagagaaaccaaacataaatctagcgttttgagaaagtatgtagtttagttgataaagccagcacctatgaaataattttgaaacaggtacttgaatgcctgatatcaactaagcgccataggcttttagagacaggctagtgagataggctgaagtgttccagaaggcttcatgggtggggaatgggacctagaagggtgaagtgatttggatatatggggaaggagttggagctagggagagcattctaaaggaataatgaaggcacaggaacaagatgctacatggttaggacttgggggcaaggaaaggctggtggaaatgagtacaaaggtggtaagtaaagagtgcttgttagtggggcaggagacctgtggagacccacatgccaggcttggcctgcctaactagtgtggcctttgaaagttaactttctaaaagcatcatttcctttatccattagtggagaggtttaaactagtttagagtaaagcttctcaagctggaagggaacatagctttacaggatgttcataaattgttttttagtctgaaacagagtgatctaccgccaaatagtttctgaaacttgatgggctagacaaaattaaatggatgccatgttctgtcagaattaaaagtctattgtgtgaatgtgaattttgaatatcagagaaggcaatgtgttgtgcctaatttcctaaatctattttgaccacagagcacttttattctctgcattgtaatctataatccagtatgggaaatactagaaaggatccaaaaaagtccctccagatcttggaatctggtgatctctgagtctggggtgagtgggctgatggtagacgacttggaaaaccaggcacagaagcttgtagtcggtgcgtgggagctgcttcttaagcaggagtggcaaggggagtgaaagtgaggaagatgtaaacagtgagggagactagtccatgtcttttcctgctcccctttcctgcctgacatctgcctttttactgattgttaccaaccccaccaggaggtgaatattggtgagtggttctcattaatagctctttcagtgtgatgatactagcccaattctgatgccaccaagctgcccttcagccaatgttttatcctctttgtcccttctggtttcatatattgctgctctttggcaacctgtaaaaaaaggttggttgggaaaggaggttgacattgatgttaaaacaacgatttcaaattatctgcctttggcttgctgtatatgaagtggtagttcaaaaaagggtcagaaccgctcttttgctgttacatagccaggaaaagctgtggaactgtgtttctgttgcatttttcactttcttttttggaaaatttggccatgggactgtaaaataaatgggtcagttccagcatttgacttctgaaagtatgcatagctttaggatctgagaagggatgagagaatttggaggaaaggaagggtgtgaatagtgtgtgtggttatgaattcaagtattttactgtacttactgagtttcattattttactttataaggcagagcatcacttgaggagtatttatgtgagatgtggttgaacgttgtgatatgatgattccatgcagcttttgttaattgtggagattaactacttgcaccttttttttggaattagaatgtaaatgaatccgtgaatttaaaaaatgaattatgaggttaggaattgagcctttgatcctgagagtagtgttctgtagttctcactgttgaaaaagggttaagaaaacagaacagtaaacatgattcaaggagtgttgagggtgatagattctgagactcttctacaccacagttttatgtattatcaaagataaatggtgattatttagttttaaagaatgttaggattagaaatgaggtccccagatggacacaacaatagttgaggctagctattaggaataatttaggtctaagagctacgagatttggaagcctttggacgagaaggtctgtggcatttcgggtgtttgtgtatgtgtgcacgcacctgtgtgcacgcaaagggtgaaggatggtgggttagtggctttacattttattttattttacccctatcctgtatagtagtcataatatactaaatgcagcctaactttgtaaaagtgtttcatgctgtttttttcctcctcaagaagcaacttttttttttctttcagaattaggattaaacccaatatgctgcagatgtaggataaagaacctagtaatgggagagcaactgttaattttagaaagttctgaaaagattcaggtagatttgaaaacttagatcattgaagtttagaagagcaatatgataatgaatttggtaaaacttgagacaggagaagatcaaaaataattagtgagctggggcagaactgttttctcttatataatcagaacctgttccatgaatgtagacttttttcccctctgggaggtgaagaggacatagaatttaagactggtgagaccctaagtgtgtcttctttcttccaaatctgagctgtgttctccttcgtttcttctaacacaatagcagagtaatgatagtttctattatagctttgcatctgttggtatgcaattaatacatactgtgaggtcacaaagaataggccctttttatgctattagtatgaggaggggaggagtgagttttctagaatttgactgcccctgcttgtttaggaagaaactagacaagtacaggcttctgtgtcttagtcctgttcaggtctctgattccatccattgcaaggggctctggaccctgaaatcatatgaattggtgccttctttgaaggtgtttatttcatatattagtgtatgtggctctcttagggtccagttagattccccgctcacctgctgcccacctccctcctttcctccctttctctctccttcatatccttcttctttctctctcttcctttactgaggtagagctatcaaaattatgaatgctgttaataaaaggtaatgcatttaggacattgtgtatgaaacgcagaaattcaaaaatttttaaatttcattatttgaactgtgacaatctgcttgaggaactctaatttagctctctaaaggtgaattgcttgccacagttttcttggccattacagctcacttttctaatttctcagcttatgtctgaattctagttagtttgtttgccagagcaaaccttataaatgatcaactacatacaaatatttttaaaatgacttaactgtcattttagcttgcactatacctcacggtgccatacccccttgttacctctggagccctggaaaacccatgtgcagtaaaatggagtcacaagagaaaagcccacagtttgtaagtaatggaaaattgctaatgcaagttgggattcatttttggcaaaaagtctttaaattgcaagtattgtgtggctgctattaactgaagcacagcctgcaaatatagattgtgactcttggttacatgggtgaaatctgatattttctttcttttattttgtttttttgagacagtgtctttctttggttgcccaggctggagtgcagtggtatgctcatggctcactgcagccccaaccttcctgggctcaggtgatcttcccacctcaccctcccaagtgctgggactacaggtgcatgccagcatgcccagctaattatgtattttttgtagagatagagttttgccatgttgcccaggctggtttcaaactcctgggctcaagcaatccaccctcctcagcctcccacaatgctgggattacagacgtgaggcactgcacccggcaagaaatctgatattttcaaactgtggctaagttctaaacctgagactgagttttagtcattgccagggacaagttgtgatgacgcctgagggatctcattttccttgttgtccccacacctaccctcgtctgcagcacaaaatctcattttaagtttttgtaaagtttctgatggcagtaatattttagaacttaaaaggaggaattaagagattacagtcccatattataagtatttcttagttgttatgttgaagtagacttcttttttcttgttttcttctagatctctttgttcagttatactcgttggctaaaggttgctggttaaatgttgtttagcgaaatattctatagttaaaatctttacaaagaaaaaagtaagaatgaagatgtggatagcacaataattgaacattagattattacttgttttctagccacatgatagaaattgcagtgacttccacccattctgtctgtacatgttcagttggcaaagagaatgaaggtcctggaccgtgcttttctaagaaatgattttatatagttgacattatactttcactggagcaaaaagggaaacaagcatttgattagtgtgtcttactgcatattgtggtctgctccctcatttgttacggtggtcactatgattgcttgacaattacagttttgagattaatatgcagagctaaatctttaggaggtatcctaaagttaggacctaaactttttcatagcagccttttgatccattttattccagccattgctagttgatgtgctttctaagccgtgtggcatcagaggcacagatgttgtctttagtgatgtagttctacctctcattttgcaaatgaaaacaacagcccacaggggttaattgacctgttcaagatcacactgggagttagaggctctcactgttaccctatgaatctaggagtctgcttcttgtaagttagtactggggagtcccaaggattgggaaccttggaaggagattttttaaaaacaaaaagtcttactacaaatgtggatgagcacccatgattgtaaagcttcccatttcagctaagaaatgttctgatttacacaatatcaagaacctttaaaaagcgttgttctctccctgcgctctctcccagtgtatcaccctgaaattagttggcctttctctgtaggtacattcatcgtttttaaacactgcctcccacctcccttttataaggatgtaaaataaaaaaataaatattagggtggtttctcatcattgaatgtctagtggaaagataaaataattatttggaagtaagatgaccttaatgtggcccatgtaaaatttttaacataatttctttgtgtaaaatattttctttagcctagcaatctgtggaaactcagagcaacttcataacattggtagcaggatgtatggagtgagtgaactttggagtatagtggagttgaaggctcaacgaaaattttcttcgaggaaatacttaaaatattaaatccacatgacgtgttgactaaggcatcttgtctgttcattgctgaaccagaacatttataacaactgtttctcatgtgtatgtattcatagccattcatataatgaaaagaagttttcatgggattgtaataacatatcaagatggatgtaattaaaacagaagcagattgacaccctgaattaaatgtaaaccataaaccaggatacctgagcattgtgccttacatatttgctgtagggggcagtcagccaaatatgcaaataaaaagacattgatgaatcttcctgggtgtgtatgtggttgcagagaacccaactattttattaatcttttatcaagcattgtttagatttgcagcagccatggaatgtattaatttggcagaccaaatagcttaggaccagaaagtaggaaataataaagggaagacatgattgatacgctgtcctataaataacacatgcgactgacaaaggggctgagtaatctttagatctgtgcttcatttcattaatggagttgttaaaccaggatgtttgagttgaacttcaatcagagaggctctgcctcccatttaaaatgcaggcctacctctactcactctctggactgatatgttgacaaaattggtgtaaatcgaatttttgtaaattggatcaaatgcactaggggaatcttgctgtgaaaaatatgagtcctttttatcaactatagtactcctcctctctgcagggaggctgggattttggtggagtgagtctcttcagatgggcattgcttcctctgagacagtttcctgcacgtgttcccggtgctctgttccccgtgctcctggaagacagtgactgtgagatttgcattttttcttcaggttttatacctcacttggtcggtgcttccaggaataattggtggtgatttgaataagcccgcatcattcagatttcagagcttggttttcaagtgcttgctaaggagggctcccagctatgaatatggaatatgatttccatatctgttccattggggagtccaggcgtgtcataaccacttcagagtcatgattgtatcgagacaccctagctgtaatttttctatatgacagttcagttttaaaattgtaaagatgccaaaagcagggctgcattgttattagggaagtcagtgacatctgttatatcttgttaaccaggggaggaaaatgctttaatcaaaacatctaattataccctatgaactgatgaaatatcctttgctaaatttttggaattggccttaatggaagaagctggcctctatcagaactgtgaagtaaatttaccctttttatttggaaaaatatttattcctaaccatagtgacataagggtattttaattgtatcagattacttttatatgtctgttgaaaatagttatttttcagaagttgttcaagccagcatcacgtttttgtttttgtgctctctgactcccttagcatatgaggcccccagagggagtttgtatttccagatgtgagcctaggaggatatgtggtgtcttagagccacctggggagggagcaaatgataattgcaggtgagatgcagggggataattcagcctgtgtgctgggaggtgcgatttcacacctgaatgttgagacctgctgtgttagacacttgtgttgttttaaaatgttttattactctaatatagaaatggaccagattgttccaggtcaccttcagttgaaagaatataaatgtttttaaatattgaagtataatgtgattccagaaatggttcctgtgtttaaaagtagttttacatatatctgaaagcattaaaatctgtttaactcagcatgtctatactgcctctacctctgttgatcattttttaaaaattgtaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaattgtaaattattttggcaatgtggctttccactttgaatcattcaagcttcaaactgtccagtaaaactatccttttatctatatttcaaaactagaattaattttaactatagctgttagttgtttccagaatcactgacgatgattataatattaatgatagtacattattgatagtcttaatgctgggatatggattatttctgagaaatgattaggtctgagaaatgctttatttcttagttttgggggtatttcatctttctgacatggttttcccatgtatggagatcttggggcccacctgaaggagttttttgaagtgttgactgtgacactatgggcttcatgtttactttgggatctggtgggaagttcaagtgctattaatttttccttggtctgttttatgctttgtaatggctttctgtgtgttttttgggagttaagactagaaccttggaaaagagagagccagagttttctccctatatttctattttaaaacttttttttttttagacatgttctcgctctgttgcccaggctggagtacagtggcgcagtcatggctcactgcagcctcgacctcctgggctgaagtgatcttctcacctcagcctcctgagtagctgggaccacaggcgcgtctcaccacgcctggctaatttattatttgtagagacggagtcttcctatgttgcttaggctggtcttgacctcctgggcttaagcgatcctcccatcttggcctctcaaaagtgctgggattataggcatgagccactgcgcagcattttatttcttatgtattgttattctctctgtattctctgcctaaatgtaacccctgcactctttctgtatatatccttctggggatatttgaggctttcagaactgtttctttcttcactcagtaatctatgcatagtaggtactcagtcattgcttatttacagttgacaacaattccatgaaaagaaatttttgaagagggagctgctatttactattcgccttgtgccaggcattgtgctagcaattttgcattcgttatcccattgacgcaccccatgaaaaaaagaataataatctctgtttgatagttgaagaaactgaagcacagagccgttaaatcaacttggccaggatcagtataagagaggcaagaaatgtagcagtttttgcctgacttgaaagcttgggctccttatccctttactcattttcatacagatgcattttgtgaaagatggccacatggtctctagtagaccacatttgttcattgttgtgctgaaaattgttacaaaggattttctaggtataataataggatttagggaggggagagtacttattgtccaggtctttatttcctttgaaaagttggagcttacagttaggttgctgccactcatacaatatatctgtaacatattcgttgttgttttttctctgtttcactgtttctccctgttataaaatctgaccttttcccgggttatactactcaggtagattttaaaccattgtcaaaggcaaggattcaggctgatgatatagagggttattgtatgtcagtgtctgttctaaacccttgcactcatttatctcactgaattctaaaagtagctctctggaacacaaatgtaaaattggaatgaggactagcatgccctcacagattactgtgcatataagcttatattctgctatagattctgaagtattttgtcttgtctgcttttaaactgttctaggaagcagcacttgtcttgagaatctatttcacaataaaagagaccttgttttgagggctaggtgtatttttttaaaatctattaggaactctattctttctggtaaaagaccacactaaatagctctttttgcttttcttgatatctgtatcttgaagataccaggtgacaaatagtccattgatttcctctgtcattgtttcctttcattattctaagcagatttgcaaattgttctctcccatttcccattccaccctgttaaggtttgtttatgctacaaagagtatgctaatgaatataactgttagatttacttcttaaggaaatcccaactgcatttagagtactgtacatttttgagaaggctcctcctcatttcccctcggctaagatgggcctcctcacaggtcattctctgggacttcacgattcagaactggtccattaccattcatttacaaggaatgggggttagtataaagatacacacacagaataccctcactgggcctgaattttctaaagatttctagatgaatatgaagatcagtcaagttacacacttctctcaagagtcactctccgtctctttctttctttctttctttctttctttctttctttctttctttctttctttttttaagagatgggatctcactctgtttcccaggctggagtgcagcagtaatcatagctcactgcatcctgaaactcctggcctcaagcgatcctcctgctgcagcctcctgaggacctgttggtgtgtgtcaccatgcctggctaattttttaatttttttttgtagagacagggtcttgctgtgttgcccaggcattctcaaactcctgggctcaagtgatcctcctgcctcagcctcccaggtagctgggactgcaggtgtgaaccactacccctgctaattttttttggaggggtagaaatggggtcttgcaatgttacccaggctgatctagaactcctggtctcaagtgcttctcctgccttcacctcccagaatgctgggattacaggtgtgagccactgcgcccatctgagtgtccgtatgaagagaggtggcagtttcttcttggaatcaccatgctctgagacacacagtcttgcctttctctctccaactgtctcaataaacacaattgcccctttgtatgtcccgaatggaaataccatactagaattctattttacagattgtaattgttggggagacccaagtcaaaacatgttctttgaaatttaaatataactgtaaaaggaaccacaaagtctagggctttaaaggtgatcttttatgctttgattttatgtatttgtaaaatacaagttctatattgactctagggcctgtctcagattgtaaacccttagatagtaactgtgtctttttaactgttccttgtatccttccttgcccctctggtggtctataatacccctgttgtgatgattttgattaaagaaacatagtgtgaagatgggctgtcagggatgggtgtcagtttcacttcagggtagtgggtgccatctattttctgattacaggtgaacattactttagcattatttttttttgagacagagtcttgctctatcgcccaggctggagtgcagtggcatgatcttggcctactgcaacctctgccttctgggtttaagcgattctcctgcctcagcctcccgagtagctgggattacaggtgcccaccaccacacctggctaatttttgtatttttagtagagacaggatttctccatgttggccaggttggtctcgaactcctgacctcaggtgatctgcctgcctcagcctcccaaagtgctgggattataggtgtgagccactgcatccggcctattttagcattcttgttgtagatttctacatctgctgcccatatttcagctgtactcttattttgtttagtatggtgtacctgggattagggacagacaaatatgtatgctcagcctgatttggaaattacattgttgaaatacagcccatatggccattgtaaaatggttagtgctgcatataattgcctttccaatgatgtgctttgtcattacttccatcttccaagaagcactcctgtagcatgctgacagcaatagcatcattagaaaacatatggacatgcaaaggcattaaatcgtctttagtttaaggattagattacagtgttagaggataggtcaccaggcttgcaatcgatgactcttgcttagttcagcactgctagactggatgatagagatttgcaaaagtcctatttacttgtctgctgagtgtatttcatatcttccctgcaattgtgagaaggtcctttagctgtgtataagcctctatcacagtattgcagccagttggcttctcaggagtgtttttttcaactattcatgtcctgtgcagaattcttttctaggatgctccctcaacctctgtttttctgaatgtgagcccaaagcaggctaagccaggaattattttatttgggggtcatttagatataaaaagagactaagtggtggagtcaagaaagtaccaggtggctgccatgttgcccaaatatttcctcccttgtacagcatctatctccacatgggtctcaagtccacctcccttcttcctttcccctcttagaagcaatgggattattgcagcctagaggctcagtggtaggtcctagaggccgagggaccatgtgatagagcctggaaagagaccaccccctgaatcctgccctttgtagttggatgttttttccccccacaactagataggtttactatctggctgtaaatattctagggatgcaacagttgtgggacatggtatgatttgaattttcagggtcctttttgtagttgccagtgaatagtaagtgaaatcgcagaatggaacatcattcatcaaatttaatatttcttctttggagtttaacagaaataatgtggatttggggactttcagagtgataagggactttggagatcctcatgggcagtggttttgggtacctcagggtacgctgagtcatttgaggggagatcctgactttattaaatcagaactccacctttacctgtcttctatatttatacttatgtattaggattacattctctttgagaagaaaaaagtgtctggatttgtttattctttcattcaaaaaaaatttattgacagcttctgtgtgctaggcaggcagtactccaggcacaggaagtaccatagtaaattagaaaaaatagatatctattttaatggagtttatattctaacaaaggatggggggacatactgtaaataaacaaatatataatatgttgggaggtgacaggggattttataaagcagggtaaagcaagagtgagaacttagcacagcaggtcctcaaataacattgattcttttcattataatgttgatgagaaaaaaaattgattcctggccagggcaactgtgtggagtttgcaccatctcctcatgtatggtaaaattgctttcattatgcatcgtgtcacgtatttaactgaggactcacttgtatgtgtatgcttacgtgatgctttatccagggtgggttagataaggctcctctgaggaggtgatatttgagcagaaacttgaaggaagcgagggagcaagaaatacagataacccggaggagagctttcaaggaaaggggagaacaagtgtaaaggctttgaggaagaaggagtggcatggtatgtgagcaacacaggagatgttggcggctggaacaaagccattgaggaggggacagagagtggggaggggcctgcagtcactttaactgagtgacgccagaagcttagaaacagcagaaagcaactgtccaaagccctcatttcccaactgaaagtgtttttgaatttccccaaggtcacccagctgatgtataaacaagagcacatctggagctcacgttatattcttttaaagtagcttctcattgtaccttgtgccaccactccaggtcttaggagacatggggcatctttttggagacaagatttgtgtctcctttcctgttagtgggtatggctcctccaagagatgtgcttcaagactctacagaattccagtgcccagtcatcacaaagtgggaaacggctttgccagtgccagaatcaccaccatttggggaattattttaaccacaatggctcatgtttatcacaggcttactgcttgtgatgtttgttgtacccagagctttacatgcattaacacatctaaccctcacaacaactctgtataataggtcacattatcattattttagagatgaggaaattgaggtgcagagaagttaagtaatttctgtatggtcatgcagatagagttgtagagttgggatttgaatttagactatttgcttcagggcctgcactgagcctctgacaaagaggagggggatgagcttgtctctagataaactaattggaatatgctcccctcgcctccattttaagatggttctaggtagggcctagccttgggagtaataccaacttgtcacaacccacttctgtgactccaggtgttagtttgtgtagaggatttcacagccagtctggctcagtactggcaactttgctgattttaggtggattcctgattcagcaggtacctttggtctttctgagctgagtttgactggagcgtttttcaagacctgcatgagagtgtgttacggaatacaggccagtgttttcaagtcagcggacccagttttagctggtctgtcttttttagccccagtgaagtaaaagccccagacaccaccagtgcccataatccataggaatgtaaaatcatctttttagtactggtgcttttgaggaccagtacactatgtgcttgctttaaatttgtctaaaaatgtatgcatatgtagatatgtgtatatatgactatgaaatattttctaggtatggaaaagtataaagcataacatagccaacacccatgtacccaccaccaactttaaaaaaccttatgactttactgtaattttcttaaaattgtaggttatttttagtgagcaggaaccacagtcaaccgtaagttttagagtccaggaggctcaaacctggccacacattagaataccctggggataccctggggagctttaaaaaagtccttgtacctctgggagggtgcaggaagcccccacctctatcatcagaattttaaaaagctccccaaggcgaggattctatcatgcagtcagggtaagagacctgctgtttggagggttgtgtttggtttttcttcactgggttctcagatgcctggtaccaagccatgtgtggtactcctggactttatatttcattttcttaaagcattttttaatgtggttctactttcaagattctggagggtaatgtcctggggagttcctctccttagactcttccctcttcagcaccttatgaggcaagctgcggatatatttacatattcattacaaagcataagcatcaggaacttagagagtaggagtgaggcattagagaggggactaagaaattcagaagtattgggagctactgtctgttgaaagtgtttgagatgagtgaaagttatagcattaccttggaagtcagggggatgcagggttacatttagaaaacctggagtcacacataccttcacaggaaggctctgagctgtgggatggtagttgagggcctttttggtctacatcacaggtttatcagtgaaatatgtggtaagatgtacaaataagatgtgccccaccaccagaatgatcagttctgtgtggacacgtccgtgactgtaccctctttcagaagtgctatcaattatgtgttatgtgtggcctgattatcctctgtgggccttggctccatgcagcacctccatccccgtctgcccactcattcattcaacaaatagttgctgagtttctcttctctatgccaggttctgttctaggcacttgggataaaaacagtgaactaaacaaagcttctgccctcaaggaatgacattctggggatgtgggggagaggtgggtgagtgggtggtgttacattctggtgtcgcattgttttttgatgtgtctaacacagaaaaagatgtgtaactgtaatcctcctttagaaagctctaggggagccatttggcaggtagggaagtgttttgcctaatttggcttaaattatgattttttgattctgaggattttgattacaaatgccttcatgaatctacttcttcaagagaaattaagtgctgagacattaaagcttccagggaccttttgaattggttggattttattagcagcttaaaatgagcatgacatacagtaaggttcaagcttaggggagatgctgaagaaataaggatacttgattttctttccacttgaagtggaatccactaatccatctgtgctcataaatttgagagaaggagggcggaaaacgaaagtttatttctagggctctctactgggcaaggctatcaggttaccttcattgaaaagacttaatcagaagtgaaacttaaatctgttacagtcttccacagctgtccagggaattgggcactgatgaataccgtcagatggacccctgaatagagggaatgccttagaggtcatgtttggagttagtcaataaaatggatctcgagaagaaaatagaaagtttgagggaaaaaaattactggaaaagaaatcttaaagcttttgggttagatgttagatggatgacgaaaacagtgggtgatatgatttcctttctggattaccatcttcatcagatattgttgtcgactacagaaaaaatattcccagcacgtaaggactctttatacctgtgagctcttaaaaagaatcatctaaaatactaaaaaagcaagaatatgttgtttcactagcttttgattcctaaagtagattttgacttccgggtgtgggaaggtgggtggaaaatgagtttttgttaatattcaaaggcatgaaaacatttttaccagtttatgttttcctggtgcatttagaaatctgtggatccttggggatggtgtatgcaggcaaatagagaatccagtacttgtgaatctgcctgaatccacaggtttgggaataagggcagggacttgagggttcacagatgtgaaggttgtacacagaactcatgcagagagatacaagatctttttgttccccctttgattagaaagaataggacatgaaagtacttaattgtcaacttcgtcttcaccataagcccagtattgatgcaaaaatgataataataatgagaacaagcatttattgagtattgggtattctaattgcttaaatcaactcatgtaattctcacagagtggttctatgaggttggtgccgttttgattcctgttttaaaggagaggaaacaggcacatagagtttacacccaaggacgagtgtgtcagtggtggagcctatacattctggctccagaacccgacttgaaccactacataagggaactaaataaatgcttcttaagagttttattctgatgttgcttttactgggactttcactcttttttctacccaacccaccccacccctaccccactcgcctccactttatctttggatgtcttcagaatctataatatatcttaagcttgcaccttattacagatgagaaaatagagagctataaaattatgttatataattgttctgtatgacctagtgaatctttggtagaacagggatgtggaacccaggttttctaatatttaggtcactgctttttctcactgcactgtatggcttccattaaaaatattttaaactaactgaactaaaaatttataaacttaatttgtgtcactcatacttctgtggatgaactacattaaaataactaggtgctgtgagattttgctctagggaggagggtggtagacattttaggagctaacatttgcctctggggttatttgacctcctcctgaggatgtctttctaatctttggtaggcgtacttaaaagtgaggagaaagtatttgaggaaatacaagagccattcgcagactttagtatgatctgtgggtttatggaagggcttttttttttctttctttcttcatttaggccttttttactttaacctccagtggggacacaactaacttaaatcttaaaaacaaataaacaaacaaaaaccctaaatacaagccttctttcgctattgtttggcaaataagatttcacaagagggtagaaagaactgccttgattcttggtgttttagactttcctatagtctagttttttgtttttgtttgttttttcttttggtcctgtgattccttttgttgttacctgtttccttggctaatgctttgtttaaaaacaagtgctctggtattccaaaacaaatttccagcaggcttcccgattgtgttctcagataaaagaccccagggtagtgctttaacttgaattttggttgcctatgcatgcctgagagcaaaattcagtttactaggtggcttccaacccagattaatatggttatatctaaaacgagggaatatacatttgaaacaggaaatgtggattggatttaccctttcaaagagccctaatgtgaatgtaatgagtagagttttgtctggggttagatactgtgggctccagtttgtttttgagtttttagctgaatgaatgactttagtcctgtcattaaacctctggaaatttaaactttcaacaatgtaataatgataatgaaaatagggaaaggctcctagactgtgctgtggaaaaacacatgttcagattttactgaagacccagaatcccatgtggccacagataatttgatttcacagtttctatttctagatatacaggatggggttgccagcagaagttacatagtgataataacatatcagcttcctttttagggaagatattgtaattgtgagaaaaatattcagaaaagccttggccaaatattgtttgtagttggtaagagaatactcagttattaaagcttctgcgaaccttttccaaataattacactttttccctaaaggaatcctcccacctcagcctcctaagtagttgggaccacaggtgctcattaccacacctggatgggtggatggatggagatatatatatatttgtagagacggagtctccttatgttgcctaggctgtgttacattttttgtcacacatgttgggtatggagaatttggagtaggtagtttcagatttgcacatcacaagttcttgccttgtgcagtggtttctaaaccgagttgcatatctatactccatggtaacttggtaaacatactgattcctggaccctgtgtctgatctactaaacattaatccctgctctgtggctctggaacattagtgttttgttttctttttggggtttgtgacagggggacaaggtctcgttctgtcacccaggctggaatgtagtgggacagtcatgactcactgcagtctcaaactcctgggctcaagcagttctcctgccttagcctcccaaaaagctgggactaccaccaccacgcccagcaatttttttttttttttttttttttttgcaggggtagagacagggtttcaccatgttgcccaggctggtcttgaactcctgggctcaaggaatctagctgcctgggcctctcacagtgctgggattatgggtgtgagacactgtgcctggcctggaacattagggttttttgtttgtttgtttgtttgtttttaacatcaagttccagtatagaagtttcagaaacactatttcttaaaatatttttgagtgttttcctggggcagtggtaatggtgatggtttacaataatttatttctatgctatgtaacttttctgaaaagaaaacattcctgtgtatttggttttaaaaccttatttactgtaaaatagaacacatcctggaaaaagtgtagtgtacagctcaatgaatgatccaatgaatgatcacaaagtgaatacccaggtaaccagtactcaggtaaagaaatagaacattgccccctccccacaaaaaatgatttttattagattcctcaaattttcttttctattcctcctcaaatcccaagaaattagagatataagtaaaggttgatgaaacaatataataaggtgtaagtgaaaaaagcattgtcttttggtaggtggtgtttcttaattactcttttcagtaagtttttggtgatgttaagtttgtgttgtttatctatgttttgattcagccttaagccagttcttgacagtgactgtctattaatgctcacagctgatattaagattacgttctaagatctatcttttctgcaatctgtttcactgaaaatattctcatgatagttttgaaaatgcgtaaggacagattatcttctgactctaataaacaagtgagtcttgtcattactgtccaggtaacttaggaaacctgtctcagtagccaggtatctttatctggtacatgataaaatgtggtttcttagttttttttaaaaaaagttccttcctcctctctatccacccagaataatctctcctccattccaacccaatcagaacatttaaagccctgatggtttttcttttttccactgaagaatcattcaattcttagtgagagaaggtctagctgtattaaatagcaagcttgcccattttctttggaaagggatgctcatggtaaaaggacctcaagcaaaccctgcacttaagctgtgtgcaagtggagggagagagctgtctgcagccacctgccagcagctacacatctgtgctctgctagcaagcatgtgggctctgtggatgtgagagctgctccctttcccctctctgcctcatgctcccccatcttagtgatcgccactatcaactaaacaggtgacaagactccaatcaccctgctctgaatggctctccatcttcccaaaagtataccagaggcctgttttgtttcagtacattgattaaataaatattcctgtgtgcacaaaggaactgaaatctgttatggcactctgcagttatctgtccattaatagtggagaaactactgccagttttctcccctcggtgcccccgccccccaccccctttcttgtcactaccacgcagattctcaaaggtgccagtaacagataaattatctgacctctgctttcaggcttgtgtgaagcgggaggagtggtgtcatgctctttggtgaggcatgccgttggggcagtgcccaagtgtatggataataggagagcccgaatgatttagattagaagatgctttcttgctttggggttgtgggacctttgtctctccccttcaattcttagcagaagcggactcagaaaggtctttcaaattagcttgcctctcttttataggaaaagggtgcttctggccctgaagtagttctgtgtgtctactgtcagatgtggaagccacaaagtgcctgtgaaacttggtcccttgcgtttatttacaagtttctttcaaatggcagtggcaggaaggatctttaccatttgggcagatagccctagtggttgatgggagggcttggtggaagggcaggctttgtgaaagatccaagtgtggaatggtaggaattctagccatggtggtgctgactggtttcctttcttttttggcggggcaggggctggggtggagtgttggttaaaagaacacctagataaaaaacatgacggatttcgaaagtgttatttgggctgcgcacggtggctcatacctgtaatcccaatactttgggaggctgaggctggaggatcccttgagtccaggggtttgagaccagcctgggaaaaacagtgagaccctgttctataaaaaatttaaaaattagctggatgtggtggcttacaatggtagtcctgtctactcgggaggctgaggcagtaggatcacctgagcccaggagattgaagctgcagtaagctgggattgcccactgtactccaacccgggtgccagagtggggctctgtctcaaagaagaaaagaaaagaaaaagacagggaagggaaagggaaggagaagaaagaatgacaatggaacataggaaattagggttgtagagaagactctatgaacattattgtggtgtgaaggaatggcatgcagagataagtgtgatggaagggaggtgttgaaatgtttacagctcctaacatctaccaccaaggagggggcacccctttgacagaaacgagagggtgttcctgagtagttgtgacattaaaaaaaattgcagggaaccttgtagctgcatggatggcagagacacataagtagggaaaaatgttggaataggtaaagtgaaatctcttagtgtgtgtgtcttccaactgactgtgggtaattagttggaaatgacattaacctgagcttaattgtaattttgcatagtaacaacataccagctgttcactgtattctttcctggaggtgcgatttaattattattatttttttttgctatcttttaagctccaattttctgttatgttttacttaaaccccgcctggttgccgtgtccacagtccccacagtttagcagtaatgtcatttttgttgctttcatgcccactgtgtgctgagggcttgggatgctcttgattttgctaatgacttggatttataaagggccacattggaaggtcactgagaagcatgggtgattggaaaccttgtgttttgggctcttccacaaggttttagtttattatataaatcatatgcataattctaggcctatcagaggtgctcaaagtatcaagtgaacaagctgaaagagaagttaattactgaacagtgattgttctgatataaccaattattggatcattaaatgtttattaccttttatatgctcctttcccccataagggcagtttcttttttaagtcattaaaacagaaatgggatcttaaaaaaattctgcttaaaaaatttccacgagactgaagtattaaaaaggtcttgtgtgatctgacagctaaatagcctgtttttctttggtctgttgaattagtaattaatgaaatgtattgcctgagcagagaaaataagattagttttgtttaggaagaaaacaaaagcaaaacattaacccccaaatgcaggttaatattaaagtgcagtataagaaatagaaataaaacagtcttcttgaatgataagatgcctaatggtaacatttgtttcattcattcattcgtcactttcttgagcaccaacattatgtttagaaggaatgggtttatgtaaatacagaggaggcaaggtgccctgtccccaaagacacatgggttagcagagcagttaaaccagacactttaggcggccaggcacagtggctcacacctgtaatcccagcactttgggaggctaaggtgggcggatccctgaggttgggagttgaaaaccagcctggccaacatggagaaaccctgtctctattaaaaatacaaaattagccaggcgtggtggcacatgcttgtaatcccagctacttgggaggccgaggcaggagaaacacttgaacccaggaggcggaggttgcggtgaactgagatcacgccattgcactccaacctggacaacaagagtgaaacgccgtctcaaaaaaaccccaaaaaaacaaacaaaaaaaaacaataaaaaaactcagacactttagtagctactgttgcaatgtagaaagtggtaggataataggtacaggggcatttctttggggaggagtggttatgaagacaggttacttctggaggctgaggcatcctgtggattaagagtaggggagagcatggttatgaagatgaatcttgctttttgaggtcacggtgtcctgtggattgagtagaagccccattacttgggttcacagcccagctttgccactacctagctgtgtgaccatttatctcagtttccttgtgtataaaatggaataatagtaatgcaaccctcacaggtttgaggattaaatgagttattatatgtgaagtgcatataacagtttacagcacataatgaacattataatcttaggttgtggttatgtcatttttgtgggataatgtgatagaacttcttaggggagattgcatttgattgaatgatgaggagcggaaagatgtttcaggcatttcttgtattgtcccatgtagccacatacctaatttataatgcctgcagtaatgtgtcggtaatgtgtgcttatgtagtgccattgtcaaaagattacaaagggcatttacagacgtttattctaagaacagtcccctgaaacgagatggtttatgcatattcttctgaagtgtgagagggtgcagagcaagcccatcctgttcttccattgaggtgtgcttggagcctgtgtttgttgtgggtaatttagactcacagagagaggaaacttttaaatcttttaaattatatcttaaattcttaagttatatttgcaaacaaatgtggtaaatagattttaaaaatgttttctgtagcttctagcaatagtggaacttgtttattcctgaggtaccagatcataggcagttgaatttagaggaagtttataataatgaacatttgtcgtaactgtgaggttgccactctgtattagttttcacactgctaaaaagaaattcctgaaactgggtaattttataaagaaaagaggtttaattggctcatcattccacaggctgtacaggaagcatggctggggaggcctcaggaaacttacatggtgaaagttgaaggggaagcaggcgtgtcttcatatggctagagcaggagaaagggagagggggagatgccacacttttaaacaagcagatctcatgagaactctttcacgagaacagcagcaaatggagaaatctgtcccccaggatccagtcacctcctaccaggccccacttccaacattaggggttacaattcaacatgagatttgggagggatacagacccaaactatatcttattatcctcattttacagtgaggaaaccgaggcactgagatgttcaggagtgttgctgaaatcaaaaagaagtgttgacccaggatctaaggtctttattgcatttgcgtaaaccatttcatttgatttgtgtgttttacaataaccctttgagaaaggtcagtcagctgctacgtgcattttgggaagtatcgtttatgagaagttggtggggcatcacagtgagcttagcatggactgaaaattttggggtggctgttgtatacccttttgctacttcaagcaagacacttttgggcctcaagatctataaaataacagagtttggaggaaacattgagtctgtaaactatgaaattcttgtgtagcttggagtgagacccatgtgggaatctttggcagccaccgtttaccaccttaacttttctgagcatgttttattattggtaatatggagctgtggtactccctttcttcagggctgttttgaacataatgcttataaaatacctgacagaccttgctagctctcagccaacggaggtgggattcttgttaattgtttcaaactaggggtcatacaggtagctgagcctgggtgagaagtccagcttcttaactcctctggggctggttctcttcagcacccaagccatattgctggggataaggaagacattttaatgagatgagccccaacttctcattagaagctgcagtcctgattctttctctagatcctatcaggttgccagttgatccagtaagtaatgtagtaaatgtaatggatccagtaaagagtttggggttttcatggagtaatttcctaaaatcaccgcagtcagtagcctgtgagccacatgagggcaggggacttgctctctgtggtgttcaccttgtataatgcaaggtgatgggacagctggcacatagttcggagtctggcagtatttattttgtgaaggaaggaaggaatgaacaacctcagtgagctgtagaaaatggtatgagaaagggaacaggatttttaaaatttcagttttgtgggacagaggaaattgaggcactgaatcaggcaggttatgcccagtctctgtggtcaccaggccttaaaattgggcataatttatacccttgaagatgttgcatggcaataccttctggtgggtggatcacctgaggtcaggagttcgagaccagcctggccaacatggaggggaaaccctgtctctactaaaatacaaaaattagccaggcgtagtggtgcacacctataatcccatctactctggaggctgagacaggagaatggcttgaactctggaggcggaggttgcagtgagccgagatcgtgccacttcactccagcctaggtgacagagcaagactctgtctcaaaacaaaaaccaaaaaacatatttctattgtgaaacaaaattttatccatgtcaggaatttcctctgaactagagtatgttcattcctcttttgtgatttgagtctgtgggagtcggaacttgtcaggaagacttagtgtagctgtgcttctaaggatgtgctattctcacaggcagccgtgctaaccatcttgctgtaaactagccacgagtaaacgtctggttgtgaatcacagcgtgacctttcagggaaaacaaaacaagcaaaccaccaaacacatgaatcagattttctttagtatcaggattgtaaagtctggtatttaacagtttgtcaggcccacttggagcagttgagacaacttcctttctctgtttttgtttgttcaagatgtggaagtgtatatccttctttagcaacatattaggataaaaactttaaagttttcttccactgagttaaactatattagttttcctaactgtcatggactttaaacaattaaagattcctggttaccactcaagacctactgaatcagtctcttggagtgggacccagaaatctattctgaagagcaccctaagtgattctatggttaatcagatttggaagccactgagatacagaatgataatattgtattttctatccacccatttattcttttttttttccttctctgtggtccgaatatccatttgttcttactcatttatccacgtcttgagtagattagaattgattacctatagggcattggtcattttaagaactaggcgtagaaacaagaggtagaacacaatgcctgccccatggggttcacaggtggtctcagaagtttttaactttgggttgagtgttaaaggattcacatacttcccaaaagccaggagcagaagattttgtgtacacacttttttttttttgttttaagctttcatcagattctccaaggggtcagtgacccataaaaggttaagaaccaaggtcttgtgcttgcacagctgttctggaaaaagtagaagagggcagtgtttctgttgccacttaagatgtttttgaccttttgagaggcaacagcggtttgaggactgtacctgttttctgtcctacttaaaatatttaaaaagaagaaaaaatagtttaacatctgggtcagggtcagaacaagaccaagggatatggaaaatagttatttcgtgaactgcatcacatttaatgttaaagagctgctgacagccaaacagcctggtggttagcgtgatggaggaacttcttaagctggatagcataggcaaggttcattccagttttcttacagtatataattagccaaattatggataacaattttcaccccatggatatacataaagactaattgtcttatttttgttccattttagccccagcatgtccattgaattgcttaattccaaaataactttgccagccgtacagctgatacattcttctttatcttctaaaatccccaaataacactgttcatagcaaaacagagttggatattaagaaagaacatctttaactgctgtggaaagtgtttactttgtaaaacactagaaccttgtatgtataatgttcttatccctaaggataactttataattgaatttcaattaaggatgttctcttccttttcctcctcctcttctctctaagttgtactcattgaattcatgtttcaatggggaacaaaaatttttcaaatattgttgttctggtaatgctgcattttaggatctggagagggcagtcagtgggattaaatgttatcaaataggttaaattatttggccatttactttggtatagttcctctggagctcaggaggatgttagaggtctttgttgtcagtgaaatcttgtaaatgtatttttaggctgttcaaatgtctggatcacctattttgaacttttgcatataccaccttacattacttatttttataaagtggacattttatctttataaggttttgccttgctggacagtgattatgtgttctaggtctttatagctttgccattacccggcatactgagcacataacagacactcaataaatatttgattaattggatatgttgattgggtacccaagaaaccagaagatgaaataagtctggagttagaacttgatacatgcttagaaaggtaggaacgtaaaagtggattatgaggtctatctcttaggctgacgtgctctcctttctccttccccatccctctccaccccctctcctcccttctctcttccatcctgcctctcctctccctccccctctcccctctcccctctcccctctgccttctcccctctcccctcttccctctctgttttctttctctttcctttccctttctctttccttaattttcttttctttctgttcatatataggtagtagagccagctcacgtttgctagttctttaaaaatcttaagtatttagaattccacagttacaagaattttatggtagagccacaacactaagttttcatttggaaaatgttaaatgtagtgaaccttgagagaggtttttattagttattgcttttatttatttttaaaataagtttcattgtgtatttgtaagatatataagattataggatgcatagagatagtaaaaaggttactatatatagtgaagcaaattaacatattcatcaccttacataggcaagagcagctaaaatctactcatttagcattaatcccaaatacagtacaattttattacctttagtcctcatgttgtacattaaatctctagacctgttcatcctacatctcctccatttccttcctacccctagtaaccactgttttgttctctgtctctgaatatttgaaaaaaatttttaagattccatatataagtgagatcatgcaatatttttttttctgtgtctggtttatttcacttagtacagtgtccttcaggctcatccacatttgtggcaaatggtaagattgagtttttttaagggctcaataatattcatacacacacacacccacccacacacacacaccccccacagtttatccatttgcctgtcgacagatgcttaggttgtctccatatcttatgaataatccttcagtgaacatgggagtgcagatatctttataagggggagatttcatttcttttgggtaaatgcccagaagagagattgctgggtcatatggaagttctatttttaatttctttagaaacctccatactatttttcacaatggctgtatcaaactacattcccaccaaccgtatacaagagttccttttctccactctttccaacatttgttatctttttactttttgatgtaagagctgtcctaatgggtgtgtagtggtatctcatgaaatggcattgatttgcatttccctgatgagtaatgatgttgagcaccttttcatatgtctattggcagttttatgttttctttggaaaaatgtctattcaggtcttttacccatttcaaaatcagattatttgtttttctactattgagttttgtgagttctttatacactttgcatattaactccttatcagatctagtttgcaaatattgtcttccaatttgtaggctgccatttcattggttatttcttttgctgtgcagaagccttttagtttgctgcagccccatatgtttagttttgcttttgtggtctgagcttttgttatgttatccaaaaaaatcattgccaagacaaagtccaggagtttttcccctgtattctcttctaggagttttattgtttctcgttagttagtgcttttaagaaggaaggaggcctcaccagacttgattattattttttttttttgagacggagtctcgctctgtggcccaggtgggagtgcagtggcgcaatctcggctcactgcaagctccgcctcccgggttcacgccattctcctgcctcagcctcccgagtagctgggactacaggcgcccgccatcacgcccggctaatttttttgtatttttagtagagacagggtttcaccgtgttagccaggatggtctcgatctcctgacctcgtgatccgcccgcctcggcctcccaaagtgctgggattacaagcgtgagccaccgcgcccggcccagacttgattattaaaagacatctgctactcaaatagatgccacccttaatctgtcctaatcaagtaaaatcttgttagttatatttgggtagaggaaatattgtaggctaatgaacagtggctgtcaacagttatcttgaaaatctagacttgtagccttgaaggagagggacccgaactgtgaagagatttgtcactaaccatgctatattggatgtaaacctgggagtggttacaggaggtggcttagggtaatatgtgctggcatctttaagtatttcgggaagagggatttagatccaagtggtcactcctactcccattggagacgcaatttggcattgtgtataaaagaagagtttttctaatagtgctgtgttagggtcctgaattccagctgctgccattcaaacaggctcacttaacactcacctggattattctaatgggaattcaaactgggtattggtgacctttgagggctctccctcccaaagagactatgagtgtgtgatttttcagggcaaaatgttctaagtaaatcaagtcatggttcaaagtctagatccgctccttgtaattttttttttttctttttaaagaactcagtcttgggtgctgtttacttcatatttaagcccatggtccccatgtgtattgaactggcacaaactaaacttgtctgctcctctaggtctcttctcatagtctgagttcttaaaattaaggtcagttaaaagaagcaccttggcattttccttattggagtttgctgtgtgtttgcaaatcaaaatgggaattgattcagtcatttgggctatacaggttttcatctcaagtcacttaagtgaaatccataaggaaagatgttcatgctttacctaccatagggctcactcacctcttttcttaaatacaaaacaaaaagcacctgccagttttaagggactgaaaaggtgttttatgatggctgaaaatacatctgagaataataatatagttatacctagactggtgatacatcattacagtatctgcggggaaaagtagagggtggaagtctgtatgtggggtcagtcttaacaaggaaagctgacatgaatgctctagccctgcagtaccagagggcacctggattaatgttctgggccctaattcagcgtcctgtctctcagacacttggcactgatttgctcatctcagagctgaagtcttaaggactaagaggagagaggaacacatcattttctctgccagaggaggtacttaaactgggaaaggaggaggagaccttaacaaatcaagccttggcaaggaaatctgtcatgaatcagcaatgccttggaaagcctctttcgctgtattttacaaagctaaacacttgtcgctactgacatttctctattgcttaccttgaggatcagctttaggtagcactatgaatggaatgaatccttttttgtgtgtgcccattttgacattaggtaattaatttacaactagctcaattagagtccagcccatacagtgtgtacatggccttttaaagagcctttgttttgacgctaattgaactggttgtagcagagacagccaaacaatttgcattcatctttggcagaacacaagggctctcccttggtatggacagccccattttttattccttctaccaagtctggcactaaagtgatgtgtgcttattttatttttctaatttaaaaaaactttgaagaggacaaaagccacataggtttattgtagaaaaattggaagacatagataagcaaggaagaaaataaagatcatacattatcttttcttcttaagacggagtctcaatctgtcgcccaggctggagtgcagtagagcaatctcggcttactgccgcctccacctcctggattcaagcgattctcctgctgcagcctcctgagtacgtagctaggattacaggtgtgtgccaccacacgtggctaatttttgtattttttgtagagatggggtttcaacatgttggccaggctggtctcgaactcctgacctcaagtgatccgcgcccccccccccccttggcctcccaaagtgctaggattacaggtgtgagtccccacacctggcctggagcacacattagcttaataccaagagaaaaccatttacaacctagtatttttctttctataccttttctgtatatgagggaatgcatgcacctgtgtatgtaactgttttcatgtgttgtttttacaaaatgggaacacagcatacaaactgttttgtagtatgcttttttttcctacttaataagatggaagtgccttgtcattttataaaatgttgtcctacaacatttttttttgagacggagtctcgttctgtcgcccaggctggagtacagtggcgcgatctcggctcactccaagttccgcctcccaggttcacgccattctcctgcctcagcctcctgagtagctgggactacaggcgcctgccaccacgtccggctaattttttgtatttttagtagagacggggtttcaccgtgttagccaggatggtctcgatctcctgacctcgtgatccacctgcctcggcctcccaaagtgctgggattacaggtgtgagccaccgcgcccggcctgtcctataacattttaaatgtctgcataatagtcaattgtgtggatgtaccaaaacatatttaaccaatctgttattattggacacttgagccctttccaggttttcgatgttataactagccttgtgatatatattcatgctactaaatctttgtgaagtcttaattatttgcaaccaataaatttctagatattgaattacttggacaggggcatgcatgttttaacattttttatgcatactgccaaattgcaacaatttccactttcagtaatgacagctttatgtttattcttgatattcaggagtacagtatagagagtattgactcagaagtggattaaatcctgatcagtgattttgctattgcccctgaaatttacgtcagccttataatcttctgttcccagtatcaggtgaaagaggccagtttatatcatatagtacaatataggtttacttatcttgactaatatgtgttatttagttttgaaaaattgtagaataaaagcaggtagctgctgctgtaagacaaaagtgcctttgtttttcgtaaggcaggattctgaaacagtgttttcactatgaataaggaccaacctaaataaatagatgaaaatcaaagcgatagtagatggttttgctaagtatatgaaaaaaatatttggatcttcttgaggcagtgaaacccaagactggaggagcaagatgaactgtggcatcttgtatcaggggtggccttggagaggctgttatacctcgtgtatgtggtctatcattgactgaacatttgttatgctgctcatgattgtatttgcagcacctgaaagtgcagttggacaaatagatgctcattgttgactgaatgaataaatgaatagaatagatacacaggagagtgagatttcagaaaaagacctttcaggtcatctaagaccctccccctaattttattttactttattttttgagacaggttcttgctctgtcacccagactggaatccagtggtgcattcacaactcactgcagcttcgaactcttaggctgaaatgatcctcctgcttcagcctcccaagtagctgggactacaggtgcatgccaccgtgcctggctaattttatttttttgtagagacaaggtcttgctttgctgcccaggctggtctcaaactcctggcctcaatcagtcctcctgcctcagcctcccaagtgctgggactacaggcgtgagccactgtgcttagcccatccagttttctaattaaagacatagaagttcagaaagatgaagtgacatctttctcaagactaagttaatgatcacagcagaagttgtagttctctgtatcaatgtatttctgagattctcatagtactagaattgtatgtttttcccttgatatggtactttgtatgattaaatttcaaaatcaatagtaaaattttaatttcaaatgcagtataagcacaatttccctaactcctctttttttcctctgtttggaaatagcctcagtttttgttaaaattcaacacagtcttaaacttgcatttcttttttccttactttctttctttctataatattttcacctatcctatttcattcacagtggaggttttaatttacttcaagcagtattgccatctggatgtcaaaagacattgaattgacttcttatctgtagatcccaataaaggtctcacctgcctagaaacaaaagatttagtcaggaattgaggaggagcaaagcaaaggcttcaccagaggcccaggtgctacctatctgcccacttgttctttgattgacagtggggcacagaggtgccttgtgtttctctaggaagtagcttttgcatacagtgtttgtttggaacttttcaatttgctagtgctgaataatgtctgcagtaaaagttggtttagggtaaacccggagaaaggaattaaagagaagttttaacatttctattgtttttcttctgtgactttagcctttcccccttcttagtgaattattatagagttttattaaaatgtaagttctggaaattagacaccatggtatttagaccagcatgggatactgtactcttaggttccataatatttcatagtacatctctttattgtatgttaaatgatagcgaagtataataaaatgcacctagagagtacttatctattttatgtcctgtaacattcagtacttgatgcaaatgtagcagatctcgattcaaacaggagcaaaactggttataactcaagagaaaggggataggctcatcttgatggaaagttccctgttggtggcataagttcagcaaaaccatagaatttgaggctctaagggacctttgtaacatctactccaatcttttattttgcagatggggaaagaattagccactggttcagtgtcactcagcaggttaaagaaagacctgtgggcagaacctagaacttaacgcctgctctgctgtgtcttttcattttctgatcacaattgaagcatgtggtctaccctgtctttaaaagagcataccatttgatgtttgttagcttgaaacctgttgtgcccaagggcacctaaaggcttccgtcttgctcccttttcctggatgcccaggtcattctgtgcctctgagggtgggtttggatatggctgaaatgaaagctgtgttgtggcagtgcttagagaattgtctctgatgataggactcttttaagaaagcagtgaaaaagcagtaaggagactgttacttcataaaacaattggctctggacttggagaagacccaggtggcggatggttacatcccttggcagcagctgtctttgctatatctcttacagtcttagagatctgggagtctttggctcttaattttaacctagattcactgtatgatcttggtcaaacgcctcacctcttgggcctcagttaccttgtagtaaattcaaggggagttaaagtggatgatttctatggcaacttccaggccttgaattattatttttataaaagtttttccacatgatcaagtaaccaaacatgtattgctgacagtccattttattactgttttgattggttttcatgagaatttggaaaatgtctgcagactttactgtgatcaggctgctagcaattatttacagagcacccatcaagtgttcagggctataaaagaaatagtgtctagcttcagggagacagaaagacttcttgatctccccagccggggatggagggcattctcttccactggatttaagctctgtgagtgcaggggctttgtctctcttaagtagtgcacagttcagtaaacattggttgcattaatgaaagaatgaatccagttgtcagtcttgcttatatttactgaagatatcccactgagatttattggtttcttcaacccgtaaatgctgctaacttgaatacatttcccagaaagtattccttaccttccatagaaaaatgcggccaggatgctctgaggctatagggaaaaaccataaatattccactcctttcttgaaattcaatttaatattagcatattgaatgccctgagattacctgccttcaaatattttggtttaacccagcatttttgaaattcatttgacctcagaatattgttcattccactctcccatgacacacttgttaatatcccccagaactttgatttgtaaaataaaaaggttgatatagggagtaataatatggaataaatagaagcagcaacattagttaagaataattaattgaacacaatggagcatatacattaagtgctgttcctagcagctctgtgtgaaactgtggtagacttgtagattttttttcttttaaaaatgactatctatgtctcattacagatacaaggttgggtggtagagagattgaaggaagttgcaagtgacctaatagctaatttacagttacggaagttgaatggtagcattttaacttgtgtcaagggctgccctgtcaggtactgcaggggaataacgatgaaagggagtctgtgtctgctccttctggagctggctgtccagtggaggagacagacatgtaaacagattatagcaataaagtactcaaatgtgtaatgaacagaaataggacacaggaaggaatggtattttcccctggtttagaacagggttgctgttcatacaataagcccaaaccacattaactggaacccctctagatcctccagacaaaattctactcatacatcaagattcaaacaactcggcctcttcatgctttcgctgatccagaattaattgcatcatctatattgcctgcagagccttgcttacacctgtgtcataggccttatcataatctgctttgtatgtgaattacttgagggcaggatagagttgtctttgtccctgtatctctggggcctgcagttacagcatggactgcatattcgctgctttgtttagacttggagcaagttattggactgtgaaagctactcactttaagtaaattcagtaaataaaattatgttttatggaagacagattggacaggtggtggtattattagcattttctctcaatgcttaaatatgatttacatttcaagatttcagttacattttttaaggaattcaacaattctgcatcatgaagtattctttcacacaaatgttccatagtcattagtttttacagaacccttttcttatattctgcatttcatctggaatactataagcacaagttcagtttggcattctgttctccactagtgattgagtttgaagcccaaggtcaggatattgattgatgacatttccctttaaagtatttgtatccatttgcaatttggggacagagtgattcccagtatggtgcaggaaataactaaactggaagtcagcctgactcagttttgtagttaattttctttgtgaccttgggcaagtcacttaaccttccaataactgagggagttggcccagaactagcacagtcttctaatgcagacattccacgattctctagggaggattcacttccatagaggtttaaaagtggatacatttttaggttaaatggctttgttcatttagtttttttctccttaacccattttggagcaataagactgtcatggagtaaaaccaaattacctggaactctcaaaaggctgcagttcttatcctattttttttatttttaagggaagggaaaaaaatggcaacaaacaaatttatatccatgagtcaggacaaatccatcccagttttctaacatacacagtgtacataaacatattcaatgaagcactgcagattcttaaccgaaaatggaatatttggtttgacttaccatcctaaatgtgggaagaactgtactttgatatatactttttgagtatttttagcaaaaattgatataagcagttgtcttggttggcaaggacttgtgtataggaacctggctcccagctcagtgacgagtgtattctgtaactttgaataagtcactgaacctttctagatgtcagtgtcctcagctgttagatttgatactgttctgattactaacagatctgtgattagacatttccatgcatttatttcaggcctcttcctgttctcttccttgagagattaacaaatatacccaccccttccctcacacagtctcaggcaattattgatttgtgagggaaaaggggtattttaaaacactttaaatgatacattcaagaaaattatctcgtattggttatcaattgatatataacaacattaccacaaacttagtgccttaaaataatacacatttattatcccacagtttctgtgagtcaggaggagtctgggcacttcttagttgggtcctttgcaaggctgcaatcaagatgttgtcctgggctggggtctcacttacacgcttgactatggaagcataagctactgagcccactgtgattgttggtggaacttatttccttgcagctggaggactagagggacttaatgtttttgctggctaggggctgccctttgctccttgaggccacccacatatccttgtaatgtgtgcttccctaacatggctgctggccccctcagaagcagcaagggagagaacaaggcagtgctgcagtcttttggaatgtaatcacataatcatgtatacataatcatgtatgtccatcatctttgctctactctggttaaaagcaagtcacaggtccctcccacgctcaaggtgagatgatcacacaagggcattgacaaccaggaggcaagggtcatgggggccgtctgaagcatctgtcagccacaccatatttcaggttttttttttttctgtatcttcctttggatctgtgaataagtatctcacttcatactaaagcctcaataaacactgattgacagaaagtctttgtgctcatttaaaacttctcagctccacagagtatttgtaccatgcccttgttttatggagtccccagatactgatgagggcagggtttgagtttgagggctgttcattcttctgcccgccaaccccccaccccgcccccagcacagaactgccagtgttaggtgctcattaagtgtttgtcaaaggattataactgttgttccaattgcagcagtaagtaaatttgaagaagctccctgatattgagtgaattgtattctccaccccccaaattcgtatgttgaagctctaacctccaatgtgatggtagtcccagctaccagagaggctgaggtgagaagattgcttgaagccctggagatgaggctgcagtgagccttgattgtgccactgcactcaacctgggcaacagagtgagaccctgtctgtaaataaatatgtgtgtacagacatacataaggttcacaattcaatttaaaaaagagaaagtgaccatctacaagccaggaagagagcccccaccagaaccctatcatgctggcaccctgatcttggatttccagcctccagaactgtgagaaaatcaggttcgcctgtttaagtcacccagtctttggtatttcgttatggtggcctgagctaagacaggccctgtgttctctgtgtagcaagaggcaggaagctaagcacaaaggttgccagatagcagggactggctggctgttagtgagccagggccagtggcatttaattgcagtcattcccattctttgctgagctttggtcataactatttgtagaggacccctagactttttttttttcttccaggacaaaagtgatccaaaacatactgtcttcagtttttgagcattggactaccaaacaggaacatttaaggaaaacaaaatgttgctgttgtaaagccttgatggtgggaagttatgtagtgaattctcaatttcttcttcctgcatcttgtcttaaaaaaaaaaaaaaacttttaaagtttttgtttgttcatcattcattcattaataagtcaagatgtagagggctcagtagccttcccctagttttctacatttctgactttggtaaacttcctttacttctgcaatttccctaattgtaatattaacatatatctaaaaagaatacaatggttatgtaaacctcctagcacttaataggcactcaagacaatatgacttaactgtataagaatgactaatgtgctatgtttatttatttggcttcattcattttgccagcaatggtgtagtatatatgtagtatatattaaaaatctcttgagtaagagaggtttggaatgggaaaaggaaccaagaaaatctcaccatctttcttctgcttggcagcaagtcttgaattctgttttatttttcttaagagacggggtcttgctctgtgcccagactggagtgcagtggtgctattatagctcactgcagcctcaaactcctgggctcaagtgatcctcctgcctcagctacctgagtagcggagactactggcacctaccaccacacccagttaattttttttttttttttggtagagatgaggtcttgcagtgttgccctggctggtgtcaaacttctgacctcaagtgatcctcctgccttggcctccaaaaatactgagattacaggcatgagccactgtgcctggcagagtcttgaattcttcaacagggcttttgaatattttaaagccacataaaatttcctttttaaaattgcaatgaaaattgtcaagtaaagtgggtcattttttgacctggtgcttaattgtacttagaagcaaatgcatatctgtaagtaaggggaggactcagaagtgatttaaagggaggattgtaaaagagtttgggaagtccatccctttcattttacaggttaggaggctgagggcattgtgcaatgatgtatagtcaggtagagagaggaaacaggaatcataaatcttaccttttgtacaaagtcaatgttttcagtaattttgttgaaaacaaacattaaacaaatttggacctgtaaaatccattgaactggtggaggtcagcctgacctagcaggacatgtggcatctctgttttgtgatgctgtatctgctttgggagtcccagtgcccaatcccctcagtgttgaaaacttagctcctgagtttaaggtggtttctgtggggttatggggcagggggagagggtttggaggaggggaggagcggaaaaagagacttccagtctggggctcctgctgtgttaccttaggggatttagggcctataaaaaacacatttacatctctgaatggcaacagataaataccaacgagcgttaattgaaaaggaggagacccaatggactagaggtcaggactctacagtgatgactggtggcctgggggtgtcagctgaaacggtctggattttttttttttttttttctccttcttcccctacctccttcctgggcttagaaatgctggaaggaagaaggagggaccattagttgaactaagaggtatgttgtttatactgttgttgtggttgtccctgggtggtctgaaattttggaggagggggtagggaaaggccccctaaaccttttttaaactagtataatacaacctgactgctacctgcagtttcccaattacccaattataacacaaatttgcacatttttttaaaaaagcaggctgctactgtttctccttatacaaggattttagtcactgtacatcttgtgtctttaaataatgtattaggaacattttcaagtctgtaagtgcttttttaatgagagtgtgaagattttaatgggactagattgcttttcatgacatttcagagtgacttaattgtaacaatgttgagaggctgtattttaaagtttgctaagtatgtctgtgtggattatagtcagacacttaaaaggacggatggttggatagtggaatcagatagcttttccttactactttctccaaatattagctctttgcaaatatggttataccaaaccaggcacaggtcaggattctcttaaaccttttaattttcagataggaacagaggctaataacagaccaatgtgggtaattttagagacaatttccttaaaacttagttggactgcaatattggtcctaaggcctctcctctctccttttgtagacccaggaggccaggctgtctttgtgtatacttcctgttagtccctgaactctcttccctgtttgctttaaaaacatagtgaccttgaccgggtgcggtggctcacgcctgtaatcccagcatcttgggagggcgaggcaggcggatcacgagatcaggagatcgagaccatcctggctaacacggtgaaaccccgtctctactaaaaaaatacaaaaaattagccgcgcgtagtggcgggcgcctgtagtcccagctgctcgggaagctgaggcaggagaatggcgtgaacccgggaggcggagcttgcagtgagccgagatggcgccactgcactccagcctgggcgatagagcgagactctgtctcaaacaaaacaaaacaaaaaacaaaaacaaagcatagtgaccttgtgcctcatttttttttcaggtatttgagttagcgtttctaaagcattatgactctccagataacagtttaccgttttaatgattggaatttcagactcaatttttttcttatctccaaaacaagaaggttattcagaggtcttttcctatgcaaacattattaggattctagaacctgtggcagacttctcaaaattagatcaaatggtcagacactttcactatctttttttttttttttaatggtcttgctctgtcacctaggctggagtgcagtgccatgagcattgctcactgtagcatcaacttcccagggttgagtgatcctcccatctcagcctccttcctgagtagctgggactacaggcatgcaccagcacacctagctgatttttaaatttttttctagagatgaggtctcactatattgcctaggctggtcttgaactcctgggctcaaacaatcctcctgcctcagcttcccctaagtgctgggattacaggcgtgagccaccacgcccagtctcctcagtgccactcttaatagaagcttgtattagtttccaaggctgccataacaaagtatcacaaactgagtggcttaaaacaacagaaatagtctcatagttttggaggctaggaaatgtgaaattaaggtgttggcaggaccatgtttcctcttaagcctataggggaatctttctttgcctcttcctagcttctggtagtttattgacagtctttggcattctttggcttgcagctgcataatttcaatatttgcctttgttgtctcttagtgttctccttgtgtctttacatggccatcttctggtaaggacatctgccctaatccaccctaatccagtatgccctcgttttaacattggtgtctgaaagaaccttatttctaaataaggtcacattgtgacatactgagggttagggctttaacgtatatttctgaggggacacaattaaacccataacagagttctactttgaaaagtgcctaggagattctgatgcagcctgcatgggttcccaaagcatgattcctgacctatctgtacataattcatcaagagcactaacaaacttacaagacatatatgtataatggtatataagtatgagtgatatacagaagaaaaataaacccaaaactcatgtactcatcaccctgcttaagaagtaaaacattaccagtacctttaaaggctctggaaagcctggggtgtttgtttaaaacataggttctcctctgaggggttaggtcagggaggtttggagcaacaatgtgtattagaattcagtaactttaaaaaaaaaaaaaactccacgtgcattttaaagttggtctttaaaattttactttggagtgggatgggattttttttttctattagcgaatagaaaacgtgcaagaaaagatgtagtaacttttttcatagtgtagtagaacagtctttggctcctcttctttttgtgaggtttcttgagaaatctcacctgtacttggtataattttccaaattaatttagatctctgacccagagagacttagagtgatgcacagtcatgtagggggaggatgtgtatgtgtgaagggacctgttattgattatacgtcttacattcttgcctttcttgtgggattttgtgaagattaatatctgccagataggtttaagtttgcaaaatgccttgagttccttgggggaaactgttacataaatgtaaataaattatgcagcacctgaatttggttgttcatcattttttatagtgtgttttaattaagaacttagtgctatttaagttggatggctggggagagggtttaatcactccaagatggttaagtaagtaggtaggagcaacatttaggctggaacccatggaggaataaatgaacaagactggagaccagtcattttccatggcatttgctgagcggagctgtggattaatgtctcttcttgtacgtgtgtacatggtgctgttagaaaatcagccagtttttcactacactttgtctcggacctgtagataccttggacctctctggttttcctgagtaagctggaaaccctaacaacagccaaaacaaaacaaaaacggagtttgtcttacagtctaggtacttggggagcaagaggcatccagcaaactgcattggcttttggtacactgtgtttctgtagtccaatgagctgggttccaaactacctccttttgcctgttacatacagctttgtgttccagtggatgatactgttccttaactcttaaagagtggacatacgaaacagttgccaacaacccgtggtccagttgtgcctcctttgtttgctgctttgtcagagtctcactgtatgcttttttttttggcctttggcgctgtgagcagagtcacctcatcctcctttccgtggccaactcaaagacttacaacctttctccctcattcctatgtatctacagaacactcactagttgctaactagtggatacatgtgaattatgttttgatgccatagggctgtctagtggaggatacaaacattaaaaaaaaaagctaaatccagcaaatagctataattagatgagggttatagagaataaccacagactctttcagagcatataaggaggcgaatctaacccagtctcggattctggcaaattgcttctgaagagtgactctcagcaaaatctggaaggatcactgggaagaaattagcaaggaaggaggaagaaaagagaacagtgccttctaagaaatataccatgaagtcatttttttcctattcctttctctgcccttttccttccccacacagtcttatgcagcagcacaattttagccatccaaactgggccagttgttttgttacactgtggatggttggagattgagagctatgggaatgggtaggagttaaaaactgaatataaattaggtgacaagagatggcaaaatcatttattgggatgattaacttattaaattgggctattcccatgctgtttttctaaaattgtgctctgatggccattttggaagcctggtactacccacagactggagtatgtcctaagtaggttaagagcttgggaaagatgcttgctgagggagggccttctttgtactctttctatcaataagaaataataaagagttaaagcatcgttacattttagatatactttctcaaactgctgacatcagaattgccaggagcctgttaaaaaggcactttctgtagccttcctatcccaggccttctgaattagaatcttagcagtaggattcctggccactgtaaagtactctattgaaggcgtggattaccagtgggttattcagaggagaactttcatcattttagccccgtgggtccctgcctgatttcctgccatctctcactaccaggaccagctatgtaatttgtgaggccccttatttaaaaagaaatattaggaatttcgagacagtgatggtagagcattaaaccaagtatggggccctttctggatgtaggtccctctgggattgcacgggttgcaagcccatgaagatgttcttgttcaccattcctgtttgcctttttaaaatgctcctgcagtaatgaactgcttattgctccctgtgcatgatactgttttttgcctttgtcccttgggtctcactatgtggcatgctgtgtttcatctcttttctgtcacctgggcttacctcagtttttgcacatactgcgttagaatcctgtgcaagtcgcccgtgctatgctgtgtgctttgagggcccggatctgctcttcctcatctttatattccctgcccttagctgaggctctgccttggtcttctgttaagtgtgctgaaagggatacttttttaacctgaatcttttcttaaaacctaattaggttataggccattgggaatgcagatttggttcagagtgaggagttggaggctgtgttgccctagtagtgtcgtgaggactgcctgggcgtgactggtctgagacagtgtgaggaacggggtgtgaaacaaacttatgacatctctggcaagtagtgcatactctgctgttgacacctttgatagctgctaccctctgataaccagtgtttttttttctggatctctcattgaactctgagtttctgggaacagcagatttttctgagccacaggttcagatgtgttagcagaacctgaggaaatgtttcttgcaccaggaaggtggccattttactccgtggctaatatttggaactagtcatttctggattgtttgaactagcgtgttctggggaattccccaaagctggacgcacttgttaaatgaggttatggctctgtggggtgagaaatagacccgcctactatacttaaaaggactgactgtgtttctgccttcaggtaaccagaggtagttatgaatttgggtgaaacctcttcatctcatgatagactagcaactagaggttcagagaagttacacagaatattcaaggttgattcagatagtgactgaattgggactagaatccatggtttctattctgtggattttgagtaagatcactaatcaacatgtgaaatcttccttgtgtcattcaattagaatttaagtgtcaaatggatggtaaaatcatttcttagcttatgtagatcataaagattagcaaatcaaggcagaaaaagacccccacacatatttgttgccaggtctgcactaatttctggataaaggttagtatatatttggtctacagggtgtgatttgagtgtaagttttttctttagtttttagattattgttcaaagtccccactgacagaatgcagggagacagccttgattagattaggccagattagattaaatcgaatggttaaggcctttggagcctccagcttgtaggagacaccataatggccttcatagcgtccttaaatcctattaggtaagttaatcttattgaagatttcaggtctgcataaagcagtattgctcttatactctctatggtgggctctgcttgttaaggtgagcaggcattttaactttccgggaataagttggttttattggtttggggcaagttaatctaaataacttgaaagtagacacctgtgcctgatagagaggccattccatgtagcaaaataggctgtctcctggcttcccctttgcttggtggctgttagtacctgtgacagggattttttttctttgccctgatttggggaaagagagtcaggtgagatgtgtaataataatgtacggagacagtagtatggttatgacactgaggcactactagatattgagaataaagcactttggaacttaggagctggaagcattcttagctgtcattttttgagtgtttatagttttattataggtgctagttggctcttgcctgtttctacaggtgcagtgaccatttttctgaagcaaaatattcttgttgtcacaggcttttcctcaatttgtgaatttatggacctgcaaagttttacaaacacatgaattatgtcaaattttgtaatgtcttttgaaaaaaagggggaaaagtgtaagaaatttagaccatgtaggtctgaaagtatgcttactacatcgatagtgggggctggaggaactgtgaaaaaagtaatagtaaatttccttttttagatctttgccaaaggtagttttgttagatataaacaacttcaagacccacaagtgactactacacactggattggccttcagagatactgggattttctttccaagtatctttaaaaatgaggttcgtagtgctttagctaggaggctgagtgcccactattaagatcctgtgagttaattggtttggttcacaaactaactcatattgcagtgtatctggctgttttgtggctgggagaaggttcctgcattgaagggactgaagtgacactctgaccttgggacttccagtgctgttgtggagtggggacttccttcttcatgtgggcttgctggctcttcatttattgtcccacctgggctctgcctgttactcttctcaggccaagaagtgagttaggttccttatttaacttttctaatggggcagctctgcatctgtgtcctgtccccaaagactaaagagaaatttcaggtgtgggccagattatggagcctgaagaacagttttatgattgattaatggttttgatttgcttttaggaagaaaagtgcaactagcccattggatgaagatagtatctctctccagcactcctgtatcaagtgtacagtgttctcttcctgtatagcacttgtattttcaagagctagggtcattgagagaacacttctcactcatgagtttcagagcgtagcagagtacacacacctgaagcaagaaatgtaattttctctaagtgtactaagaattactttaattctctgtatgtgcatgcatgtgcccacataatggtggtgggtttggttttttttttttttcatgctccttgaggagaaataacccgttttttgcttttattgattcacgattacctacttttcagggttacctttgttaggaagcagctgctggaagaatgtgtgctcattttgtacttgtgtcctttacttctatgtcctctctgacctgaggctcaccctgcctgccacctcctctgcatcagcccagctttgttcttctgggcctgttgtttccactctatgaagagacctccttacttctctctgtctctacttagtatccatttctgctgaggcagatccagatgggcagaggttggggagggaatttgaatgaggggaaaaattggatcagttaggggaaatttataaaacttctgtattctgtgctaatagttctcagatgctttggaatcataagacgggatgttggtctggcgacctttgagagctgctcttaaccagccagtggacagctatgcttgctttttcttcctgtcaccatctctgcttttcttgcccaatttgccaggaagagtccaccaattcttcataagcccactttttattctctcttttgaagtcatcttgattcacttcctacacctgcagcccccagtcttgcttgatctagctcctaatcttctgcttccctttgggacagaggagaagctgctctcctcgccatgctttgctgacatctccaaggggaaggagagcacaggccctttcatatcctgccccagaccttcacagggagcagtaataatgcctaaaccttattgagtacttaacatgtgcccagcactgtgacaaacacttcacacagattatctcttaaaatattcaggccagcccagtaaagtttatgtactgtcattgtctgtcttcaatttgcagatgaggaagttgatgctcagggaggttcaataacatgccattatgtacacagctgaaatgagtgatgcaatcaagattcaaactaggcagcccagttccagggctcttgtccaactactcagggaaaggttttcgaggtcactgccaggatagctggacttgtgacggttttcctgtttgagatatctacccttttacatcaacctaagcacttactgtctttatattttcaatgaactaagtggggtgttctgggtggtctttgatgatggcaactgtgtgttttaaagaaccagaaagaaaaatgtttagaggtgggcttctttagctgtagtccctcttgactgtgtggtcaaataatagggctcctgacaaggaaataaggctataagtgctcttgctttgtaaagattagttaattggtagaggttgtgtttctgtggttaatttgtgctcctgtcttagcaatacatgagtatccacaggcagcaagtgtgtcgcccagcagccccataaaacaaggcactcttcagcaccagcatcagttgatgcacctgaataacaatagggaagcttgttgaccatttggcacttcacagcctagtaattagaaactgtaaaacaataatacagacatgaagcaaatcctccagttaatgaaaaaaaaatctacaatcttgcattgtggctgagtgcaaaatcacaaccggccgcttatacagcaaagcaaacacttcaggattttggcagctgttttgtggatataaaaagctctaggctctgtattaatttggggcctgtcatattttttaaaaactgaaaacaattacctgactttctagttttttgttgttgttgttgttgttgtttttaatttactgcagtggttctcaaattatggtccccagtccagaagtgtcagcgtcatctgggaacggttagaattgcagattggtggggcccaccccagacctactgaaccagaaattctggcagtgcggggcacagtaatttgtttttacaagtcctccaggtgattctgatggactttaaagtttgagaaacactgagggtgtgggaagggtaatttgggggaagggaagtggagtcccctcttggccccacccagagatgagcttctctgtctagtggtgggatagttggcttgagatgtgatattgagaatatatgaaggctccctactgggtcaggaagttgggggagtgtctcaggggagggccgtgccttcctggggacctgtttaggagaagggtcctgggcagtagcttgttactagcctttcgggaacaatttcaatgtttcagtcaccctctgggctgttgtactattgcagtcagccctgctaggcccacaagttgtatggggcagaggagaagaggcatggggacagaaaccttatatcccaggcaaagccttagcaatgctgctgatgtcatatgctcatcgttgtcaagaattgaaaattaagatagtgatgaggtggtggcaggacaaatttcttcttttcactgtatgtcccctttctcttctggatctcatttccctgcctccagctatcttggcagatgggattatttaataattttcttggggcctgttggcaaatggcccctctgccccttccccagtgtgtggtgaccacaacagtgacatagcttcatttcacagccattaggaatcttgacgcagctgacccctagatctcctggaaaggcctcttgggaaatataagcttgccaccagagtgaagtgaattctcgagtggtattaccacagaggctcaggttcctgatgctccttggagtgctaggttaacagtctctctgttggggaaaaacttgatacaaatagaagatttgctaattttgctcacatttcaaaattgtttaatttgcttactttttttttctctttcagactattgggttttatctatcattccttttattttacaaaaaagaacatagggcatgttggccagataatgtatcctgttttttgatttaatcacccaacatagcatgggaataaaaagctgaatgagatgtagccttgctcctccctgacattgaagagactggcttctgggagaggaaaatgaccaagaaaagaaccacccagatcttgggttcagtttattctctctgtattttcaagtggcagaacttgcttgaatatgtgaatttgatgttggatcacaagcccaacatgtggcttctgtgggcatatgtagttattttggattttattttattttaaagggtctgtgtcctgttggcttttaggaggtgatagttgctgattctcctttcatgtgacattcagggctcatggagaagtcaaaggctcacactggtgttcaccttcctggacttcaggaaagatagtccttttgccagatgaatgggaggatctaagtctgttagatttccatgagtcgtgcagcctttctggatcgggacaggaagactgacccactgtccttcccaggctgcctgccgttcatcttgctttaattaaatacacagctgatgatgtcagcttggctcccggctccttcagctttcccctcagaacaaaacatccgggcagacagttgtgacaattaagtctcaagacccaagcttagtttgttctgaggtagttaagataaatctgcctaagcatctccaaatgcagataaaacctagtgctgattagaggtgaccctctaataaacctgatttgattaggcagaaccagcgaggtgcaggcaaatatttgagactctggccaagctgatattccattgacctttcacttaggggaaaaaacctgtttgatttttttcctatcccagagtacttgaaaattattacctatggcagctaaagcactagggcgaaataaacaggtgagacctgtggacttgcccttaagagtcgcagtcagctaccacctgggttgtgcttgcttcctggcagatcagtggagaatggattttgccggaggtcctggcctggaatgataattaaaaaggatgtttcagaacacacccaggtgcgttctgataaagcctgagcagatgtgggtggtgaaggattttttttttaaagtcaaactttgtttataaaggtaacttctaacaatttattatagaaaagtcaaactagaattgcattagtttgtttatatcaagacctcattagaaattaaggagaaatttccttaattgctccatctctggctcctgtaacagtgggcatacttctcttcttagcatttatcacattgttctgtaattgttggtttaccttcccttttgtcttaaaaagcagggaaattgtataattattcttgatgttgctcaaatgcttggcacctgggccaggtacagggattggcaaagtttggtccacaggccaaaccaggccactacctgtttttatgcggtcatgagctaagaacagtttttgcctttttaaatgattgaaaacaaatcaaaggatatatatttcatgccacgtgaaaattatgtggaatttgaatttcagtgttcataaataaagttttattggaatacagccatgctcattcatttacgttattgcctttggcatcattttgcactacaacagcagaattgagtagttgcagcagaaaccatatggcctgaatagcctaaaatatttgctatctggcacttcacagaagtagtttgttgatccctttcctattatatagcaggcatatagtgtaaatgcttattgtttgaattatttcaaatataaatctgagtttacaaatagagttattctgatcctaaaagtgttcagtgaaagttagatgaatgactgaccaatctatttctcttgttattcatttgtaaccttaggtttaagttttagaggtagtggttcgtttattagagctagacaattatatactatttctcttctgagaaactttataaagagttaatccttattacttttctaggttctgaacctactatatgggatgcagagacaccaagaggcacagagaggttaaactgactaagacacacagtaaagaaatggcatgactcttcatgtcttcatctctttctttgtttgctaaagccattctttgtgatgaaagagaagtcaaatctggagatattcatgagcaaactactgtctgatactatataatgcattatttcttatagacatcagtatctttgtaggctctttggttcattaccagggaaattcatttaaaaaaataataaatatgtggtttaaaaagtaaatactgcagagaatgatagcaattaccaaatgtaaacaatgtggcctttgagaaccactatgaaattgtttagtgaattaaattattatgcttttgctattcacatatccacttccattgactgttaaggaatatgcttcaaggaggacagatgagatataggtaaagtttatttttaagatacttaggtaaaacaaaataaaccagcaactggcagatgtttggtgaccttgaaatctggcttttgttttgagacagtgtctttaaaatgaccagtgccacaaatgtaaacaggggagttggagggcattggagtattcaggaagaaagtgagaaatcagtaatttgtagaacatgactaactggaactattgtttggtctgctggggtttgagggagtagaggaatttgtgaagaaggaaagaaggttaggagatgcatagagcagagaaacaagggtctaagctttcctaggaatctcaggtcagacccttgttaaattttgtccgtatattcattgtttgctgtggaatcttttaggagagtgtaatttttttttctgtttttctcttattaaataatttaaagggatgacattcagggctttgggaagcaattttttttttttttttcaaaacgccgctatacctactaattggatatccatcaggggatggatacttacaacagctctgcatgatagggataatattcctattttatggatgggaaagctgaggcttagttgtttttttttttttttttttttgagatggcatcttgctgtggctgaggcttagtttaattggctttcccgaagttttacagttagcagccagagccaagtttcaaacccaaatctagctgactccaggggccttctgttgtttctactatcccacttcctcagtggttgcatcccagagatttcatcgtttggtgcataaatccagcctaaagccatacttcaccattttgtgtgaataaatctcttcctcattttatgactcagctacctgctttctctttctaacctgttattttgtacatctgatttgttagcttcccatgttcccttagcttccctgcccttagttgttaacccttttgatcaatatctagttgattttgctacttaataacagactttagagggacttcagaggataaaaactagaacctccaccctactgaaaaattacatttggtttgccgttggtagtatgtgccccatccttctgccctggcactccaggggaatcaaaaaggaagagctgagaaacagcattccaggcttagaggctccacattctttgggtttgttggaagacttcttggcagcattgaaagatgcctgtgttttcatactgattttccatcctgggccacctgctttctcccttcctgctgttttccttttgtacctatgtggttggtgcttctggggctttttatagcagctttcatcatttatactactgagttttgcaggcgcttttcttttcaatttttgatgtttgacagtatagacttttatttatttatttttaatatgttcacttctgaacctttttagacttcatggtgacagcctccaggagaggaaaaacaaaacaagggaaattctaggaagaggcagaaggtagttactattgatttctctggatgcagatcctaactgttggcaaatttaaaacttacttattttgagtggaggtggttctgtgttagtgagaagttgatctggaaaagatgctgatttggacatggctgttgtaaaactaatgatgaagcaaaacaaaagaaggaatagtgcattttggccaggcatggtggcctgtaatcccagcactttgggaggctgaggtgggcagatcacgaggtcaggagatcaagaccttcctggctaacacagtgaaaacccgtctctactaaaaatacaaaaagaagttagctgggtgtggtggcgggcacctatagtcccagctacttgggaggcttaggcagggaatggcatgaacccgggaggcggagcttgcggtgagctgagatcgcgccactgcacttcagcctgggcgacagaggaatagtgcgttttcactttttaaccttagttgcacagggtatgttgaaagctactgttggcttcaccatgtcattgggaagtgggaacgctgacaatcaaagcagctaaacaagaagcaactcaggaattatgacattggcggcaagtcttttgcccctcttcagaggtaacactactagatctggagagagttctgtacattcagggaatcttcctgatctctaaaaaatttgagaggactagagaggagtaaagactggaacctggatagattgatttgtgagggacaaagattcagagaagacattttcttgaaggtgatgaacctgctttaccaaaatgttgtaaaaattctaaagaaaagttaattggatcaagttgacaataaatgttagaagggaaaaatcttaaagggtaaaatttgaaagtagaaagtttgtcctgtccacagtgtttgccatttcatagaccaaggtggttgggggaggtggggcaaaattactgtagtttccagtgatcattgccttctctcggtcctataaatgcaggcactatttagcactgaaaccatctggtgttggtggttgtttcttatgtcgtatgacctgcctctataaatacattgtgtataagcttaactgggacagtaattggtgtgatccttttctttttctgatctctaaggtctgaggcccatgaccaagggaaagagaagtgctttttaaaaaaacggacacttttgttgttttggtctcatggtttcactgaggtagtgttccacagtgtaagacaggttaggattgtatgttccagaattatgaacaagagtatccttgggaatgataaaaaccatgctgcagtgttgcatgtgtatttgtgtgttccatgtggaagaccttctgggctgtgtctgtctttgctatttatttatcacctgaaatggtgctgctcaaccactctgtgacagtgttattttaacttgaaatagcatgagggttaggagaaaatacctcatgaatgtgaagggggattctcctgggcgtatgtaattgcaatgatttgaaatgctttcacaggtttgtaggagagggtaatttttcttctttatttgctccttttatcttgttctaaagccagtattacctcctctcccaccgcccatgtatacttcttattcccttctccttccccctccctttctcccactctccatgtaaagaaactctttcctaataagaatcataggtattcagagctttttttttttttttaattaacagttgatttgactttttagtactgtgtaggagatgggaaaagtcagggccatttgatagtaattgcttcctggaagagccgaccaacttattataagggtgaggagtgtttggaggcattattttctggttccaggtgtgttttgagtattgctggtggtgctcagcactcttgacatttggggctggattactgcatgttgcaggagtatcttgtgtattgtaggatgtttagcagcatccctggactctacacaccagataccagtagcacccctcaagtgtgacaaccaaaaatgtctccataggttgccaagtgagggacaggatcactctggttgagaatttctgccttagaaagaggaaaatggattccctggaagcagaggttagccattaaccttatagggctggagccttcatttaaatgctttggtatattgaaagcaccactcaagtatcagtggtgagggcacatttagcttgttgaaattcctgtgtaattcataaatatcatattagctcttggcttcaatttcctaacactagaaatgtagatttttccccttattttcaaaatgaggaggattgtagtaaaatatagtaatctctgaggtcgctcccaacccttacattttatgattttagttataacagacatcttatggaattacacaatataagagttgaaaatgtatttgtgatcatttagccagccctcttctgttagttctatcccgtgtgatttccacaaatagatcagaccagaagaaaatagttgctttttacaagtggatgttattaaatgctcatatttagaatatttatcagaacagacttatattacagtgtttacttttctaactgattgagattcaggtgacttaactgcctaagcttcaactgtctgttgtttggaattaggcttttaaaagttggtctttatattaatattcctatgcctaagctggtactcttattgtcaaatagctttatgctctgttacattaatgagggaaactttgactttccagagtgccttggctgatatattggtgttaaattggtaagctttctatcccaactgctttatttatgctttaaacataaatgaaagcagagaatttttttttttggcctgagaggtagttaagagggaaatctaataccttttatgggtttatatgcttcatatgtgatgtgcccaaccagaaataataagatacaccccagatgtgaaggtaccagctaatataattatgctggagatcattttcaccttttgagggctgaattacattgaattcatttcttcaactctaacaggatttggtatagttacttaaatttgaattgggagctgagatgaagtcccaacacttgtgcttttactggaaggattgggttgtgtataccttttgtatttctgaagcttgataaactataaagccttgagtattcaggttcatggcaaggtttagatggatggggaggtatactctagtagaatctaacagcttagtatgctttctgtgggctcttgcctggaaacccaatctgaaggtatagtgatcagacacaatgctattcttaagccttcttggaaataacaggtgtcttagcctgtggtaaaaaggtaattttgcatgtattaaatattcaaccaagggcatgatctgtgcttattttggcaaacaaatagatcccaaaatgaatcaaacaaattgtaatgcagaacaaatttaaatacttgaggatttgttttagacatttaaactcatattttatcctctgtgtcttcatagtaccctcagaaagaaaagaatctttggaaatgtcagtgaaagggcagtataatctcacactgcagttgtggttccggactcagtctgtgtgcctgtctttcctttcactcctagccacgtgacaacacaaagagggtacttaaagtgtttatttcaccctggaagatttttatagagagcactttttaatgaagcacagcacatggcatcattatcatttctaacacagagaactcattttcaattttgctatcaaagaaaaatgacaaatagagaatgcaagaaaaaccagatggactaactgtattaggagcttagtatgcatattttgtgtcacatattagcattcattaagtcaaaagggaaaaaaatgagttttgcctacatgcattaaaccaataaggctggcaaagttccaagctagctcttgtgaattaattgttttataactgttttaattaaaattgttcagtatatgattaacctaaaagttttaatttccacaaaactgttgaacaaatgagacattaatattttacgttaaccatggcaatattgctgtggttttcagagctctgcttgttcaagcaaagcatggcaagtggtaggtggaaagtaccctgtgtctcatgccactactaagaaaacctgcaaatcagaagcaaattctatacacaagcatttatgtaggcatcgccccaaaccccctgttcagacagtctagttagagctgggcacctgtcataaattgtcaggttgaagaggttaacgatataacatggcaagaatacatttattgtctttttcttccacctggcttcatagtagtgttggtgtaccgtgtgagatccttagattagaaggggttggccagtagggactatgaaatgattgttgttaaattctaggggtttaatttaggatataggtacaaatgttagttctggaatcaaagggaagaaagagaagatttggatgacgcatcacctttacttgaggttctttaggttggcatcaggctaactttggtaaaaccacatcccattttgcaaatggtaaaacagggttggtaaaatttcactgtgtatagctgtggctcctgaaatacacagatttgcatttctgtcactcctccctctccccactttccacatgtacccccatcctaatgtacttcactttgttaaaagatggggatgtctttcctctctcctcccctaagcctttcactttgctctgtggatttgggtcatggtgctgtataaattcaaggtaatgatggtatttgaaccccatagaaggatattttaagagataagattaatactgctcagcataaatgatgataaaactcaggctgtcctaaatgtctaggtagtgatgcattttttaaggcactagactgagcttaccttttaggttgtatgacacttgatataagctgtccttacaggtttaaagctgtaggagtctggaatgcaaaactgaaccacagaagtatattggccttgcacttacatagtcaggatcatacggcattgtgatctatccagatttccagctgcagtcctgatgtggtctcttcattactttgtccagctgtttcttcccagacggtgctctgtgttagccttcccttctgtataatcattctcttccctaaatttttctgtttaacttgttaagcaccagattctgaataaattattcatataatcagtatttttgaagtagttaataatcagagtataataataaattttatgattgtacaggttgccatatttgccagaaatcagctttacacaagtgatttttgagataaatgctttattgggcatgttgctatctgttcatttcttcaggctctcttgatttctattattgtgtgaagttaggccattagaaatgcgcatacctggaccatattatttaggctcttcagagaactgccatcacggagttagagtgctatgtccttggtaaatggaaagtaagagccctcaatttaataatacagtattttatagtcaaataatacatctggcttttgtaaaaccttaaaagtaatctggtatcttaatgtttcattatacatatgcatatatgtgtgtgtatactcacatgcatatatacagacatacatatgtgtacatatatttacacatatacgtacacacagtcatacacatataaaaagcttctctaagaatttggagcgaggaaaaaatgtctgtcttctgaccaacatgtatacattcttctaactctcatgtgtttgtttagtgaatgaatgaatactatgtaattaggtaagagaactattgccttaccctggaaattcgaatcgtaattcagtaaacaattttaggtacccatcctaagtacttgttgatcaaatactattactcttttgcttggtgagtattatttttcatctacttttaacaggttcttctttggttaaaaactgacttctaaaataaaacaaacagaaaacctacttacttctaagccgtgatatgtctgtattggaaaataggcactggcattgcaccatgttccccatgataaggaaacaataagaggaatcatgcgtatggttcctgtcctgtaaagtctaatgggtggctcacacctgtaatcccaacactttgagaggtgaaggcaggaggattgcttgagctcaggagttccagaccagcctaggcaacatagcaagactcccatcttgacaaaaaataaaaaattacctgggtgtggtggtgtacacctatagtcatagctagtcgggaggctgaggtgggaggatcgcttgagcccagcatattgaggctgcagtgagtcatgatcatgcccctgcactccagcctgggcgagagagtgagactctatccccaaaaacaaaacaaaacaaaatacagtacatgtctggcaagaaggagaagtacctagctcagtccattttctactgaaaatgggtaatatataaagaaaaggaatttatttcttacagttgttggaggctgagaaatccaaggttgaggggccacatctggtgatggccttctcactggtggggactctacaaagtcctgaggtggcacagggcatcatgtgcaagggggctgaacatctagttcagatctctcttctgataaagccgctatccctactcccacaataacccattaatccaccagggcagagcccccatgacccagtcacctcttaaagactgtatctctccatgttgctacattgaggattaagtttcaatgtgagttttggagcagatgaacattcaaaccatagcagtgccaaaatcaagcttttgttttgttgtgtttttttttttttttttttttgagatggagtcttgctctgtcgcccaggctggagtgcagtgagatgttgtcttggctcattgcagcctatgcctcctgggttcaaacgattctcctgcctcagcctcctgcgtagttgggattacaggtgcacgccaccacacctggctcatttttgtatttttagtagagatggggtttcgccatattggccaggctggtctcaaactcctgatctcaggtgatctgcctgccttggcctcccaaagtgctaggattacaggtgtgagccactgcacccagcccaaaatcaagattttgacagtggggctgtaatagtagtttggaatatacttcatttattctagttcttttctctattttattacctttctgaatgtgctctctgctcccctggggcccattcccaatccagtagcggcaattaccattgggataaacctcctacctctgaggcccacagttttcctgaccatctctctacagcctcacttccacctctacctctccataaaacaatgtgtatacttctgttcatcagctaaatcactatacctatcttacttgtttttctgatgcaacaagcagccttccaaaaataccaccaagtctaataatccttttgctgtttagtacatcttttgtttgaggcttactgtcacatgacagatgatgacaggcaacaaatgactgtttaaatggtcaacagatgtgcccatccaggtgactctcctaatagttgacacacagtgggtggagggattgggttgttccagatattccctgttgttgggctagcttgctcttggtgattatagtttgacttattttgcttttattcagtttttgtggttctgttttgctacttggttttgatacatgtaggtagtgtgggttccattttggtatgtgaaatttcatatcatgaagaaagttatgattataatgtagcgttagtaattcccagtggtcattcccaaaaaatattttctgagaatgccaggtgtatataaaagttatttttgaaagtacacatgtagtgtgccacaccctctatcaaaacaggcccacattactgaaagaaggagggaaactacccatccactattactttacagtacttaaaatatgcagacaaatacattttagcacgtggtgatctttgtgaggatatcctgtcaatcaagagagtaaatatcttttctctttcccatgaacctagcaaccaatttgcttatagttccttcaaagctgttgttaagattattttgtggctggttatgtcacttggctagaaaaatggtactggaattaagtcagctttagccctatgctgcccatctttcttaacttatggtcagccatatgtttagaccagatgaggtaggaggtatgattggatacaagtacattcctggaaaagataaccaaaatcatgttctactaaaagtgaattactgtgtttttttccttcacataagaacagcatcttcatacctatggcaagaacctgtcatttttttttctgatcacatatgtaaaaatcatttgttggtagtagcaattaacataaaagtcaggttagtgatgtggttggggtgagggagatttgaccattgagagacacacaagggggcttttgaggtactgtaatgttctctttattaaccatacctgtggttgcaatggtgttcattttataattcttctgaaaaacagacatgttttctacattctgctgtatgtgtaatatattttgctatatacgtatgttttactggagaagaatttcaaaaatacctaaatagcacaaagtagaaaatgttatcagtaatcctaacactaagaaataatcgcaatttttttggacatgtatcttcccagtgttttggggacaaataaaaataataatgtatatctactcccatgagttaagattttaagaatgcatacatgtatgtatgtatgtgtatgtacaatatatatgtgtgtgtatatatatataagtatatacaaacctgactttttgatttattatattgtaatattttgacatgaggtttcaggattctatagagttaattttaatagccatatagagtaccattgtttggctatatcatattatttgcccaatcctgtattctctaacatttgcttgtttctaatatttatgtgttataaataacatgtatttatcttgtaggtatttaaaatttaaataggctaaatgggacccttctttatgtagtatgtagatatttcataaaaggtacattttgttgggaaagataactctggcttcaaatgctttttgaaagatgatttttttcccctcaaagaaaattgaaaacaatttcactttttttttccttttatgaagcatgtgtgtgtcatttgttgtaagaaggatatggccctgacatcttcatactcgattgttctctgtgaagttattttatttattcacttattgaactcatttattgaacaccatttgtatgccaggtgctttgttccagatctgaggatatagagatggagacctggtttctgctttcacagcctggcgacataatggatagcagggtttgggatgttgtctgtccatagactcttgagtttatggatccaaatgtttttgcttagattactttgctgtgatttttattattagacaggtgatttaggagcttatgtaccagagaggctgttgctttcctccctccccagcccttccacccccagactgtatgttcttctttaaggttgagtcttggaattcagaacttggtgagcaagacctgactagaacagaaatggaaatgaccttttcatgcacagcatgagcatgacagagaatgggctgtgtgttaactcctctctgatattgctgaggtcctttccagccctaaaattctgtgatttttctgatacttgggcctttgaagatcctaatacccaatcctttctcaaacattaaatttgtagcagaggggaaaaattaaattcctcctttttgagacaccagctgaactttgcagtataaatagactcaagagtgaaagaaaggagaaaagtgcattcacccatcccaggaaatcagatggggattgagagtgtgtctgttcatcttctgtaaacaaaaccattagtaacatggttgttttttacttgatccctcaaaaaaaaaaaaaaaaaaaaaaaaaaaaaaaaaaaagcagctgggtaccgtggcacgtgctgtgtaatcccagcactttgagaggctgaggctggaggatggcttgaacccaggagttggttaccaatctgggtaacataatcagaccctatctctacaaaaagattaaaaaattagccaagtgtggctttccaactacttgggaagctgaagtgggaggatcgcctgagcctgggaactcaaggctgcagtgagctatgattgtactagcactgtactccagcctgggtgactgatcgagaccctgtctcaaaaaaaaagcatcgttttagggtttctatttgaatagacatttctgtggcttgagtttcgagttaggaatgttttggcatagaaaaacctgttggcccagaaacatctggcatcattcacaatcaggccaaagtaaaggaaaactaattttttaggtagaatgttggcacctggaagaatggaggctgtaagttcttttgctggcaaagtataaaaagaaatgtttagtggacaggtgtgtgagttaaactctagagtataactaagcagtgtggctgcccattttttacttgatttgcttgtgcttctaccaccttcttaatgtgtccctggaatgcctacatgtaaaaggattctgatggagaagaaacttctagaccttaagtgactgtcctggttccagcactcatttagttgcataaccttgggcaaatctctcaagaaatctgttccgtcttctgtagaatggggtaataaacacttactcagcctgtttcacaacattgttggaaagattaagaaagcatatatgaaagtatgtactataaggtgatacttaggtattataaaaaaagtgaacagggatcagcacaaaatgttttggctgctgctgctgctggtgtgtgtgtgtgtgtgtgtgtgtgtgtgtgtgtgtgtctgtgtgtgtgtgttttgtgtctctgtgcctttgtctgtgtttctctaccaccttagatttggcagccctagtatctaagtgtgaaagtttgggatggatctcagggtttttttggtaatgatgactgactggtatggctattgaataaaatattgaagatgctattggtcctttaggacaattagttttgtctctctcctttaaggtcatttggatgaagcagcagtttgtgtagaggatactagtttttaagatatttttgtcctattttattttattttattttattttattttcactgttattccacaaaaatctttgagctggcttacaaaaatgtgtacaatgcaacagaattaaaataagtagaaaaggaattggggcactgggaaatgggtagggaaaatacaataaagccatgttaaggcttctgggcagaaacatgcaaggcagggtctgaggcagtaggttgagggggggtcccatattcagcttcccagagagtagaacaaagaggggaacgtaacttttctttttcttttttttttttggaaatggagtttcattcttgttgcttaggctgaagtgcagtggcacgatctcagctcactgcaacctccgcctcccaggttcaagcaattctcctgcctcagcctcctgagtagctgagatcacaggcatgcaccaccatgcctggctaattttgtatttttagtagagacggggtttctccatgttggtcagtccgatctcgaactcccgacctcaggtgatccacccgcctcagcctcccaaagtgttgggattatagatgtgagccactgtgccctgctggaactaacttttcttgagaaactttgtcaatggagaagatgtgtccatgaactctatcttggatatacttatcaatacacacaacggtgatttgtgaacagttgcttttataccgtcaatgcaaattaataacactgagacaaagcatgatttcaggaaagagtaactataaggggtcaagatcatgtgtctcacctagatagctcaaaggactggcttgagccaaggacaatttttagaacatgtcgaggagaggataagctacctgtcctcaggcagtctaccacaaatactctttatctcagctgggagctgacatctctccctgaaaggtttccagtgatattgtggcacaatttgttggccagaatcctagagacccagggatggagatgccagtgctgtcttgagagttcagtgtcttccctgttggcatcttctctttcttggttctggcatatctggttcaaggattagacacatgaattgatttagttctttgctggagagggcagcaaaatgccagttgtgatttttgggcttggctatgttgggaaccactgggaatttgtggactgccaataactcattttgtactagcttttgggtgaccattcagtggctgttatttcaattcatagttcagagtgactgtatttagacccatcatgtttctagagttttttcctagattcaaatcatggtaaatgctttcattagataatttagcttatgccctttttcctacttttatgtttccctgttgttactagccctagatacttaaaaaaattttttttggaaaggactgtgtgtttttagatatggggattgtattctgtgctttagtggggcacagaaggagactgtctggttaaggcaagagattgtggtgctaaaaaaggaaatttggcaggcctgttcctggtacttttagtaagtaaagaaagagaatgacaggctggctggggattgtattaaagggagccctgatcctcatatgaccttattccctgaacctagaaagatggtctgcctatgtggcagttattctatggcgctaaagacagttttgttctgctttctgccatgtatatttaggggcctaacggagagatagaaacctgttaaggaataatcatggatgttcaggcctattgcttccttcacttatccagaagccagcctcaccaatgtccatgggcaagtttgtgttcacacaagttgcttgtaacaagagggaagattctcattaagaagttggccctaaaatcaggatagaatcaggctatatttgtgtttctgtcaatagtctgaattccttattggtagaaaggtcttataattatggggtaactttgccaactaatagtactggggtttgatgtgggttacttacatcagaagtcacatcaactttttgacattagtttctattccaccatgtgctccagggaaaaggagattgatgtggactattaagccaaaaatgagaatctgttattgaaacccagaagtctgaaataagggtttagtgattgttttgtttagacacaaacttttcttcatagatgctttaacttcctaagtgagtttatatatttttctaaatatgtaatcttttaaaaatattgcaaatatttaatttatgtatttgccatttaacaggtaaaacagcaccaggaagtcttgctcctgttttgcaaaggcacatttagagagtgacagaggtttcccactgtgtctgggacaagcctcccagtgtgtctgggacaagcctgaaaagagtgccattttgtctccctgaccatttcactgattctgtacttgttgtttatgaaacttcattatgtaacagacaaaaaagcaatttcatgagcaattcctggaataggcaagtggacaaaaatttctcaggtaccttctctggaggctgtttgtcttccattctggctgcctctcttgagaactggagtggcatagtggttaagaccaggggctctggagactgcctggatctgggtgctggtctgactcttgagctgtgggaccttaacttctctgtgcttactgtccttacctgtgagatggagatgattggagtctccaccatgtcaatgtatcaacacttctaaattatttagagcagtgcctgagacattgtaaacacttaatatatgttggttgttattgtaattttaataataatagctattaaattattattctatggctgtcatgcctgagagttcatcacaggggcatgggtgggtgggtagggaataagggctgagaatctaatcagttatttttaatttattgggcaaaaatgaatcaaataaccgtggcaggcataatgaaattgaggtattcagtgtgtggtgaggatgaactgttttatcacagttcctctggtgtggcctgtgtgctttgattgcaggtcagatggctagggaaaagagtagtcaagctgaatgctctgtggtgaggctgtgagagggacaagaaacgtgggtcaggacagaaggcgtactgcaggaacagattccgaagtgtgtgcacagcatcctataatttgggctcctgtgtattttctttagttggttgcatttgttaatatgttagtctggtgtctttaaccctgtgactgacagttgacaatggtgtagctctttaaaagaggtgaaactggtctgaccacagtttacccttgatagtgctttcactttggcaacaagacagagggagaaagtccctgcttctctgctctgggaatcttaccaaatcaataaggagtctctggtagcactaacctcttttaaatagcctaagtgtgagatcctgacctttttttctgtatgtggcctacttccttgatgagaagctggcttttatattagaacttttttagacgtacatgaaacttgaatcttgctatttgtttccattgttgcttttaaaaaataattttacaaatttattctaataatatactaacgtattttgtctccaggactagtgaaactttttaagatttttaacagattcatctagacacctaaatctctctaggacttgatccttctccacccagcagaatactgtactgtgctgtgatcatttctcagggtggttttggctgagggtttttttttttttttttttttgagatggagtcttgctctgtatcccaggctggagtgcagtggtgtggtctcatctctgcaacctctgcctcccgggttcaagacattcacctgccttagcctcccaagaaactgggattacaggtgtgcgccaccacacctggctaatttttgtatttttagtggagacggggtttctctatgctggccaggttggtctcgaactcctgacctcaggtggtcctcctgtcttggcctcccacagtgctgggattacaggtgtgagccactgtgtccggccttggctgaggtttgactctttgcacccacagtcccatgatgtgtgtacttgtatgtatatatattcacatctgaggactgacatcatttcgcagaccgggaaactaagtgtgaggagtacattttaaaataatttttacattatatattggcagatcatccatgtgcttgtagaaggtattatattggtaagctgcaggtagacaggaagactgaaagagaaggtagaacctgcttggatcccagtctgtgcatacctaaggagttgagttggcaattcctgaaccaaaggttctggtgttcagaaatatctccagttattcagaaggatggcatgacattctaaaaataagaaattatttgtagtcacatcagtgtgtaatataccttacagaatattagaagggagatgaagcatttggggattcaaaggaactagttgtagacccttaggtatggccctgagactacctagggtggcttttgtagcaatctaaacctgtatcctgggatgttagcatctctgaacaaaccttttctctcccctccattgagatcactttctttaaagtctttatgcatttagagagttgctgaggcaaggccatgtcctggtttgctctttttaaaatgcagatgtttctagaaatgactataaactgagtcctgagccacctcttgtaacttttcaggtcttggtctgggggaagataaagaaatggaggtcttatgcttcacaatttggtttaagtcaactatggcaaggtatcttgacttaaataagtgtgacttaagtaagtctgacaatttaaatattagaatggtaagacatttttgtgcctctatagccatatgtccatcttggggaggaaaaactgaaaataaacgatgattacttttcagtattctgtggaaatcttacttctctttttagttaatttttcagtggataggctccctacctgccagccctaaattcttatttattcctgaaactctggtttttttcttttttcttttttttttttaaagtattctgaaactgttttctgaccatgcttcatatattgaagtagatttttttcacagaagggtaaaggaagtgcattatgtttcatatgtagatgcttttcaagaacacacagcttctcatcattcattttaacagtggacaattttggtgcctgtttatggagattccttgggaattatcagctgatagaaaatttctgaagagagatagaaaatctaatctatttggatgtcttgttaaatggagctttttgagtataagggtttctgaagaaatataggctgtcagagctgatagagtttagagagtctctgtgtaccattctttataaataaagacagccaaaagcccagagaagtgaggtgcttgatgttaagatttagttagtggccccctactggtctctgagctgcccatcactctaccttgactaatagtgataactgatgtttctggcaacaaatccaaggtacaagttttccagggtcttcaaaggaaagctacattatattaaagttcatgctgaatatcttttattgtgttctgatagtttgaaaattggttatttttgtactgttgtaaaactatagtgcttaactggaaaccccagcattaacccagcctttgccagcgtttcccttctataggatgagaaagttgttgaagagtgaggaaaaaagatggtatcttgtccttaacaaaaggtctacgtggatgaaaggagaaactgacacttattgttagggaaatggtaatgcttacatgatgatctaatctgggtttgagtttcgtttttgaagtcaccagtttttattttggtgtttttcagatattcttatagccttcctggggagatttattttttggagacatcgctcacattgtttactcctctaggttaaatgtactaggccatctgttgttaattttgtagttgtattaaattccatcctttggctggattttaagcaccaaaagcaaacttagacagaagcaggagcatttgcaaattacatagctttgagcctaaatggtggtttttataagtgcagttttcaaatgggctgagattctattttgagttttgggatcagtaatttaaacacagggacctctacgagttctctggaaaagcccattttgagaccctgaacagttgttatgccaaagcaagctcttggggtaaggttggcagtgatgctgctgataaattacttttaagatgcttggggctgaaggacaatgattttgtaatagtgttttaagttctcaggctgacctatgaaatctggaagtgctcatctgaaaggccagtattctttctgacaggcacaggaaaaactcgtcccctgcttgatcctcatgcaagcatttcttggaggaagccaggcctgtgggtcttgggggccagaacagagacactgagagcaacactactggcattttgaatttctgctgaggctgcaaaaacatttcaagggaaatctgaagttatcccttcactgtctacagcctcttgaattgacttctgggtgttacagatgggaccagcgtgtgtaaaagcagaatttatattctatttggatatcagaatcaagtttctctttttaaaataattttatggtaagtcgtggtttctctgatatgatttctgttgtgagcggaacaaaaatcatggcgaaatggtgttattacttaaccaaattgcctcgtgtacagacaggctgaactggtgctttgcctagagttggcctggagttttcagaaactcaattgtggcctttataaggctgtgcctggggttgtatttccaatctctctcaacttttgttcttgtggaagggaggaagtagagctgtgacagatatattgccagatagcacacaatagcacacaaaacgagaaagacacggcgtgagccattcatggagacagatttacgctctgtgctgccctcaaaccatagatccatctatttcagagaaacaacttgcccactgtattatatttcagacagggacatggcttagaagagagatgctgactccttctgtttagcttttgccgataatgctgcacgttttgctgtagaattacttttgtggggatgggaaagtatgtttggcaaaggaaggcctgtctctagattggaagtggaagaagggagatatcaggagagtaattggccatgctgtcgccatagtgaagtatatgtgtatatttttgctgggttttgtttccagccaactatattatcaggtgttggattttttaaacttacttcacaataagaaaaacaaagctagagagattgtgactggccaaggccagaatgtttggcattcgtagtttctctttagttctctctgtaggaccatttcctggagttacagaagaattgaccagtgtgtcagtgtctttcatgtacattaatgggcgatagtattggtagtggttaatataatagcatgggttctggaaccagtctgccaggatttacattcaggctcaacaatgccttagctacatgcctcagttatcttacctataaaatggggattccaggtcttaccttataaggcagctctgagaattgtttagttaatattgaggcagttataactaagtgttcagtaaacttagctattgcattttaaaatttgtgttgattttatggaaataaatgatgatgtgtgatacctggtagattgttcggcagacatttcaaatgtaaaaaaataactctgtctgcattgaaatctttctagattgatagttttaaataatgaaaaaaatacttctgggaatgatctacatttggaagaaatcaggaaagagaagactgtgtgtacttttgcatttctatgttttgggcttgtaagatatgtgattgtatatttcatgtcagtaataatttattttggggagtagaagcaaatgtcagttacatacatcatctatggaatagatttttagttttatttattttaactggatgaaatggttgagtgttgccttacttggttgaatttagacatttgagaaaatttttttttaacttttgtgacacacaaggacctttgaatgaaatcagtccccttttcttcctttaaaaaaacttataagaattaccatttcttgactaaacagttgttttcttttaacattatatacttgtctctacatagatactacattttttagttagatgtgttttggaagagcattgactttttttcctgttacattggaaaaatttaatggcacgtgtatgttattcttatcatgaagtgggtttaggcatgctgccttatactaaatagaaatcctatagtagttgtttttcagaagtaatccattgattcaagtcattcattgattcatttatgaatacttaagtatggttacataggtagggattgtcagaattggcttttgagcattttgtttagcagttataatccaggtggcaaatatactgtctgattcaattacttgcatgaaatcactttaaacagctacttaagatgagttgtccctaggcctgtctttatctacttattgtgcatgtgtgctagcatacacgcattatcattgttgttttttattgtgttaaaaaaatattacaaagtgtaccatcttaaccattttaaagtgtagatacttcagtagtgttaagtatagtcatttcattgtgaaacagagctccagaaatttttcatcttgtgaatatgaaactctataccccttaaacaacaactcccctcccttgttccctccagcccctggtaagcaccattctcatttctctttctatgaatctgagtattttattttattttttattttttgagacgggctctctgtgttgctcaggctggagtgcagtggtatggtttcggctcactgcagcatccatcccccaggttcaagtgattctcctgcctcaccctcctgagtagctgggattacgggctcgcgccaccatacccagctaatttttgtatttttagtagagacagggtttcaccatattggccaggctggccttgaactcctgacctcaagtaatccgccagcctcagcctcccaaagtgctgggattacaggcatgaaccaccacacccagctgaatttgagtattttagatacctcatctaaatggaattacatagtatttgtctttttgtgactgacttatttcacttagcacaatgtcttcaaagttcatgtaccatatgacagaattttctttcttaagactgaatactgttccattgaatgtatataccacatttgtttatctccttatcctgtgatggacatttgagttgttttcacctcttggctattgtgaattagtgcttctatgaacacgagtgtgcaaatttctcttcaagatcctgctatcacttcttctgcatatgtacctggaagtgtgggattgctggatcatatggcagttttatttttaatttttgaggaacctctgtactgctttctataggagtcataccattttgcagtgtcaccaacagtgcacatgttccccagtcttttaaacagccccttccagactgacagagtggctacatacagaacagggcagctttgaagattagggtggcctgttccaagcttcttcagactcctcgggactggctaattatttttgttaaggtcatactgctggaccagggcctataggttggcactgacttacgcatagaatgttggcctgggtgttgatagacttaggctgcaattgctatgagtgatcttaggcaagttacctccactctgttccctgccattgtcatctgtagatgaggtggttatgcttctctctatttcttaatttgttccaaaatcttattgtttgttgtagaatccaggcatctaaaaaatatactgtgtgtagcttcgtgtaattatttgatagactggatttctttttgcaccagatagttcggtttttttgttaaatgtctcctttttcttttcttactctttaactgccccaaatactaagtgacgaggatggagaccttggcaattgagtgctatcagtgagtctgaatgcctgggttcaaatcctccatttactagatgtgtgaccttggagaatgtaacaaactgttgtttcacagtttctccatctgtgaaatggaaataataatacgtttgtgagacttaggtgagttaatgcctgtaaagtgctttgcatgtgtctagcccatagtaagcactcattaaactcttaattatcatataatatgctaattatgatggtggtaaatgagtgaggtcatcttccattttggtcatactccacatttgggtagctttagactttctgaagatactatttcctgtaatgtttctttgtaggtggggaggatatacctattacacagttagaaaaactgaacagtagagattatgctttatatggctgggattaaaacttcagtgtcgtgtttagagcctagtacttcctggcctggcatgttgtcctacacttaatgactgtggggcctgagtgggttctaatgttagaatctggtaagaactcttcctgacctctttgcccatttataaacagccttccagggtgacctgagtaagatcattttctagctgtgtaatcctggtggtatgaaaacactggatgtctatagttttttagaactgtgacttagtactaatactagcctcttcaatactcatactcttaaggcttaatatttgtctctttattgatttacatatttgaaacctagacagtcttttcaaaggtgagtagatattttatatgtctgccttctggtcggtagcagcagttgtgcagttactcagctgttggcagttctgttacttaatacagaggcagagagcgaaagacttattcagaaacaaaacctctgcttgaaaagttctcaaggccagccatggtggttcggcctgcagtcccaagctggtgtggcctgcagtcccagcactttgggaggctgaggtgggaggatcacttgatcccaagagtttgaggctgtagtgagccattgatatggctccgttgtctggagaaacacccagggtctctggtctcgtgctgagaaaatcagcaacatagatacacatggagtggtttaaggagcggaaagtttaataggcaagaaagaagaaaacagctccaccgtacagagggaagagggctcagaacggaaaacccccattgctggggggaatgccgtaggttatattgggaggctggatgaggcggtatctgatttgtatagggcccaggggattggtttgaccaggcttgtcattcacatagcccatgaaaaactggccctcctatcctagtcttttaatatgcaaacgcagctacctggctggttgccatgatgtcctgcccacatagtctctacctggctggtcgccatgatgtcctgcacacgtggcaacaaaaagtggcaggaaccgccatactgggtggacctggcttttagttgcctgcatttgcatatcaatgcttgcaggtctggtttttcagtctgctttctgttagaaaagaaatgttttgggggctgctttttcagtaaaagaaaaagcctcaccgaggactcttttaccctctctatctgcttaaaataattcttaataactcctgtaataccatgattgtgccactgcactccagcctgtgtgacagagcaaaaactatgaccctgtgtctaaaaaacccccaaaaacccaaaaccaaaaaacgagactgggcgcaatggctcacacctgtaatcccagcactttgggaggctgaggcgggtggatcacttgaggccaggagttcaagatcagcctggcctgttacatagtgaaaccctgtctctactaaaaaaaaaaccaaaaaacaaaaattggtctggcatggtagtacacgcctataatcccagccacttgggaggctgaggtaggagaatcacttgaacctgggaggtggaggttgcagtgagccgagattgtgccactgcacttcagcctgggcagtagagttaatgagactccgtgtcaaaaaacaaaaaacaaaacaaatgttctcaagtcatgttcaagagataatggcggacataatggaacctccctaaatctgattttctccagctataaaatgaagggcccagatcaggggatgcttaagggctttgcaagttctaagactcagccatcttgagattggaaacagccctgtaggttcttagggcatgatgaagacctttgaggagaagtattttaacagctttgtgtcttggggaggaagagtcatggggaggtgattaggtgggcattaaaggagcaactggagaaaggagagactaggaggctgttttgataatccacatgtgaggtagactgccccttcctgagtgcctgaggggcacttgcaccttgggacagggtcaaggttttctctgagatagcagctcccacaggcctaggagccttctttcatgagcttgctgccctggttcatgagggagggattgatggatctctgccccgttctgtttttttgctagcactgtcttcacaccctgttgccgtttatgttttttgatgaatgattaattagaaaaataatcatttgtaaattgtgagtgaaccagacatttggccctgactgtagggaaatggcgcctctgagccgggtgtagcttgcagccagtacatcagagctccagtattcccagaccagtgatgaatttacatgaagttccttttcagcatgttaatgactgttacagctgagtaactagcgaaaaataatagcaaatgggaagagtaaatatttaatgcttttatatcttttagcttactgtggaatatgtattttgatttaggaaggacatgagagtcttagagacattagagacaatgttagtgtgtctgagcctcattccttgtttccttttctttctttgcacttaattaaattaaaaggataaagtgagttgttgtgagatggattttactaggggagtggtttttctgtaagttttaggtcacaagatgcgtctttcctggcagttaaaatctgtatgttcagactacctcattgattacgtgcctggtgtgtacagggactcatattgtttctaaaattcagctttcatcattttactctcctgcttaaaaactttagtgactccacaccgcttctgggctgaaagatatactcagtagcctggcttttaagggagggcctctgtgctgtgagtccagcctcttttcaggctctctccctaaggcagctccatgtggctacattgctcaagccacagtggttgactccctgttcctgtaacttgctggaggcttcctcacctttgcacctctgctcagatcattttggggcatgaaatgatcttgtctttttctctatctaaagcctgcttttcctccaaggctcagttctagacgtttctgtgactactctgactggataggagcctgttcattttggaatatagagaaaattgaaagtaggtcacagttctctattccttccagtttgccacctctctaccacagacaattaataatgaaccctacttttccccacttcctgtttggccaccatctagtcttagacaaactaagctatttgtccaggtaaacaagtagttgtggactacagaaatttctgaagattagaattgaagttagtagggaaacaggcctcaaggatagtgccatattttctgagagcagatgattttcagacaaaaggttttaccaacagcattcatataaagtactgctttagtctgagtttgcaatggtagaagtagagtatctaaagaaaggatccatgccctttttttttttttttttaaatagagacaatgtctcactatgttgctcaggctggtctggaattcctgagctcaagtgatcctcctaaagtgctagaattacaggcatgagccaccacacatggccaatccatgcctttttactctgttgtagagactgtcttggagtgttgagttcagacccagataaaacaataatctttagaggaaatgaccaagatgaccagaggtaggtctgaaaacatgaaggccgtgtgggtaagagagaacaagggagtccatgccttctgttttcaaatatttaggaggctactgtcaggaaggagggatattagacttcatgtatggaaccatggagtgagaacaaagattgctgggtgtaggttataccaaagataaattttatgccaatataagaaataattttctcatagtgctgtgataaaatgaatttccccaggagatagtttcccaagtaggaagggatatgaacaacaggagctgatatttgaatcgtgaatatacgtggccttatagtaaaaggaccacagatactcgaatgtcagacctttaggaacaagtcattttctactgtaggattttggagggttcataatagaaagtaacacatctccttgtgtctaaaaataggaataaatcctaatatgaaccaaaaaatatattaggtacagttttctgagttgatattgaaatgatgaaaaagaaagagatctgggactgggggttcttaacacactgggtttagggacctcaagaatattgtttaagaatgacgagagatttgcaatttccaaggagtcataagcagtttcaaaaagttgaatgtttttgaggaacttaaaattctgttgttttcaaaatactatagaaaagtaatattacaaaattgtcttgacataagtaatttgggtatgctgtataaaggcttctaagaattaagaaacatggcccgggttgcaaattttaatgcatgactacctttttttctatagaatatagcttttgtcagattctcagcagtggctctgatccagaaaacattaagaaccactggtcatgagtggtgattttcagcttttttggtcttaacccacttaggtgggacagaagctccttatctcacctataccatccagcatcaagataagcacacgttaatatgaaccatatacatattttgttttataaaagtatcccataagctttaaaaatgtaattttgtcatacttaccttggtatagtagattgtaagttatttagagactataaagtcacagatgaatgtttacaagtactctttttggagttgggcttattctatctatgtcttctttagcagtggggatttggattattcttaaccataacacatacaagtctcattattggaaaattacaggacagaaacaaatgctgtaaatatgcaccactgcgcatcatgagattaaacagacaattttcaaaaagtcaaatttctaatgataaaattaaagtaagtaatttatatttaaaaagcaggaatagcagcaatgcaaactgtgattgacttaagaccacagtgaggttacagtgataataaatcattcttctggagaattgtgagaattttctaactgttggtgtgtgtaagtgcaaggtaggcactttgcataattgtatagtagctgacattcttgatatgccagtttcaagtcctttatatactttgctaacttgctgatattaatttattaatacaggtttttaggactcccctctcttatctaaggtaactagcttattaaagctcatattaaagaaaacaagtatctgtggaaatgttcttgtgggtaccagtgattctagagccttacgttaagaaacactagtctaatggatcaatgtataggtaaatgatattagacattttgagtaggattaagatccaggagactatctgaataatgacctttctctctctttctttttaaaatatggtcatcctaacgcgtatgataacccagatactctttctttttaaatacccttttatttaccaaccctcttaaacctggccctgaagttaagatcaacagctatgtgtgaataatttttttccttctcctttgctttgcttttcctatcaaattgaaataccctgccactttcttccctctctgaaaacacaaaagaggattaagccatataatggactatttatgtgtcaaattaaacgttttactctgaggctgtttctgagttatgcgagcagtaaaaatatgtattaagctgccaagccttttaaaaaatgcatgttatttagctgatagcctgtaacagtctgatggacccataatggtgttttgagtaaatacgcatttgaacaatttatgaaacttatgtttacatgtgtattaaacagcctgggtagggagtgaccaaaagttattaccagttgacagctgttgtctggtgaccaatttgaaatgaattggtggattcccttcagtgcggagtaaacaggtttcccagtcaggggagcatgctgaataattatcagtgtgtggggcctcagccctggaggcctgtgtgttggttgaatgaggtgctggaataaaatgtctcaactctacagtgaagttgcaccttagattcacatttatgatctagtttattttgtacttggaaatttataattatgttcacagagtacaggctgtgcataacaatatattctgcccttgggaagagggttcatgtttgtttatttcctttttttcttttttaactgacatataatcgtacatatttatggggtacatagtgatgttcaatacatacaatgtatagtgatcagatcagggtaattagcattccatcatctcaaacatttatcatttctttttgttgggtgcatttagtattttccttctagctatttgacaatacgtaatatattattgttaactatagtcatcttccagtgctatagaacactataatagaacttactcctatttagctgtagttttgtatcctttaacagagctctccctatcttccccacacccccttgtttatttctttgacattatccatctagggaaatgatcttgaaatttttatgatgtgtccatatcaacaatacatattttatatttgttcacttcaaaattatatgcatatttacatgtgtaaattttattccaaaattaggagtttaaaggattgagataaaaattaattacatatagataatttgattttctttttgtacctgaatgaatcctctttggcactgtctgggatgtgcagattttgccttggagattaaggcgagtgtcttgaaacctttgtgtaatgaaaagggcattgtggattatagtcattcataaacctgggcaaatcattcagctaccttgaggtctagtttcctcatttgtagaatatggatccctgcctggggggtttcataaagactactgatagtaaatgtcaggtgtctaccttgaccacaaaatcacttcctcagagaggctttccctgacctcttttctccatgatagctcctcttttcttcctgatcactctctaactccttaccttttaattaattaattaattaatttttttttttttttttttttttttgagacggagtctctctctgtcgcctaggctggagtgcagtggcgcgatcttggcttaatgcaacttccacctcctgggttcaagcgattcttctgcctcagctttccgagtagctgggactacaggtgcgtgccaccatgcccagctaatttttgtagagacagggtttcaccgtattggccaggctggtcttgaactcctgacctcgtgatctgcctgccttggcctcctgaagtgctgggattacaggcgtgagccaccgcacccggccttttatttatttatttatttatttatttatttatttatttatttatttatttatttgagacagagtctctctctgtcggccaggctggagtgtagtggcatgatcttgactcactgcaacctctatctcccaggctcaagtaattctcctgcctcagcctcccgagtagctaggattacaggcatgtgccaccatgcccggcttaattttgtatttttttttttttttcagtagagatggggtttcaccatgtcggtcggccaggctggtcttgaactcctgacctcaggtaatctgcctgccttggcctcccaaagtgctgggattataggcgtgagccactgcgcccggccaactccttacttctatttaaaacaactttttaccatctgaatgaatattatttaagtttctactggattgtaagctttgtaaggggagatatttttaaaattttacttttttggtctgttactgctgtatccataactcctagaatagcatgtgcatggcacatagtaggtactcagtaaatattagtcatgatttgaatatttcataacttagtagttgactaataaatagaggctgttactgttttcatggagtatcctacatataatatagttggtgttctaggatagaagacataattctctatgtatgaattgctctcactgtcacaggatccttagggtgtcacttttccagctggaaacctctgtggcctatggtgcctttgcccaagttttgctccggcctgctgggcttgttccacccactcagctgggcaggctgtgctcaggttttgctgccggcctgaatcccatgcctgccaagtgtgagcaggcgcagagcggcaaggggtgtgtgagcaagtgcagggtccggccactggcacagccaggcatgctggctgtggggtgggcagctccatatgaggctgtggctggaccaggtgtactgcaagcagcttccactgtgggcactggggaatgcggtggcacctggaagcttggagactccaggaaccacagaaccccaaacagggtgtcacagtcctggcttgtagagccactaggtttgggcttcctgaagggctgcaactcttctctctttctcgtcacctgcaatgtggctattgggggttgtgttacacccctttcagtcccgcaattcagcgggtgctgagttttgtcctgcatccaggaagaatgagatacgtggacaaccagagggtgagcaaggcggagaggggcttcatttaagtgacagaagagctcttaggagatcagaagtgggtagctcccttccacagcaggtcatcctgacgagtttccagctgtcagcagagaggagacccatagtgggtaagtgctttccatagtcaggttgtcctgacaagttgaggagacccaaagtgggtatctccttcctgcagctggtagtcctgacatctgcctgagtctacctgagtccgagggtttttatgggctcggaagggaggaagtatgtgctgattggtccatgggtggccatgagtgggcctggagaaagcaccgtaagttcttattccaagccacggactccagctggaactggcagcctggcccctaggcttcaggccatccctggcttgaagttggggtttcacaggggacctacccctttccgcccaggaacctgtctgcctcccaccgtcaacaagctgtccattgtgtctaggctgtttgtgcagagaggggtgtctgcagacccatgccaagctaccctcagcacccacccccatcctccacttccctcctgcacctgtttgcagccaaagtccagagggggccgaggtggcagagggctggtgtgtcaacatcacctgagctactgtacacctgactgggtcgcggcagtgcccagtctcagccacaactttgctctgcaccagagcaggtgccgggagtggggagaggccagggagtgggagcatgtacttccaagcctatgggagttgggcccccgagaacacagggatgcctgggtccagagccacagctgggcagctgcagctgtgcccaggagtgcagggctcccaccctgctaactcggtatggggtggggctcctgtcttttcctggctgtgcctcccctgctgcagcatgggccgctgctgccatcatcagtgggacccaaggcaggaagtgttttttcctgtagggaggatagatttttttttgtctcttacaggtagcatctggcaggcatgtagaagttagacatgaagcctccacccatggatctgagccaagtagactgacctgtgtaagcttcagatgcctcagtcttggtctccttagctccctgtttttgtcaactgtgccatccagctgagcaccttagagcttgaagctgagagcttcagcggggccagtgcctacaagggctgtgtgtatatgctttagaggtgggagaattgtgctgccagtgggcgtttggcccactaaggagaacacctgtgacctctgcaatcttccctacccctggcattccaagtgccattccaagtctgtagagataatagaacaaacgtaattttttgtgtggttggcaacgaagactggaggagaataaccacacctttggaagacttcggtggtcctttgaaatgaggagtttttatagaaacacttatcattttaaagacctaccatttttaaggtcactcttctgctagggctgtgaaatacagacatatgaaatgttttccagtgttgctctggtacttacgtgtgtgatgattttattggagaaatggatgaatatgaggttggagagtctttacatgtatgaactatcaaatatacagttcagtagcctgaaaacattaacaaatagcttttatttattgtatccttatgtctttcaatttggttcttatctgttgtctcttcagttgatgcaaatttgtgctcaacttttcctgaggggaaatggagagatactttcttggattagcttatgatcttgaacttgactattttaaagagtcatggtatataccaatctggattgtgtttaggatggggcttgggggatggtttctttgttctcttttggcccacgtcttctaacaacccatttgtttagggggttttatgctgcttagagtgagctgagaatgtgctcaagcacataattttagcctgtttttcaggtttacatgaaaaatgtaacaggcttctgaaacccctctaggttccagctttcaagaggctggtcaggaatgcactgaccgagagacttccctcaaaattaatttataaacacgctagaactttcctcaccttaattttgagaaaaagatctctctcatggcattttcaagtgttatggtagatggaaataatgaggaaactgtggcaccttgaacagagtgagaggtttagagttgtatagaccttagtacaaattttgactctgtcattaattacctgttctgtcatgagtgagttacttaacattccctgagcctcagtttcagcatctgtacagtgaggattctatttatttcatactgttgtggagacttgagcaacagagtgtgaaaacatctgtcagcgcctggtgtattttggacattctgtaaatcttagcagcccatttccccattctgggggtaaagccacaggacttttttggcaaatagttgagatacttggtgccaaaaggaaatttaactcatgccatgacaagtttttttgtataaggatgggattctggaaacatgataattttttctcttggccatatggattagcaaaggctttagaaaactacaaaaaagactaatttgttgcctctggatgtgtgtgttattttgggctgttaatatacttgactgcttgtttcaaggactggaaccttttcttttacctttaagattcctgcattttcatgtgctcattcagctgggatttgtgtttcatagaactggtagtattggaggtagaggagatactgtgatatcatatctctctctctgtctgtctctctctctctctcccactgaagaagagaagacaaaatttagagaatttgagacttgctcaaagttgtgtagctagttagcgataaagctggaattgcaccagatttgatttccatgacattgctttagcctggtggttctcaaagcatggttattggaccagcagcatcccttgggaatttgttagatatgcaaattcatgagatccccattcccttatcagaaattttaatacgctgtgtagggtgattctaatgcctgctaaaacttgggaaccactactgtggtctttacactattgggcagggagatgggagactacaggtagatttgctgaatttcatgggcaacactaggttttcattttaccttattgttctgccatttagatgtctcctcttaaaacatttttacttgcagtgatggcttccttagactcgtgtgtgattgttgctggggcagttaggtggaactaataggtgttgcttgttgattccctgctaccaagtactagttttgaaatttgagtattcattaaaaacaaatagggatttctgtgtctcactcctggaaattctgactcagtgggggtaaggattaggaatgtttaatttttgaaagccctgcaggtaattttttttctactttttaaaaattataatttttattttctttactgttcttttaagacatcctgttatagcatctgcaggtgattttgatgcccagccatgtttggggaaaaaagtttgggttctgagtgaaaatagaaaacgtaatgacatggaaaggaagtcaggggataagaaaagctctatggccagccatggtggctcacacctgtaatcccagcactttgggaggctgagatgggcagatggcttgggctcacgagtttgagaccagcctaggcaacatggcaaaaccatgttcctattcaggaacaaagaatagatcacaaattaaactctgtgggttttcataagtggaaagttggctttcgttgttctgtatttgggtgcttagtggacaggagttatctaaaagaagtaattatagttgtaatgcggaccctcaaagttgaaagtagattgaaatccattattttacaaggtggccttactatttatagtttgactgtaggtatggcagtgagagataaaattactttttctagctttgcaaaacgccaaacgtctttgaaattaagagtaaaaggggtttaaaatatgtactgctttataaagcaggaaaaccccactggaacattttgggtgtttacagaaatgggtattccatgggagagaacgtggtaacctatgttttgtcatcatttgtttaatcactgaaaatatattaacaggccaggcatggtagctcatgcctgtaatcccagcgctttggcaggctgaggtgggaggattgcttgagcccaggagtttgagatcagcttgggaaacacagtgagactccatttctacaaaaaaagaaaaaagaaaaaaaagtcacatgtggtggcacacccctgtggtcccagctactttggaggctaaggtgggaggatagctcgagccccagagatcaaggccgccgtgaactgtgatcgcaccactgcactccaggctgagcaacagatcaagactcttgtataaaaaagaaaaaaaatttttttaaaaatataaatatagattaacaaagtaacagggaatataatattttcaggttggtcatatagaggaaatactatattgtgttattcagcttaataaaatataaaacaaaaaaattattaactgtttgaaaaattgtagtcagatatttgattaggggtaggtcctgatttggatgaatttgaatcacattcgactaaatattgtgctttttaatactcactttaaaaacaaaattaattgggcaaatgttcatatccattttaaaaaactatcctcttaaaactagattgatagtagacattaataggcttgatgttgtttataatattttgctatattttaagagcatgcttttgtatattttctgttttagtgaagcattttaaaaatgcccccctcccacaactgcaggaataaatctaacagattttgaccaaaattactctaattttgaatttcttgaaactgggtatggaaactagacattaaaaaaaatctttatttttaagcacggtttcttggtcagtagcttctgtattacgggagaacacaagaaggggccttcttgacactcaagaaatgctctttttccatctacaaataggaagacaccctttgtggtatttttgttttgtgggccctgaatgaaaacgtattatgatcagttttaaaaattgctgcccctttaatatctgaatatattcgtggctagtgaagcacatgcatctgtcagatcatgggtgagaattcacttttctttttgcgatttctccagccacaaggacaaatttagttttgcagagcagtttgacacctctagaagcctgcggttagcctcggtgcacctctagcagctgcataggctcaagaggacctctgttcttccctttttggtttggttaccttacccctcctcagggaaaggccaagagactcagcacttcctccccaagtgagtttccttagtaacgtcagccttctctaatgctggccaagggtgtctttgctgggctgttttccctccaaaatagactcactggggtatagaattttttttttacgtgaagggtatagaattattttcagaatagcagcagggtaattaggctcattgttgacatgtcattgaagtctccatgtgacaaaattgctcctccctctttgagcactctgaatactcttaccctcttatctcgatctgctctttagaaataccagcagataatctgggagaaggccaccatagccatgcacagagtggggagaatgaggagatctttgctgaatgtcttttagttgtttgagttggagataaatgcagaatgacctccattttgccctaagaacctgaccttcttgtcactttgtgtaacattaattttctaatgtgttctggtcaatttgtaaaaagattttttttctagtgtctcagctgttggtttgacttttgtattttcattggtaaaatatgtatgtctttgctgtgagcagagagaaacagattaataaaaaccactgaaccagcattgcatatgtaattaattaacaccaccaggaaagctggttcatggttgtgtgtaaacttatttccaaacatctaaaaaacgtttagagttatcttattcagttgtctcacttctaagggataggttaggaagctgtaacgtatgtgtatgcacagaaactgttggacaatgattctcaaactttacttttcattaaaatcgtctggagggcttattaaaatgtagattgctagacctcatccatagtttctgattcagtatgcctgggtggggccttaaaatttgcatttctcatgtggccccaggcattgctgatgctactagtccaaggaccttactctgagaatcagttttaggatgtagatcttatgttcctctttgccaagggcaaatgaactgaattgtataggcttccttttcttttacaagaagcattgcctcttctaagtagacatccaccaaatatttatgtactgtatccatggtgccatgcactgagctaggtgcactggggataaataaaatgatctctgccttggggaactcacagttgagagaggattaaattaagaaacccaccaatcgtgattcaatatgagaagtgctgtggtgatgtcaggggtaggctttctagatttgctatgaggtgcagtctgagctttttctcagactgtcttagctttatacctacagaaataagtgaaagaaaatgaatcttctgcagcttaggattttgttagtgctcagatcagtttcctctcgtccttgactttgggcatcccaagctctgtattcagacactcctgaactggcattgtgagctctccaccccagcttttgtggaagagtccttcctccatttttaaattacaatttcagacactgtccactgtggcagcaggatttgtaacaagaccaagttaagtgatcttggctgaactgatttatgagacagcttcaaaaattcatgaggtaccatgggaactttctgtagtggatcagcatgccgcttttccttcacttcttcaagtagatcagacattttgtgataacacggcagtttatagtggagccttctagattatggctctgctgattaagacactaagacagacctgaagacaaagagaagggagaacaggatgttacttttagaaactcctgttatcctaagcttgagcagggactttgggtaaaatacatctatgtataactcaatttatacatagaactctctagggcaagtttttctccagtggtgatctgatatggagtgtcttggccattaataatggtcccataattttaagcacaataaaatgttaggtgtgtatatgcgaaaaattgagtgacatagtagttgtctctcctctctttgtgaaaaccggtagacaggaacgaaggatgtggccaaaaccagtgacaggttatggtgctttccctattttattgattgctcatttctagtctctaaccttatttgctacttattgatctagtagaaaagcaaataattttccctagatagtattttgttgagctgggctttgatgacttgtctaccaaagggtttttaaaaagtacttacctgctgagtggcagcctgtctaccatttaatgttattatctgtgagcctgggggttccttcttagtaggatcactgatgtcataggctgcctctttattctgcctactttcctgcaagataccacacatgcccgtggtctgctttaatggcctcacagtgcacacagccttagacttaacacaagaaacatatgagtgatcccattggagataatgtgttgccgagtcaatttgggtcagcatctgccaacatgtcaaattttcacactaggttgtattttgagatttttattcatgcttttgggttcaaatttactcacaaataagttttgaacttttaagtgctaaaactgctgagttcttgactatctgcacttggggaggggaaggttaaagataaggggtgggtatgtatgggaaggaaacagtagcacagatcatctaacataggaggtaagatagatttcccaatgtcatatataactttgactatatattttttcctatgtttacattctcctgtttatgattatactcttttggttcatattaaattggtgtttatctcctaggaatatatatggcgaggtgtgtcataggaagcaatagaaaaagaatttggagactggtcacttataattcttgaataatataactatgtagagttaaaagcaaagattgatcctgtcattcatgggattgatgggcatttttgctggtatcttattattgttcatttctgagtaggtaatatattaatatgatcccaaaagcaaaattgtattaagaagtatatagaggaatgtctcactctcatccctggacctatgtgccccattcttcaggcttttataactactttattagtctctattacatcttttgtaatttcttaaatagtgtgtgtactctcctatttgtgtatgctctcgctttttctgccctttgttataccatatttagcatactataagcactgttctgcatcttgctgttttgtagttaccaatatatcttggagatcattccatctcactacagagagagcttccgtattcctttttatagctgcttaatatttcattgtatagctgtaccataatttacttaacctgtctgacactttggttatttacaatcttttgctcttacaagtgatgctgcagtgataatgttttttttttttttttttttttcccgagacagaatctcactcttgcccaggctggggtgcagtggcacaatctcggctcactgcaacctctgcctctcaggttcaagcaattcttctgcctcagcctcctgaatagctggaattacaggtgcccgccgccacacctggctaatttttgtatatttagtaaagacggggtttcgccatgttgtccaggcttgtctcagactcctgacctcaagtgatctgcccgcctcggcctcccaaagtgctgggattacaggcatacagtgaataatcttgatcatatggcatttcatcctgggtgtgtgttcagttgtaggataaattcccagaagtgaaattgttacagtgaatgtgcatttgtaattttgatagtcactgctaaatccctctgtagaggtcgtactaatttatattcccatctgtttaagagtagagatttccccgcagtcttgtcaacagggtggtggtgttaaacttttgaatttttgccaatctgataggagaaaattggtatctcaaagtggtttcaatttgcatttcttattatgagtaatgttgagcattatttactatgtccaagatctgatagtatttccttttgtgtcatcaacagtctggttatatttctttcctgttttttctatttgattattgctatttttttttaatttttaaaataagctattttggaatacttatagacttaccaaaaagttgcaaagattacggggattttttttttcttttcttatgccctcattagctcgttaattgggttagatggtttgaggaaggacaggtctcctggaattctgtggcttgtcataggtttgtcagcccaaataaggatgcacatccaattcacgactcctggctgcctctggggattttccatatggagtgacagacttgggaaattctgctgagcttctgactagcctccattatgaggcatataattcagagcccatcttccattattcttcttttactagtatcaattattaactagaaaggttattgaagtgaaaaccttgcctcaagtttgtatttcttgagatttacttccaataataaatgtggttttcaagtgactgaatctttcatagaccaagtttcgagcacattaaatatttggtggttttgcgtcctctctgcctcacatgctaattgagaggatgagtagctataatttttctggagcttcaggctgtcattctgtcctgttaattggttcttggagtaaggagctaaaatgtggaggcagaaatgctttcccagatagaaacatgccttgaagctttgtgtcctgtaagggtccacatagcctggaagttaagaatactggctctggaataaaaccttgtggattcagattcctgctttgccactgctagatgtatcacctcggacaagttacctaacctctttgtacctcactctctccctgtttataaaatagggattagaacagtacctgcctcatctagtagttgtgaagattaaatgtgatgagacatgtaaagtgcttggtacaggcctagaacattgtaagtgctcaataaatactggccgaaaagtcgtacagggcagtggtttcagaggccatgcaataaaatagtgggttatgttgcatttgacttttgttgattaacctttcttcttcctctattctttaccttgtgaggcacttaacctactaactgaaatgccattcattcagccagtatttgagtgctcagcaagtgccagactctaaacaagatgatgtgtaagatgctgcaaggagccctcgtgccttgcagcctgagcacaagtgcctataaacgcaaggctggttgtcgtcattgccatccccagtatactttgagaatacaaaagaatgtgaggtcactctcctttgactggggtgacgaggacatgcattgtgaaagggggaactgttagaactgggagccattcgtaagtgaaataaggataagagggatattatcagcattgatgctaattagcatttctgtagcattttgcagtttgggaaacattttatgtattttattttatctcagtctcataaaagagcttgaggtattattatctccagtttacgactgaagagatggggagtcaaataggttatctgattctcccaatgccatacagctccttggtggtggagttggggtttgagtccaggtctcctgactctgaatctccacgtgcttccctctggtctcttgagtgaaataacccgtactagcaagaaagagaagagtatgtcggcaaaagagaaacctggaatagttgccaattgtccctaggttcagatcacatacttctagggcatcagagctagaaggaacatgagatcagtgcatcctctttatttgactaatgaaaacattgatgtgcttgtgagggacttcgagaggtcaatgtggtgctggaagcagctcaatggagagggtagacagttccccttggatgctcatgtgtggtcttctggggattgattagttgctggtaaggaaggagctcattttggggaaagtaggtacatagattcatagagggaaaacctttattcagaagcaggcagtttttctgcaatatcttcctgggaaacacaaataaaagggctgtagtttagtattcagatgtggttctggttgtgcaaggataaggagaaaaggcagaggcagggtgagaaggaaggaaaatgaatgactgatttgaaaggtcagtgagaagtctgtgaaaggtacatacttagggtctgtagggcagtcatttgaaatccaggatacttagtatatatataggaggacttcgtagtagttctctgactggaagaggactgggctgccttgtgtgtgtgagctttcatcatgggggcagtggttactacatgctatttctaagaattgcacttgtggggtgatttctactttgggtaggaggttattctaggtagagctagtgtggatcagcaacatcagcaccacctgggatcttgttagaaatgcagatttggggactcctaccctagacttactgaatcagaatctccagtgggtgcagttcaagaatgtgtattttaacaagatctccaagtcattggtctgcatgttcaatgtttggaagcattgctctagtgcagaggctctccaagatcctcctttgggttctcggcttatgtgattaatgtgccattcaccaaacatttattgaatttcacttatgtaggcacagcacaaagccaactctcacatggatcctgcttgcattctagttgaggagacaggattgtttacaagtaactattaggttggtgcaaaataattgaagtttttgccattactttcaatggcaatttcagtggcaaaaaccatggttacttttgtaccaacagtataaaaacagtgttaaaggctagtacaggaggcacagagaatgcctgtgaaagtggagggtggacgttttcataggtgtgtgcgggagcaggtggcatgcatggtagggggaatcattacttctgtgcaggactcctgagtaattttaatctgtggtttgctgctgtgcaaacccagaggcctgtctacaacttgtttaacctcccccagcccttgactgggtttactttattggcctgataagtagtataaaaattggcagagctattaagatgactcatggaaggatatcctcagcatctccttttggatctcctcacacctgcactgcttcttcttaaatgcctgaatatccaccactttgtaaaagaaaaaaattgatttgtcactgaatttccatgcctcagcctgagagaaatgtaaatgttgtactggcctttagtactctgccttcaagcctagatttagagctgatcattatacttttagagtaggctaggtatgaaaatagcagcaggttgaagagtcagaggaagctgtttgctctcatctgctggtttggtcagggtggaagtacgaatattaatacagtccacttaaacaataaaatagctcccagggaagaggaactataaacttcagtaaatatcagagatgttaaatgctaaaaataaaagctctctgcagttgtttggctctttaaagagattgtttattggtcaagagtgctagtctgtttggtcatgttttgctagctttttaaaatgcatgtatgtaaatgaattagaatataagttaattaagcagggcagtgtttctagaatgtgaaaatagtaacctggctagttaatttaattaagtccttggtaattttcttttagaaacaagtttcatcttgggaggtcacaacgtcctggctgctgtgcttctgagctttaccttgactccatcctctcctctctgtcatccttttctctggctctgtcacttgcatttgccccctgacttgtcaccctgacttcatttcctctctcccagctgtttacagtgctatcacagtggtctttcagaaatcccaaactctgctgttgaactgggttctaaaaaccttcagagacttcatgttgtccataggatacactgttttctgaactccttagtgtgccatattaggctctctacagtctggctctaaaatacaattttttttttttttgagacggagtctcactctgtcgcccaggctggagtgcggtggtgcgatctctgctcactgcaagctccgcctcccaagttcacaccattctcctgcctcagcctcccgagtagctgggattacaggcgcctgccaccacgcccggctaatttttttgtatttttagtagagacgggatttcatcgtgctaaccaggatggtcttgatcttctgacctcgtgatctgcccatctcggcctcccaaagtacaggcatgagccacggcacccggcctctaaaataccattatagcctaattttcaggcttactttttcttgtggtccaggccacaggactatctgctattctcaatacaaataaaatataaccagtagccaccctgcagtagtagggacaattcaggtgcctcgacaagcattgtctgattacactattcaatacaggatcaaagagttttgtcatttgcccaaggtcatgtaccttgtgttagagctgagattcatattcagtattttgatattctgactcagtttcctgctttcatgtctctgtgctttccttgtatgttttctttctttttttctttttgaggcagggtcttgttctgtcacccaggctagagtgcagtggcacaatcacaactcactgcagcctcaacctcccaggctcaagtgatcctctcacctcagcctccccagtagctgggactacaggtgcacaccaccatgcccggctaatttttgtactttttgtagagacggggtttcaccgtgttgcccatgctagtctcaaactcgtcagctcaagctctctgcctgcctcggcctcccacagtgttgggattacaggcgtgagccattgtgcctggcctccttatgtcttctatgcctagactgtctcctaccctttttctttgcagacttggaaatgtataggtgttaggtattcctaacaatgtgcgtgcataggtcatcgggcctatctcaatttagcctgatagtgtaaatactagtactactactacctagtgctagtactaagagctgatcccagatcttaatttttcttcatttctcctccaaataataggcggtttataagtattatggaatgaatgcatggatggatgaaaggatgactggatagatggatggtcagtcccagtggttgggtccgtttgtgatttgaccaagttcaaggctgtagaattgctatgtggaaagaatgcatattatttcagctatatcaaatagcacctagggacggcctgactgacagggaacaaattgtcagccctcatttggatccaagtggaaattaatctgaagaatttggaatgggcctattcgtgggaaattgcttatttttataagagtttattttctgatttgtggctatattcgttggctagggccactgtaacaaagaccaggtgacttaaacaatagaaatgtattttctctcagctctggaggctagaaggctgagatcaaggtgttgagaggtttggtttcttctgaggccaatctctttgtcttgcagatggctaccttgctgtgtccttacatggtcttccctctaggtgcacatatccgtgttcagatttcctcttcctttaaagacagccgccatactggattagagcccaccataaagacctcattttaattaattacctctttaaagaccttctctccaaatacggtttcattctgaggtactgggggttaggacttcaacctacaaattttgaggatacctcattcacctctacccaacccatcccctctgccttttcctcttgttgtctttcttctggcagttttgtttcactcaagggcagtcaggaagagaagtaaagatagaggaaaaggaaatttattttgggtgcagttcaggaggtgtagctggggttggggatgggcagtggctgaagctattggtggaaatgagattttgatattgcctatagattagtattgtcctggaacattctgtgctggtttcctggacagccgatagctggctgtgtgtgttggagggcccagggaatatctgttctgttagtaagtgagggggaaattgataatcctgcagccggcctggagaagtaaggactctatctttgtctgtcagctcttcctcccagaagtagctcagagacttgctgagcacacctagggtagaggccaggatagttgagttttggacgctctgccttggctaacaccttgcctggcatctagcagatgcttatgaaatgtttgtcaaattgaattacttaatttacttgactcaaatattttgttcttctccaaaccttttatgaggagttttttctccacctttgtttgttaattcccaaacttctctccagttctcagttgtggcttatgtcttttctttcctttctctttgtaattatcaggtaatttattaaatggagacaagcttaactagacattaaataattgcaggtgtgcagctgaactgagccgctgtcctttaactaggaaatcacagctgcttgtgttgtattgtgtgatgagattacacttcacctcatttggttacacgatatcttgcttattgtaaggtaaaagaatgttgaagcttctgctctaagcagtacacaaaggctggtatgttcccaggaaaccaacgtaaaaagtacttggaggtcaggtctggagcctttgcaacctctgatgcttctcttttcttggaatttttcatttcctttgcctttttctgtatagagaacacctgaattactccttaacttgagacctgtttcacattttaaaattttcttttggtcaccttaactgtaaaagcaagatttttctgtttccttctaagagattagcagtgggtccattggttagctctttttttgctttcattatcagacctcatctgcatactttttatacaaatttgccccattggtaagaattgtagcttttatgaatgttaattttagtcataggttaaattgtgatgtcaccagtctgttttctttggctagtttcatagtttgtgactattgctagaggtagacactagttatatagcaagtacctagcttattacagaactcagagtatgctgctaataaaggattgcttgattgcttgaagggtatgcaggtgtaagaaatattcatctttcaattggtgtcaaaatttttatttaaaaaaaaagtcatgctgccacttcccagctttgtaactttgggcatgccactgaaatatcttaatcattagatttatcatctaggtagttgtgagggttaaagaaattcaacaaatatttgaatgaactatcttttgtgcctttctggatgctagggatatatttgtgaacaaagcagaataaattcctatccttgcgggattaacatatatgaatctggttttgactgtcaactggatggagtccaattggtgggagaacatgatacctaccatttatgaaaaactctttaaactgaaatatgtgcctaataacactaactttctttattagggacattttaaccccatttgggctttgcagagtaggtcttagagaaagcccttctccatacttgttcgttcagtcgtgtatcatgtacagccatccattttatggttttggctgttgtaaataaaatggctagagcctgtgcatctggagttgtggtgactcttagtcttgggatgcgtgcctcttcctctcggtcgttgctttataggctgtctctgaggttccagaaggggctcagagaatgagctccaactgacatgtttgagcctttgagtctcttcatgaaagctcagtttgttcaagtaaaatctgaatggctcagagaggacactgtggtgtttagcttaccaagcccagtgtgatatcactggtttgttaatatctacagaaacacacacaggaaaaatattctagagcatcatattgctcacctcctctaaattcttttttcatggatgatcgaaagaaaaacctttttgagtctctctcttcttttttgtgaatgactaatagaaagaagacgacactggtaactttcagaagcattgtgatagcattctgatggtgggattatgatgttcagacatgggagggtattagcaaccaaacatcatttcctttaggggactggaggtagtggtcatctgtgagtctagagctgtcttcgagggaagtgagcagtggctcttccaaggacacagagatgtcaggcacctctctcatgcatgcaagtgctacatattatgtccacagtatctggagtatttaaaccaggaataacacgtagtctttattattggaagaaataaattaggtcagagttagtatgccatcgtgtgatgccagtttgtattctttattttctgtacttgcttctagagagggagtaaatactatgagataatgaagaaagacatgtttttgtgacttttctgatttaggacactttatgttgtggaggttttttgaaggatttggaatttggttgcttattgagaacctcttgagaaaatcagattatctctgatacacaaccagtcctacattgagttttttccatttattgctgtagagacatgaacatttatttttattgaagctgagagaggggtgttacatggttgtttatcagctctgccaaaagtagctcagacatccctgatgactcagctgatgcccttgctgcctgattgggtgcttgtgtactaagtacttgtttccttgttgagggctaggaatatgtcacaaagccccattgctgtggggattgttgcagtgagcagacttagcggaactgcacaaggctggctagaggccaggtttagactaccttggaagaattggcttaagggcagaggagaggtttagaaaactcctttcttcctctttggtggcattaatctttgcgaaaccaggctcagactccttttgcacctttcccaggaatggggtagcatagatcttcttcctatgtgaatcacagaaagggactttgtgtgggtgctgtgtgttcattgtaaaccactggtgctgctatctaggtggagttaaagttgataccagcagagtaagttagcctgagcaggaggatggagttctgcagtacagccggaaattttcacttcatagtgtttctactgtaacttctcaccctgtgttgaaaaaggcacacctggccattcgcatagtttggatacgttttaacccataagagtgctgtccttaaagatgatgaaaagagacattttagctccttggaaataagcacatttctgaaaccacccgtctgagtgcacacttgtgcagataaacaggtacttttgtttatgctctgactcaagtggaaagggcaaaataagagattttccttctcctgagtcttttcactgtgaggattttgtcctttaaataaaataaaccggaactgtaacctttattatgggaggagtgtggaggagttaggaatgaggcaaaatgccctccctgtttctcagataactcttgctaccgtctgagcagtgtttatttaacagatttaatgcattgcctcaatagcatcacacgaaacatgtcaccccccctttttagtttcttcccttcaaaaattttcttaaaaatgccagaaccttaccaagtcacttaaataaatcagtccaagtatgaaatgatctctgaagtgacttaacacaaatgattctgactttactacttgggagactcttttttgatggccagccctctaaattgtaggaagatcattttctagctccctattgtcaaaaaacaaagcaaaatcaaattaaataagtcccttaattcccataagtaattttaaaattatctcttgtatatactttacttgtgtgcagcttgcaactgaatatcattgtgagagctatagtttgtcagggtttagatcttaattagctcatgagattgcatccttttgaagctgtataccacaggttgttggctagttttccaaaagcaattaaaatgcccactgttataattaagcctgttactagttgtatgttctagttataaaatatatttggcaattaaggaaactgagattgaggcttttggcttggctctttgagatgcagtagactggcttccaccttgatctgttaggatgactggtgcggatgcctggatgatgggacatgtcttagtccttgagtacctatctttatgagtaagagcaaccacaggtttttacaagaaagctaaagttagagaatgtgactcgtgtcctcacatatgccgattatgtcctacttggtatacaggagtcaaaacctaaacttctaagttgcagtctcttagctgagaagtcctttttaaagaagcattcccttatctttaagaagatggctcgactctgactgtgaacatttaatctgttaaactaacacctccattgcgctgtttaaatttctgtctggttgttgaaaagaaggtgtgggagaaatgttgcaggtacatgtggttaatgtctgtttctgaactgtatttcatttaggagttgttaagctgtgtgcccaccatctcagagacagatttgtctgaactggcctgtggaggaagatctcattgtcagggctggtctcaatggcagatacagttctcagtggtgtgctttgcgtgtcgtgtcttttattcttcctttcctcctgctcacccttaggaatgtttcctttttgtgccttaacaccagaacggtatggtggctgagaccatgggacaaatgcgtcacttagtgggcagatagaaatcagtatttaaagtatgattgaggtttttgtgtttattttgaaattcatttagtacacagggaagaaaacagcacttggcttatgtggttctatcccattgctttgcctgtttgtgcccccgtgcaattaacatgaaaatgatagtttaagaatgagctcattaacatttagaactgggtaggaacagggcttcataggatgttaaaatcagagaaaaagagaaaagagcaggtgctttgtaaatactatgtggttttgagaaatagtagaaagttgggtcttattttaaatttccttttttccagagtccctttaaagttgtgattaatgatatacattattttctttattgggcaaaatattagaattattagagatacatttttcttgggaaaaccactgtggttctctggacatttctatgttaactgtgtcatatattagtatagaataaattcacaggcttgtgggtctgaggacatttgcttgtttcctttaaatcaatttatacaagcacttcctatgcttccttcctaacaaattttccataatttatttctggcctcgtaaaaatagagggaaaataaccaatcaaattattagctcgattccttacatgagttcttcaatttttcctaggtaccaaacaaaataaaaccagtctttgtaacaaagattattggttctgaggaaatgactatccacaaagtgtacatttgtgtgtaatatgtggtatgcattatgtgtggtattttacagttaaaatacaacataattaccataaaataatgtatatgaaatgagttgtaacaataagataagattgacttttaaaaataaacaaccaagaataaacacagcagaattcctaatcagccttactcataggtcaaatttagctttgatgtcctttcctccataagccatatttaggcatcaattcagtataatactccttctttgtgctcccatatcgcacttcatccttccctcatcatggcacttactgtgctgtgttgcttgtttggctaattccttcatttggctataaactattaggatatgagcagacatggtgcctttttcactttgtcctctgaattctttttttaaaaattgaagtaaaattgacatgtaataaaccttggatatttagtatacaatgtgttaagttttagcttagtgttgtccatgaaaccatctcacagtgaggatcatgaacacatttcccaaagtttcttcacgctcctttggaatacttacttctacttctcttctttccttgtcttgagacaaccattgacctggtttctatcattgtagattaattgacacttccaacaattacgtgtaaatgaatctcatatagtatgtactgttttcttttccttggcttctttcacttagcataattaagattcatctatgttgtagtgtatattgataatttcctttttattgctgagtagtattccattgtatggatacaccaaagtttgtttatctatttttaaattgctgagcatttgagtaataccagctttttgcagttataaataaagctgctatgaatactagaatacaagtcttcgtatgggtatctacttttgtttctcttgggtgattatgtagggtggaatggctgggtaaatgggcaggtgtatgtttaactttacatgaaactgccacagttttctcaagtgttagtaccattttacattcccactagcagtgtatgacagttctagttccttcacatttgtgccaacacttgatatagttgatattggtaagattttagccattctaataggcatgtagtaaaatctcgttgtggtttacattttcctttccctactgactagatgttgagcatcttttcatgcttttgctgtccatatatcttcttttgaaaaccatctgttcaaatcttttgcccatgaaaaaaaccttagttgtttgttttcttattgagtttcaagagcttttgtttgtttttattgacacatgattatatgtatttacaggggacagtgtgatgtttcaatatatgtgtacattatgtaaaaattaaatcagggtatttagcatatctaccacctcatacatttatcgtttctttgtgacaacattgaaaattctctgattttgaatactacaatatacaacccatctttggtatcaaattttgaaatatacaatccaatatcattaactatagttaccctatagtgcaagagaacaccagaaattattcctcctatctgtaatcttgtacctgttgaccaatctctcttatgttcccctgctttcccttcccagcctcagtaactactattctgctttcaagagtttttttttttttttttgagagggagtgtcgctcttcttgcccaggctggagtgcagtggtgcaatctcagttcactgaaatctctgcctcccaggttaaagagatcctcctgtctcagcctcctgactagctgggattacaggtatgtgccaccatgcctggctcattattgtatttttagtagagatggggtttcatcacgttgtgtaagctggtctcgaactcctgacctcaggtgatccacatgcctcgccctccgaaagtgctgggattacaagtgtgaaccactgtgcccggccttaagagttctttacgtgttcttaattgaggtgttttattaaatgtatgatttgcagataatattcttccagcctgtggtttgtattttcattgacttaacggtgtcttttgaataatagaggttttaaattttgatgaagtcccaataccagtttgttcttttatggagtatgcttttggtctcataactaagaaatctttgccaatttagggttacaaagtttcttctagaagttttgtcatgttaagttttacatttaggtctatgattcattttgaattaatttttgtatatggattgaattttttttttttgagatggggttttgctctgttaccaagtctggagtgtgcagtggtatgatcacagctcactgcagccttgacctcctgggttcaagtgatcctcccacatcatcccctcaagctgtagctgggactacaggcatgcaccaacacacccagctaattgtgcatgtgtgtgtatatgtgtgtgtgtgtgtgtgtgtgtgtgtgtgtgtgtgtgtgtagagaccaagtctccctatgttgcctgggctggtctcaaactcctaggctcaatcgatcctcctgcctcagcctcccgaagtattgagattacaggtatgagccactacacccagtgtaaattttttttccatataggtatctaattatgtcagcatcatttgttgaaaagactgtccttttccattgaattgcctttctgcctttgtcaaaaattagttgtctatatatgtgtgatctatgtaaaaattccttattctgttccattggtcagtgtgtctgtcccttcccaaataccccacagttttgattactgaagctttatattaaatcctaaaattgaacagtgtgagactttcaactttgctgtttttcatccttcttttaactcttctactggttcctttacctttccatagaaattttagaatcagcttttctgtatccacaaaaatgtccttctgggatcctgattgaaattaaattaaatttgtataccagtttggggagaattgtttattgtgttgagtcttctaattcacagtcattctccatttattttggtctttctgtaaattttttagcagtattcttgtagtcagtattcagcatactttatatatatatatattatgtttactctttttatgtaactttaattcaaaaggtacagagactctcccttagtgctgttcttaagacatgtttatatgacatctttccattagtatctttggtcgtgttcctgcagtatcctcagttgtgctcaccactgcttaactcacctttgcagccaagtttcattttgagtcaaatctaccagaggaggtcatttaccacctgagaaatccctcacttagttttaacagaaataaataactttaaaacaattgatacagctccttctttggcttgtataattttcttcaggcataagtaaaaaaaaaaaaaaaaaaaggaaaaagtgatttcaaacatgttcagagtaactgtaatccagctgtggttgaaagaagaattttgagtggttaaagagctgactgaccatgttggtggctcttgaaacactatcagcttttcttaaccagaaggcaatcaaggacatacttgaggtcgggaacagatatttcataggccactggagtgctgcagtggaaggattccctccagatccttggttcacagacagggaaggtgaagcctgaggagacttggttacttggtttccttggaggatcatatgctcagtgagctcttcctgaaaaccagccctgttcccatcagaaactgcagagacatagtacttcccattcagcaggttacatggagtcagcgtaggcagtcaaaatggagagatgaaggattggtgttgggtaatgagagcaagggatggtcatagaactcagagatgataatgtgaccaacaggatcattattcaaatttcccaagaggcacaaatgtagatgatgattgctttcataagctagtggagttaatttctgtcagacactattctaagtgattttgtatatgaactcatttaattttctcaacaaccttgtaaggtataggtaccgtaattatttcattttgtgaatgagcagaaattaagcacagaggtgccagagatcttttctcataggtgatgaaggtaggagaggaacccaggcagtctggctatagagcacagagtcttaaccactacactgtctggctgatggcaaagagcatgtctattaagaaagcctatggggaaatggtcgccaaatccttctctaattcttggggaccctgagtttcagggttttttttggttttagaaataagggaaactcctgtcaaatgataagattgacatttttcatttttgaagttctaaatgtaaagctctttgaaatgtataggttttcagatactctgtgtgtctgtgtgtgtgtgtttgtgtgtgtgtgtctgtgtgtgtgtgtgtgtataagttcagctcctttaaaagccccatctctgtcacaatcacatttttttttcacaccgcattccaccctactaatactcagagcttagattagggaggtgactaggatactgttaattaaaactatatgacctgattagacaaattaagagaaattttcgatagggaaaagaagcaggacaaggactgaacttctgagagatagtgaaaaatcaaggtgtttttcttattctcagtcacttcacattttacttctgacactagatgtgtggtggattttccccacacaccaagcagttctccagaagacatcaattaattagctgaacttattcaatttaattttgaccctatataccaggcattctgatactgtctacctggagatagtatcagatctcacaatctcagggctcagtcccacacaactgcccccgacttcagacaccaattgcaagttccaggtgatgtgtacttctgaccaaccagctattaatcggggttctcatgaccccctcctcaggtttgattaatttgctggagtgactcagagaacccgggggggaaaaatttgcttatgtttgcccacttattattaagaatattacaaaggatacagatatgaacagccaaatggaagagatgcgtagggcaagataggagagaaggggagtgagtggacttctatgccttccgtggacttgtcacccttctggaaactgcacgtgtttagctcttgcgaagctcatttaaaccctgtccttttgggtttttatggaaaatttattacataggcaggatcgattacatccttagccattagtgactgattcaacttttagcctcctctcttatttgttttaaacgtttgtttccaaagtttttttctcccctttgaggaggacagattcaggcttacatcaaaatggaattaaatgtgcctttgatttggaatggggcaacaagagccgcctgcatggctgtgtatatttatttatatggggtcaggtaaaagcacttttaaaataagcaagtattagagatcagaggttatggagcagctgctggctctggctgacaaagcattcctggtggcatttgccactagctctctgggtgtgggcattagagagtgtgagagttggcctgatggcctttgtgtttgtggccctgtgtggaaactttatagcatttcagccgttctaatctgtgcaggcacagagccacagctgaccataactcttaggggaaatgaggacagaaaagttgaacagcactgtgtgctgtgtagagtatggagaccagaatgaagggtgcagaatgaaaggaaaaaaaattttttttgaagtatcctgcttcagggtttctattgtttgggaaactattcctatagaaatgacatttgtgctttgtgaagggggtggaggtagattttctggagtgtaattttctggagtgtttccttattgaagggggaaaacaaatgattggaaaggctcttcctctgtttctctcatgcatccctacacccccaatatatgcagtgtccttgtttttgttaaatacagaagctatacagagggcagttagagttcatccaccgttttactcattggatgggattattaagagataagaccatttattgcttagcatgagaatcttactgtcccggccagcaaaggaggccaaagatttcatctgaactttacctcttcaattcaagccaccaaagatttattgggagtctactatgtaccaggcataacatatggcatataaaggctaattttaacaattatattgccgtttatgttgttggtttggatagaaaccctgtcttccactaatccttacttttcctataatacaaagattatcattgatgaaacatattacagattattattttaagctatttagcaaatattagacattttcttagagaatgtttgagcatatcagaaattgtggtggatatgttagtttcctatttgctgcaataataaattaccacaaacatagtgacttaaaaacaacacaaacttttatcttacatttttgtaggctagaagtccaacatggatctcattgggctaaaatcgaggtgtcagggggctgtgttcctcgtggaggctctgggacaaattctatgacctcatctttttccagcatctagaggcttccctgaactcctaggtgtatggctcttcccttcatcttcaaagccagcaacagcagattgagcccttcttaaaatgccatctctttgtttctcttttccatagttacatcttcctcttccacttttaagaacccttgattacattgggcccaccctgacaatccaggataatccccttattttaagatctgctggttagcatccttaattccatctccaaccttaattcccctttgctatgtgtagtaacatattcacaggttccaggaattaaatggacatggacatctttggggagccattatttctacctgttacagtagggtggactttccccaaactttgctctttccccactcaaatgaaattgtatagtgccctctattaattctttgcaaaataaattgttacctatgaatgtgtcttgtgcgagtggtgggtggtttatcactgcttaaagcctcactcttcttcattgtgacaaaaccccagccacttagttttgtacaatcccagtgttcaaggaagctagagatcctcttagccagcccgcccgcaggggttttgcacacacattgttacatctcttcaaaatggctgtcccacctttgcttacatgaaatggcctgccttggcaaataaacctctttgaacagttctgtttttgttagatagttcctgctttaatttaggggaaaatatttctctttgtgggtttgtagaacctattggttcttgttttactctctggggtcatattgaataaatctaatttcttctttcacacttgaagcccttgagattttttttaaagacagttctcatatcccccaagtatcagacttaaaaatctcaatttcttcaactgggtctcacataaaactgtcttgagacttctctccatcctgttccttctcctgagtatgatacaacatgaagaaggggaggctgaaggaagatttaataggaggctttaaatgctggggggaattgtcatacagaaaaagctggtaaggtctttacatttaccatggaaacaagaaatcacaggctcatattgtggctaaggagatttaattagcaggaaacctgtcttaaccttatggatttggtgtcaggaaacctgtcttaaccttgtggatcatgcaatggactgcctgctatgggaagttgagggatcttttgccttagtgtaagacaagtcttcaagctcagaattcgtatattttgtgtaagagacgttgcttttagttaaatgttttgcttaaagtattcttgtcattgcttgtcatctatgcctgatgcctgaatttccctcttgtgttggttcattggatgtaaggcatcatcatgactgctgttaatcatagggggaaggaatatggttcagggctttatgaaggaagggaaacagtggcatagcacaggataattaatagcaagtggagtgacagtttgattccctggtagggaccctggcattgttgaaggaaaaaaaaatcactttattctttcatagagagaggcagctgtaattctggttggatggaatccaattaaaaggaactgacatgcaaattgatgatgagacagtgtgagcatagaagtagtccaagaagagttttgtaagaaatggcagagaagagtgtaagtaatttggcatggtaatgtgtgtaagaaaatggaaagctgatgggttggctacctgaacaattatgtctggaatctcagccagcagagaacaggagactggttggtttggtagagttgttaacaaaactttctggtgttttgagttttggtctacattttaggaattatagcctttcataatagaatgaatataaatcaacccttgagggttataggctttcaaattggtggtggttaaatataatattctcaagattctatgatgggagtcccagcctggctcttggaaagaagatctcattgtacaggtgtacttcacctgacctaatgatgtgttctcaaagatttgtgtgagaattggctcctaaatttaggatgaaataggagagcttgccatttctagtaatgctattatgaatcattttctaatgtaaaaaatccttttataaccacagtcatgcccaatttatcttttaagtaaattcataagtccacatattagatttgtttaaaccaaaggtatttttctttgaaatgaaataattgtaggggcacataacagttaagctttagagtaacagaggaaaaattgggtaagattttataagtcagtatattgctttttagggaggaaattctgcctaagaagtcagacagcttctgctgttattacgggaaaaggagaaggctgcccaacgtatttcagggagatttactaggatctcttgggaactgcagtagaaatcactacgaaatattttgaggatagaggaaacaggacaacagcgtttactaggttttattctgaagaaagccaaagaaggtggaatggagttcatcttgagaaagcggtagaagattgagaagctaagaaaagacttacacagcagcaaaaagaagaagagactggagtagtgggcagagttttcagttagcaagagagcaccatccaattgttatgctggtcagcagcaaggaacattaatgaaggagatgaagaatgaccagggtcagtttttgttcatccaggtttgagcagggtgttgcttatgatgctccatgcagttttgcctcccacaatctctctctgatctttgcctcctgatctgctcaagtactgcagcagcaatgcattctctactgaaggctgtcacgtttacttttcactgtgcctagaatgctcttaccctcaagcctccctccttcacttgattcaggttgctgctagaagctcccttatcagagagacctttagtgaccattctgtctgaaggaggcagacactcttcccttattccgcttttcttcatagcactcattatcacctcacacatggttgtttaatgtttccccaattttctctgctagaagtaagttctttgagagttcagcttcagtttcttttgcccatcagtgtattcccagtacctaatttatataaaaatttgtggaatggatttttagggtatctcttgcctatcacagtgagaagagctgagaatgaagaatacaggactcagtccttgtcctgtgttatgcaatgtattacatagttatagtaagtataacagcctgagcacagagtgctgtgagctttgagaaataagctagagatggtcatcacagaactggatcttgaatgataaagaggagttttgttctgtggtggagacaaggaatgatcttctaggctatcaaagcagggtgagtgaagttggagagatgtagaaatgagttttgtgtttggatgtcattgagtgattttgatttggctgctagagcacaggtacatgggaaagcatgacaaaggggcctgagaggtagggttggggaggacatgtgaaacatatgttgagatctgattggtaaagttattgataggcgtttggaccttgtcttttgggaagcagggaagtagcaatatccaaaagagagtgcttaaggatggattggaagagggaagattatagaggggatagagagcaaagcaggatgtgactttcccagccttgaaatgcatgagaaagtttgggatcctcacaatgaagggcaaaaaaaaaaaaaataaaaagcaattctgtttatggatgtatagcaatatattgtgtataggtggtggctattagaagactagtagttcttggaactgttcctttttttctcacaatagtagttaagctgtgtcattgggatacaaagggaaggagaaggctatttccattcttagaatagaaaaattggaaaatgccttggcaaatggaggtattcttattctacattttttttttttttttgagaccaagtctcgctttgtcacccaggctggagtgtagtggagccatgtgagctcactgcaacctccgccttctgggctcaaacgctaccacacccagctaatttttttatttttgttttttaagagctggaaatttgctatgttgcccaggctggtcttgaactcctgggctcgagtgatccgcctgccttgtccccgcaaagtgctgggattacaggtgtgcaccactgtgcctggccataccttacaggttaagcagctatgtggccttgtgcatttcatttaactgtgtttcatttgtcctttcatggagatagactttgttgatatcctttcatcgttgatgtgcagaacaaagtatgctgcttgggaaattataaacatactttcatttgaaatattgggtaatatcaggagtcctttgctttaatagaagtagatctggaattgcttttttttttttcttggaatatggtaacaccaaagcatctgagctactcacacccatttccagaggaaaacatgatcatttccaggagatggcctgcagttttaaagctttttgctgcttgttttctacatgtcaaaacacatcccatttcagcagttggtgagcgctaccatagaactgttcagaagcaagagggaggattgagtcatgttgtacgtgcagctgcatattaacctgcaggtcatagcagtccctgatccaaaggactgtctgacactttatccccgttcttactgccttcatcattcacagcagccagtgtaggactctcccactttagccttgatcatttggagtagcagaatcgtggtcttgtgtatatatagagtgttatataggccatgtgattctcggagacctttttaggaagtttgagcaaccttacatattggaattctttcctctttttgagaaggaggaaagaaatgtatgttttataaggattgctttgaaatagatccattttgcagggtttaactcaagcaaagaacagactagcttaatggttaatattaagttactggagtttgaatgcctaggtcccaattcaagcttcaccattattagctatatgaccattagccagttttctcatttgttagatgatgataattacaggaagatactgtatcttcccacagagtggtccagaggaatgaatgagtaaatacatgtaaatcacttagactaaggactggtattatggattctctgactgttagctgttttattcctgattttctcatagccactggcatttctaagaccttgcaagaaccactggtcaacttttctgcctgctatgtttaactagtagaagtcagaaagtgacttggtggcagagtgctagaaatgattcattgggtggactattgagcttcacaccccagtccactggcatcatgtaagaaacaactcattacactctaacggtagtttagtgaaatggatgagtagtcttagtctgcctcctcaggctgcaacagaaagtcaagccaagcagccaggaatgtctgggaatcacctggagagaggacagacatctgcagcacagtggaaggtgatagatgagtgggacccaggaataaactacagaagcagtgtggattgtgttgattctagcaagcaggagggggtctccatggtatttctgagtataagccaaggaaatgtgttaatgtggggggaaaaaaatcaccgaactgggagagagtcagactacctcgggtgtgacctttgccctgtcaccaacatattgtatgtcacatccccatggggcgagtcacattttctttctaactctgtttctttgtctgtaaaatgattaaatgatttcttgactctttcttttctagattctttttaacgatttcattagcttttaataactatgtgaggaaaggagagcaacctgctatagaccttggcctgtgtgagtctttaattttgttttttgttatttcaaagaagttcttgttcaaaagaccatgagacatttcatcattggactttttagggagttgtctctttaatctctcatatttccttttttccctacaaatgatatccacagtactgctgttgtcttgtgctctctggatcagcacttttccagagaaatgaaaacactgcacttttaacggcacagaaagcaaaattactgtagcatcaggattcaaggttacagaattggttaactttctggtttgttttgctgagctgaatgaaaaagatttgatcgaatgttactgcttagggataaatattaataaccacaaactctcttagtgatcattgtccccccttttgcagaaaatttcaaattatggtctaggacttagattgtgattgtcagctgaatatgggcgtgaaaaatgtggaataaccagataaaggacccttaattggttgtagaggaacaactttttggggatccatgtccagagagggaattggttctggattattgatttgtatcattactttgattaagtgtctagcagttgctgtagacctttataacattatataatagaaatggtattagaaaaaagtcatcaaaggtaggatttttttaaagatataagaaccgaagtttttaatcttcagtccttcatagagaagaatttattaggtttgagagttctcagtaccaagtaaattctaactgcagacttaaaacatatgaatacactcacatatagtcaccccatcctctggcctggttttgttctctattatagttgactttgctttaggggaaaggagggagagtattggtattaatttatttgaaaaattagcaggagtatatcaaacacttactgtatgccaggacttaccatgataaataagaggtggacccctgtccttatggagcccacttgaatcaaaaagtaaacatatgagcatgcaaatagatggctgtaagaatgtgatgggcatgccattttttctagcaggttgcctaccacatagtctatatgtgttagagatacacattaggtacacagaagagggtccatttgtggcatagagagagattagaggaatcttcatgaaggaagtgacatgatgatgatgttttgaatgacaggaaggagtatgcaaaaaaaggcagggttgacattccagacagaaagactagtatggaccaagacatgtggacatggaaatggtttgctccttttggggtcctgaaggtaataagtgcaatgaggctggagaactgggtttgtcttaaggggctatgggaaatgagggtcagagtgtaggctcttatgaaggctgtctggtcagacttgaggggaaggtatgctggtaaattgcactgagaatagttcctagctgtcccatatttcagcatctcctgaaatagatgtgtactgtgatgtacaagttccaggatacaatcagttcatgagtatccagttaatgtacctgcaggatttgggcagcaatatatgtagggtgttgtgtgaaaatattggatatgaacaattacaatcttggcttgcacaagaaatcattgtgatgcaggagggaagggtagaaaagttagattattttttttcccctctaatgcagtgcctctcaactttgttacaaattagaattacctggggatcttttttttaggatattgtttacatgcagtgaaatgcacagatcttaagtgtacacatcaatgaattttggcaaatatacatacccatgtagcacacttacccatcaagttatagaccatagtcagaacctgaaaaagttttttagtttccggtttgaatcaattcctgcccacccctcccatatgtaaccactgttctgattcgtgttaacatagtttagttttgcctgttcttgaatttcatgtgaatggaattatacaagtatgtgctctattgtgtttgccttcttctgttaacataatgtttttgagattgttctatattgttacatgtcagttttttttaattgctgaatagtaccctgttgtacagatataccacaatttgtttaatcattttcctgttggtagacatttaaattgtttcagatttttggctattatgaataaagctgtaatgatcagtcttgtacaagttttttttttttttggcagacataggtcatgatttttttttaacgtaagtgcctaattgtggaattttgttataggtatgtcagtgtatgtttaactttataagaaactgccaaacagttttccaaagtggttgtaccattttacattccctcctgcattgtatgagagttcttgttgttccatactgtcaaacatttggtatgataagtctttttaattctagccattctaatgggcataatatggtatttcagtatggttttaatttacatttctctgatgatttatgatgttgagcactgttttcttttgtgaagtgtgtggtcaagttttttttgaccattttcaatttggttatctttatgttattgatttatagggctctttatatactttggatacaagtcccttgccagatatacataatgtgagtacttctttcagtctgttacttgcctttttagttcctaatgacatctttggataagcagaattttttaattttgatgaagtatagtttatcttatttttccattatatattttgtgtcttttgtatcctcactaagaaatcttttcttaccctaggttatagaaatattcatctttgttttcttctagaagctttatttatcttttggtgtatgttccatcacaaatttttgagtgtgatatgaggtaagggtagaggttcattttctccatatgtttatctagtcgttccagcactatttgttgaaagaccttactttctccattgaatgtccctggcacctccgttgaaaatcagttgcttgagggccaggtgcagtagctcacacctgtaatcccagcactttggggggatgaggcgggtggatcacgaggtcaggagttcaagaccagcctggccaatatggtgaaaccccgtctctactaaaaatacaaaaagtagccaggtatggtggtgggcacctgtaatcccagctacatgggaggccgaggcaggagaatagcttgaacctgggaggcggaggttgcagtgagctgagatcgcgccactgcactccagcctgggagacagagtgagactccacctcaaaaataaaaataaaaaaaataaaaaatcagttgcttgtttatgtctatttctgtttaggtctatttctggactctgtgttctgcttcactgatttatttgtctgtcatcccagtatcacactgtcttgtttatctagctttatagtaagtcttgaaatgcagtagtgtgaatcctcccactttgttttcttttcaaggttgtttttactattgtaggcccttttcttttttatataaggtttagaatcaaattgtccagttcttaaaaagaaaggtagctagggtactttaccttacaaaatcccttgatacccagaccatacttcatcccagttaaatcagaatcatttagaaatgaacagaatctcgttcattccctagattcttctgagtgcagccaaaattgagaacctatgtactaatgggattttagtgtggtacactaaagaagatactgtcatggattgctgggatggaagccattccagtggaatgtatgcataggagctgatgtgggcccctacacgaaagaaattgttgatgtttatggaaccaggagagctgaatgaggaagagaaggagcaggagtgagaagccctgtggtcaaggtagtagagttccctctccctggggcacatggagccccattgctgaggcgctgccttgtgtggctcctattcctgattattcagggtattcccaccctaaacctgctgcagtgcagccaacaaaccaccaacttgaaatctagggaatactcttagtagagcgtgtaaatgtactattttaaagaatagctttcccctggattagggaaatgcttgtgaaatctgcatagtgatgaacagggtaggcacattctagaagtgcctgtgtgggttttttgctttttgagttttttctgtctttttaatgtaatgtctttagacaaacattgagtcatccattcttcccaagggtaggtagttcagtcagaagtgatgttttcccaaaaggctttaaagaaaaacgggacaaaaagttacgctcaagtaatatgttctttgggagcactcaaagtatgcaggctggtaggttgcttgcttgtggcttttttttttttttttttaatttaaacacacattttcctctttgaaaagagaggttggaactagtcagctgagtccctctttctgaaatacacgttccctaaacagctgtagagaattaatttcagtcaaagatagcagagctttaatctcagctttctgctcagtgttatggaaaatcctttctagaaaatagccagtgtctacctgctatgggatgttaaaaaattcaaacgaacattggattttttagtgttttcctagtagaaacagcatggaaaatcctttagtgagctagattttacagtgcacacagaaagcaagtatctatgatacatttataattttgtgtgtgtcacatgttggttgtactattttcttattcctaatagaattgaaatataccatgtccaattccaaaccttattttttttgtgtgtgaagggttgaagcattttagacaagaaagagctttgatactagcaactttaaactcatttataggatatatatacatatataatacatacatatgtatgctctttcaaggcagaggaagaaggtaggcagagtatgagaggagagttgcttttctttctcaacttatgattgtatttaacacatactcgcatgcacacacacattcttttaatagcattttttttttgtagtgagagaaaacttatctttaagaagtctctaatctattatgggattaagagttttaaatgtcccccaacacccccccccccatttttatacttttatttctacgatttatatgtcacgtgaacatcactttttggtggtgtgattatatcggaatacttttgtattttgcttaacattaaaaaagccatttcttacattgctatatcatgatagtaatttaatggcagcataatagtacctcaaattgtgccatactttatattcttctgttgtaagttttctattttgtgctgttaaacctcaaagaacttatttgtgcatagaatccctcttaatttcttcagtacatcctctgtgtagaatagtcacaaggtgcattttgttttttccttatctgtgtacagtttacactgtatatgatcctcagtgatatagggtgtatttaccttaagaatgatcattatttacatttctagggataaaaagctactggatttctttcataactgtattatttaaaaagttgttcttcccctttatttttgtgcacaaatttgagccacatttatgtttgtcttttaatgggttatgggttcaaatttttttcttaactggtatgtttttttttgttgttgttgttttaatttttttttttttttttttttttttagaaactaggtcttcctaagtaagttgtctggtttggtctcgaactcctaggctcaaagtgatactcccacctcagccgcctgtgtagctgggagtccaggtgtgtgccactgcacttggcaatatgtaactctttgtgatatttgtcatgagtattttttccaagttttttctttttttattttagtgccattgtgcctggcaatatgtaaccctttgtaatatttgtcgtaccttttccaagtttgttcttttttattttagtttttcattacaaagcagtttatgaagttttttatattttcttctgttgccttaagatgaacaaacttgtcatcccttctgagatctaacatcaattctgtccccacctgccccccaatatttcctgtggtttaattaaaagcaatttttaaaatccatctgagtttctgtcgatacatatgccctctccttacctgctgtgctatgaggaaaggtgggctaaatcaggagctcgtgttattcatatcttgggagaggaatagaaacagccagtactccaatctcagcttcctgtaatgtctacaagtcagtgtttgctcatctataaagctgggatgagaataacaaatgtacagagaatttttttaatgcacttaagccttctcttaagcactgttaagaacttcagttgaaagtgtttaaaataccaaatagctgtaacctttgattgttaatatgtgtgcaccatcatttcttggatttttctcaatagctagagaccacatgggatctttggtgttttccaaaatgaaccaccatgctattacctgcagacattaagggtctgattatacaaagaaactgagagttgaggatgtccatcagaaatacactgtttcaaagtcagatctgagtacttggtgaagactttggggactacttaatagtaatgattactagaaaaataaacactggcaatatagatagtggttaaaaaacatgggctttgggctgggcatagttgctcatgcctgtaatcctggcactttgggaggccaaggtgggaggatcacttgaacccgtttgagaccagcctgggcaacatgccgaaaccctgtctgtataaaaaatacaaaaattagccaggtgtggtggtatgcaccttaagttctagctatctggggaactgaggtagaaggatcgcttgagcctgggaggtcgaggctgcagtgagccatgatcatgacactgcactctagcctggaagacatagcccaaccctgtctcaaaaacaaaacaaaacaaataaacaaaaaacgtgggctttgacagagagacttgtttaacttaattaaacaagtgccacttaagtgatttggggtgagtaattttagctctctaaactcagtttcctccactgtaaaatggggataatattgatgagtggtttaattaagaaaatgtatgtgaaatattgagcatggtgcctgacccatagcaaatgctaagtaagtagtagctgttattacttttattaacaagtaacatttgtataacatttatgacctacagagccctttcacatgctgtttcttatttgtgaactgagtgttttatacagaatgggtttttaaatgttccataggctttttattcatggcttcaagaggttgttccctttttgggacctgtacagcttgtgtatactcagttggcatttgtcacgtatcttcatgccagtgtctttgtatctgaattctaaaactgcgtgaacacaaaggttatgtcttttgtcttattcatctgggttgtcactggaacagagtcaggagacattcctatttattatgtgcgtaatcgtaggcaagtcaatctctggcttgccaaagctgtcctttcctcatctgtaaaatgggtaacaagtttcttgtgaagattacgttaaataatgcattaggaagcactttgtatagaaaattacaaatagttttttgttttttgttttttttttccgccatgcctcactagcctagtatcacagtagatgctgtaaggttggaggttgttaggaaggctatagagccaagtcttaactttagtgtcacaatacctttgttaaacaatgaaattcagtctttgggggctagttgtcatgctgggtgctgtgccaggctaattaatactttggtaccttgcctttaaagtacttactgctgctgtctccctccctcccctttggtattcattatttatagtataaaacatttgctgcttgctgttgtaaaggtgggggatggggtgtagttacacataggtgctcagagcaggttcaatgatttaaccctacatgaggaagtaaacttaatctacataaaatatggatttgggggtgtgtgatctctgtggtcagtctggaggagtgtgcgtgaggtgtgtcagccactaagcaaacaatggagtgctggctctgtggactcttggctgagtcagcattgtttcccatggaatttctttttctcttagcccacaggtgtatttatgtgtcctggtatttcttcgtttttattttcccccaatttgatttcataaatgatagtgcaaagtgttggctatggttaatttcagtaaataaggcccaaatatgaggtatctgtttctctcttgagtaaaaaataaagtcatgttatggggaataaaagcaaaagcatttaataaaaaaatccctttgttcattttagaaaatggtacctttgttaattccttaagagacaatttattatattctgacactatctttgaatagtcaaagaaggcatgatgtctcaatttaaatttcttcttcctggcacagcttttattctgcaaggtttgtgcttttaggaagagggtattgtttctcataggagagtagagtgcctagtggacagaaaaaggtaaagattgtcatttccttgaacatagattggtgtttaatttctacttaagggtgtcttttgagaagaacagagcccactctgtttagcagcttgctttttgctaatcatgtggtgcatggtgtgttttcatctagtccgttccattaagtcttatttatgctttggggatatggataattggctacggctcaggtgaggtgcataggtgatgtgtcatttctctcctgaggggatagagatgacaggcttcttttagataatcactgtcagtggctgggacccaggaacctttggtattcacctgtttagtcagtggggggcaaatttgatgcaagagcagagagggaactgtttttaaactatgtatatagtcactatgtgattaactctttggtggccctttaagtacaggataaatttgcattagaacttagtgtctcagagtcttcgattacatgaagtctgaaaaagtgatgaccaattgtcaatattttggacatattccatgagtgccccctcagaccattggtagagataggtttgcaggtggtgaccctggtgaaatcctcctctgagaagggagtgttcaagggcatacgttggcatcatttaagtagcagaagagagcaccccattgagatggtttaaaaatgagatgctaactttcaaagttttttaaattttattttttacaatgcctgtgatgctactacattgtataaacagtatgtagtgttaaggatgtgcctcgcatgtaagccaccactagcatccttagtgtgggggtactgttccttttctacccaaatccctgcaagatgttctgagattttggtgccaaggagtctcccaacattcaacattgttaaaacacacttccttatcttctttgaggttttttaatagcaaatcccaagccactcacctttttctcatagtattaatgttctaagagtggctatacattatgttaaagtcagcgtagttctccacgggaaggctgttttttaaatgagacttattcaacctctttttagctggtgtttcattaccaccgaggatttataatgcaatagctctgaggcaaagctggtaagaatgccagcttcgctaatatttagagtcataaaattctggatattggacaagctcttaattactctgaatccgtctttgtcttaataaaagttggattgtacccactaaaacaagatggctgtgtttgcattaatctccaaatgtaggttaatacctttttaaaagctgtctcctagacaagagacttgaaaattaatttcccattttcagcttaaaacgaagagctcttccacgtgtggagattgaagggctgccatttttctgatgctgtagattcaagtgccaataataactctttgttcctctttagtttttttttttttttttaatgtcttaggtaaagaagtctttcttttctggtgcttggggacttgtattttttaaaaatctgcttcaaagtaaatagatgaaatttcattttctcagtggagtttggatcactgggattgagggggatgaggaagggctagatagatagtatgaaacctattggattcatactatggctgcagaagtctgggctttacacattaggttgctaccaagctggatattttgaaatatatatatgtatatgcctgtaatgttttagcatttgcttgttgggttttttttttccccataatggtaggttcttaactgactttttcaaatgcaaggtaaaactttcttttccttttcttgtctccagagtactgatgtgtaaccacttagtaccactaatgccaggattcatttctgtgctacagatggtcagtgagattataaaagctctgaaaaggtttttatataatttgaggtcttctcagttgagagtttgtgtctgacatattaattccttcccatccaccccctgccccattctcaatgtaaaccatatgggacatgtattaaaaaacaaatttcagacattttctggagattttaattcagtagttctggaataggttgcaggaatctgactcttaacgatcaagcacatttgatattcagacaactctattgcatcctccagaagctccaggattctgtatataatttgtaggatatacttgcctcttctatgtcaagtctcttacccagtctgattatgtgagatgtcttaaacagagcgttttttcataaacctttatgtaggataatactactcctaaaacactttattacatagtttttggattggtaatggcaaaagaatgagaaagcacctgaggaggcaccattgtgagtgatgaaactggggtatcagacctggttatgaaaggagatgataacccttgtactgttttcagacagttgcagagttatcctatgaaggaggaaccataattctggtggccctgcagagcagaccggggactgatgaatggatgctgtgggggctgaacataaagagaacaggtttaacagaagggaccaacatcctttgagagatactactttttaccttctaattatttaacccatgaaactattattttctcccaaagacacctgtttttagactatcagttaataaaaagaatggggctacttaggtggaagctggctgaggggcacaaacagattaagccccttttctccccagagctagcaagcagtacccttagccagaagccttgggctccatagaagtggccacaaacacaactagagtatggtgagttctgttcagtggaggtggccgcacagccccctgacaaggagtcttgtgagctccgtaagggctggcccttatctgatttgctgctgtagacagccagtgcaggggactagcacagagggcagagcttagtgaaatgtctgtcaatgaaagctgtggaggacatttgtatctcacattcagtgctgaatgagatttaaaagtcctttctaacataaaaagtctgtgatctctgcttccaagattaattcttaggtctcagtatggatggcccaaggatataagctttgtgtctgcagggactttgtttcctatagtgctggatttccagtacgtagactagcacctgacattagtgggcactcagtgaatatttgttgaatacatgcatttgttgaaaaaagtgaaaattgtttaaagtggtactttgtgaacctttttttctcttttttctgtcatcctggagacttctcatttaacccccagtctgtctcgtgatccatgccccatccttccttcatgcctcacaccacctccttctcaatctatacttggcaaagaggaataaagacgctaaggatattgtggtaaaccaaagtcatctcagaaacacagtgaaattccctaggcatctgaattgggaaacctattggctgatttgctttgacttgggtatttcctgtgattttcagccgggatgtgctcctgtgctcagaagtgaggatctgttgtaggtttatggcctagattaattgggatattttgtgaagtctctgaagtgttatcacttcatctttatccttgcctgctattcctcatgaaaagcatttgaattattttagagaagatataaatttgcttgtgttatccagtgtcagcttaaagctgattagcattttgcatcacctttgcaactcataaatcatccacttaccctctcagtaagcaggctgtaagtcagcatggaagcacctgctgcagcttcttgtcctgtgatttagaggacactccagattctctgcagacccttctgtggtgttattctctggtaaggcttcacctatatgggaaatgagtaaagacttttggtgacttttttttccctagggagttcttaagggttaccctggacgagagacttctcagaaatatagtctttaataaacctggtccaggcacaggtttggttcatttggcatatttgttgttttaaaaattttggaggtacttttcaacatttaaagtccaggacatttcacatttaaaaaaatccagatttagggttattccgggaaaatcagaacacctggcagtgtcaggccatgctgcatgcctggcttcatttgttattgagagcaggagtgctctaggaaaggggtacagattttccattttgctgtagactctacccctctcagtttttccatgggagtcaactttactcaaagtcctgcactgtagatgcttgaattggtgacatccttctatgttgtgcgagtgtatagattgttttttttgtttcttttttgagtaatatcaaccatttaactcaattgaataataacaagaggctaacatttatcaaatgctattaatgtaccaagtactgtgctaagtgcttgtaatatgtttgtttatatattctttacaattatcctaattgtatagatgaggaagaaattgaggcaaagagaggttagataacttgctcaaggccacctagctagtaaaagtcgggcagagtcactgtggtgtcctcagaagcaagtccctgcttgggctagcatttttgcctagtccgggttatctccagaacctggtctgctcctcattcccatatcccattaggaacagtgggcatcagttgcaaaagtagatgacagtaacacactccctaagtccccagtctgctcctgggaggagcagcctgccttgttcatggcagtcatagccacagggggatgtttgaaagacagccccttatacagtgtctattgattttcttcaccctcttgttttgctcatccatcctgttgttctaggatgcttatttgtcatgcataaaagccttgttacagtgaacccaaacaagtcattgacatttaaaattaaattgcaacaggtattgtcaatagctaaactgctcattgacagtgcattgctaattgcattgagagaacatcctaactgggtatattctgccaaatcaaatcggaaacattggctgtctaccagcaaattcattttgacttgcacagagtttggggatccacagatccctcaccaatctcaaaatactgtgtttatggaaacgctaattattatttttttttttgctgaggttctttgcagagaaggggaattctgatcatcttcactgactgctaagccaggagtcagaaactgtgcctttggaagggagagaactacagatttggggtggagtaaagttcaatgcaagggggtcatttggggaggtgggccatcaggttctttatctgtaaatctaagccatatccttggatccattttttttttccttctctcctttttcatccccttctctctcttctataggtacatgggagggggacaagggtggagacacttaatttttattaagcactgttcgtggtattttatgtgaattaatttgtttacttcccacaatgaccctggggagcagatatgctatcaggtaaaaaaactaaggcacagagagggtaaaactcttcgaaagagtcttgtggttagtcagcttctgtgagagtgagagtgggctgccctgaggccatctgttccctctccccagctgatatttttgtgctctcagggtaaacatttaagcctgtgagttaaactcagccttggactagctgagttcctctggaggccttgcaagtagcagtttggttggcagggcaattaagtatgctaggtgcactgtgctgaaccccaggagggagggaaggaatggaatctagtctttgcttgcgttatacatgcttattggtttgtggcaggcgtgattgatgccagaatcaaaatgacttaaagcagcttcccttgagaagcactactctaacggttttttttcctctttgttgccctaggtcccttgtgaataggatttagctctgattcagctgctgctgttcttttggtaatcagtgtggaggaaggagatgagggctgctattaatggcttcttattttgcattctcctaatcagatatcctgcagttattagtgtgaatgcaagatgttcggtggtgtccctgggtggttttcttaggtgtactggactgttagctttctaagatggaatgttttattaggttctggcctagggggttggttagatgggtggaggttgttaaaaagcactaaagaaaaggaataggatataaaaccaatcttcagggggtgggaataacaacccaccaccttcacttccctcccctcctgccctgaaaaccttatcttgctaatacccttcagatattaaaagtgaaataacagagctatttactaggcagctaaatgcaaattctctcccccattagttttaattaggatgaaatcatacatttaaataaccacttctattactaataactgaacttctgattcactctgaacccaggcaaatgcctcttctggtatgaatggcccacctctgagtcattccgcacctgcatattgacacagccaggctcctgatgtgggtacacacatctgggatttaagggcatgactggcatgttgaatcttgggtataaagctttctgcactataccctggggacaaacaggatagctcaactggagaataaagagcttgcaagctcaaaagaaaacaacaaccaaaaatacctcaaccaaattctgctcttgcttctatcctactgtttctttaggtgtttaaagggctgtagttttaaaaatctcccacccacctcatctttttaagtaaatgtcacaacagtactatgtcaatacagttgaaaataagtatttgagttgaaagaattggctctttgaggctttaactatcagatttgtgctaattctttactgtttccttgacatagtatatgcagtctgtgctaagagagtatggatgttgtcgtcggtgtatagaatggtggctgttgtaaacttctgtatgttggggaaggattgaacctgctgtctggagaattagaaaccagcagcttgacttaaatccctcagtgtcacaaccagctaatgaaggagaggactgctaaactcccagtggtctttgtggctacgaggacttactcaagtttgagactatctttagtgggccaatgacgtaggaacacaatcagcagaggacatgtagtttacagcagcctgtaatgtgccagagacatgactagctgcctctttggccctggggaagtgtgtctggccctgcttgcatcctctgtgagtgggaattgtgccagacaccagctagacatgaccagctgcttcttcgatgttctgtggacatgattggctgtagcttttgatcaggacagtgttcctaatgaagtgtgaccagcgtcatttagacaggaaagaatgacagctgatgtgcaagaatttttcttgattggcagcatttggaactagtaaccagagaaggtaggtggggggaggagaagccagctctgattgacaagagcttatctttatttaatctacttctgaggcactgaagttgaaatcttaggcaagtgaaagaaaggaagacacaattgtgaaacataattaaagattcttgacaaaaacatacttaaatcagaaatgtcttttttttttcttttttgagatggaggtttgctcttgttgcccaggctggagtgcaatggtgtgatcttggctcactgcaacctccacctcccgggttcaaggaattctcctgcctcagcctcccaaggagctgggattacaggcgcctgccaccatgcctggctaatttttttgtatttttaatagagacggactttcaccatgttaggctggtctcaaacccctgaccttaggtaatctgcccgcctcggcctcccaaggtgctgggattataggcatgagccactgcgcccggccagaaatgtctttcaataggagagcaatgcagagtttaggtgtgaggttatcactgctccttcggctatgagaaagagcttttgcccagggattgttaatttttaggcaaaatttaaagtggcgatgggcttggatagttctagcaataaaaaaagttctgcttctagttaccatcttgttgactttccaacctacttggaaagatttcctttggagaggccaaaaacaagtgctgtgtatggagtgtggcctgtggtggtaatttctcatcaactcttgatccactgaggatttaaatcttaagtcttcatgtgctttgagaaaagatgacaagcggaaatagtatgtttgtttcctaaggacacacatgtgatttctgagagctgattgtatgcaatgtggtggtattcttttgcaaataggcttgggaacttggcatcctggattcgaatctgggcaccaccattttccagctcattccttcttattcaactccaccccacctcgaaccccgatttggttttaaagattcacatactattgttttagtaattacccttgaaataaagtcacatatacttttaagtctaaagttaatccaggacaggtgcggtggctcacacccataatcccagtactttgggaggccaagttgggcggattgcttgagcccaggagttcgagaccagcctgggcaatgtggcgaaaccctgcctctactaaaaataaaaaaattagctgggtgtggtggcatgcacctgtattcctagctacttgggaggctgaggcaggaggatggattgagcctggaaggcagaggttgcagtgagccatgatggcaccactgtactccagcctgagcagcagagcaaaaccctgtcttaaaaaaaaaaaaaaatccatagcctaaccaccttggataatacaagtgactaccctatatctgatcatactgccaccccaacctaaatccagtatttgttttgccttttttttttttgagacagggcctccctctgtcactcaggttgaagttcagtggtgcgatattggctcactgcagcctcaacttcacaggcttaagtgatcctccccacttagcctcctaagtattaggcatgaagcaccacgcttggctaatttaaaaaatttctatttttgtagagacagggtctccctatgttgcccaggctggtgttgaattcctgggctaaagtgatcctttccacctcagcctctgaaagtgctgggattataggcataagccactggtgcccagcctattttacctttttttttttttttttttgaggggggagggcagatggtcttttagatttacctatgtatttgacaatttgtttgttcatatttctttcttgtgtctcagaccttccttcaggtttgacttttctttagaatttccttgagcgagtgcctattggtagtaaatgctcttttttgtttatcatagatgtctttcttttgcccttcatctcaaaaggtagttagctggatacacagttctagggggaaagattttcttctctttgagtcttgtaggtttgttgtgaagattacctgggttcatatctaaagcccttagcactatgcttggcatgtttgctctgtaaataacagtggctgttacattctcagaaaaatactggaacagttggaggcaatgcaggcttggttgggatgtccatactttgactaactttttacattattttcttaaaactttgatttcattgagattggggtgggagtacatttaagcatcaaaactaactttgaagatagatttgattgaactgtgagttctatcactcgctagttgtatatacctttggtagattatcttacctgtcctaagaatcagtttcttcatctatacagtgatcattgtaatacttcctatttctctgagttgctgggaaggttgcatgagaacacatttaaagctcttctccaagcctcacatagtaggtggctagttgtggtaattatttgttgcctgtaaaccacttttatgacttttatgtagagatgttaccaacttgtcttttttattgttgttgttctagctattctgtttttatttgctcttccccagatccacagaaaagatggggtatctcctgcacaattaactttctactctactgatggggaaggccttctgcagagttggtggctcttgcttggaggcaacactttgatgcttgtctttaggtgggaaagtagctttccaggcccagtactttgctacttgtaagactctcacttacctgaaaattgtttgctctggtttttcttgtgactttgggcaagttacctaacctctcagtgcctcagtttcctcatctgtaatatgggaataataatagttccttcctcacagggttgttgtaaagactagatgggttgacacacatgaagacctgagagcatgcatgacacagaggatgtgcttagtactttagcgttcatcagtgttgtcagtagccagggcttccttctgtaccatattgttgactttcagaataaaaaatacattgtttgctatgactttgtcccagggcgtgtgtattaagcttccacatataatttatatcacttattccttaataacattgtcatgggttagatgggacatgtatttttttcaactttattttttacatacaataaagtgcatcgatttttaagtgtacagttttatgactttgagctacagtcaccactgctatcaagatataggatatttctgtcaccgtaaaaattcccttatctctttcccagtcagtctgtcattcttacatttggccccaggcaaccactgatctgcttcctgtcattatagagttttcttatttagagttttatataaatggaattacattttacacactctcttatgtctggcctattcactcagcataattattttaaattttatctacctacctgcatagtacctatattttgagataggatcttgctctgtcacccaagctggagtacagtagaacgatcatagctcactataacttggaactcctgggctcaagcaacttctcccatctcagcctcctgagtagctgggactgtaggcatgtgccaccttgctaggctaattaacatttttttttttggtagagactgggtgtagctgtgtttctcaggctggttttgaactcctagtgttaattgaggcctcagcctctcaaagtactgggattataggcatgaaccaccacgcctggccagcgtaattattctgaggttcattcatgttggcatgtatcaggaggctggtcatttttcttgctctgtggtattccactgttgaatgtactacagtgtgtttagccgttctgctggcgatggcttttgggttgtttccaatttggggctgctataagtgagctgctatgaacatttatgtacaaatctttgtgcagctatgttttcatctattttgagtaaatatctaggagtagaacttctgcatcttaaggaatatgtatttttaacccccttttactgatcaggaggaacttagagggttggaactgaccaaggtctcacagccagaaaggtgtcaagcatggaccaacatttgatactccttttctgtttcctcttcaggagtcattctattagaccagtgatttcacacttttagagcaccaagactctttttaaaataaaatactgtaggtccaggtgtgatggctcatgcctgtaatcttagcactttgggaggctgaggtaggagtattgcttgagctcaggacttggataccagtctggactacaaatcaagactccccacactacaaaaaaaaaaaaaaaaattagccgatgtggtggcatatgcctgtagtccctgttatctggggatgctgaggatcacttgagcccaggaggtgaaggctgcagtgagctataatcacaccgctgcactccagcctaggtgacagagtgagaccttatctctaaaaaataaaagataaaatattgcttagaatttctataaacaagctacacaaaagcactgtaaacaggctccttagaaagttcagtcacttttttgctgttatcctgttgtgcacccaagtgcttctcaaggaatgtcttttttgcaaagtgctgcagtccatttggctgcttcttgagaggagagtcgtggaccccctgaggcctagttcttaaacatctcttcttagtccccattgcattagttgtttcagaacaggtcattgagcatttcgcctttgcattttggtggttcagagagtaagaaactctttctccggctgaccaaaaaaccacctctccctacgcctcgtgtatagattgggctgtacaactggtgagaatagtaacatcaccatccctgttgctataaatcactgctggtgatatagctccttgatccaaagggtacttcgggggatgtagggccagataggtacattcaaactcagactatttacctttgtcacctggtaatatttacagatggagcagatgccagtatgttccattgccctattctggagtagtgattctcattttatgttatcagagcctagcttatgaaatttgaaatgcacttttgcctcctttgcactgttaccactgcatcagagcattttaatcagcttgctttcgttgaagtgtacaatttttcttctcattacgtctgcaagctctcaagtttacagacatgatctccttggctagactaatattacttggccattcttgcatgcaaatttaaaatttaatatcttgctgcaggtctgttgagttttatgcaaattccaatatagattatattttggagctgtaaattagaaattacatttgggggaagtaatatttgtgtgggtttaaaaaaagtaatcttgcagtttgtatggtacatggcatttcttctgaagaaacgggattttgagtattctgtgtgggtttagtagatgtcttgccaattgtgttactgataatgaaaatacaaaaacaatgccagtatgtacattaaatttttttccttaggagacaaagtctcactcttttgcccaggctgaaatgcaggagcacgatcatagctcactgcagccttgagctcctgggctcaagtgatcctcctgcctcaacttcttgagtggctgaaactacaggcgtgcctcgctaattaaaagaatttttttttttttaatttagagacacggtctccctatgttaccaaggctgatcttgaaatcctggcctcaagcaatcctcctgccctagcctcccaaagtactgggattatagggcatgaatcactgtgcctggcctacatcaacattttttatgacatttggctgctttttctaagttatttgggattaactgtgttctctcatttattaattcattgagtatatggttatggatgcttgataggctctcctcttggctttgatgatacagcaacaaacaaaacaggctctgtgctcatgaaacttaccttctacttgggagaaacagacttcaagcaaataaacaccaagtaaatatttggtatctctgatggtgatacattctgtggagggaaataattcagggtgtaggaataaaggtgtgctgagatggaggtgctagtcatcaggaaagacctctctaaggttacctttatgcaaagacttgaagagggaatggaatgagctgcgcaactcttcttaggagaacattagtctgggtggagacactgcaaggtacaagtgtcctaagtgggtgctcttgccgtgtttgaggagtagcaaggacgtcagcctgactagagcagagagggaggtagaaatagggcagaggaggggtagcagatgatggagaggtgtcacaggtcatataggaccttgtaggtactataaggactttggcctgtgctctgaatgaggtggggcactgtgggcgagggctgtattaggtaagaagactctgaccattgtgttgagaatggagtttgtggggggaaactcagatctttggatgatgggcatgggacaccatcatcagccattgcaggtgtggaccttggatgctgcctgcctaaggctggtgaccaaaaagaaggtagagttggatacaagagcctggcattgttggcatttttgtgtttgagtgtcggaaagatcgtggcagaagcctaagtatctgtgttgcttgggcctagcatctgtgttttcacaaatcccccaggtgatttgatgcctctttaaaacacagaatgttgggccctacccaaagggtttctgattcaggaggtttagggcagggcccaagaatttgcattatttacaaatgtcaaggcgatgccagccagtgctgctggtcagggaccacgctttgagaaccactgctctggtgaatgggtattgctgtgttgttatctgcaaagttacctttgtgtacttctgctttacaaaataggatgtagcttgaactctgagtcaaactgccatttactgtggtatgaccttggatatggcatatacagtgattcctcacacatggtgttaataagttcttagtaaatgctggctatttgaatatggtatgtaggtataaaatgatgtggtggaggtaaaatatgaataatttgctgaatataagctctggactgtggacattataaacaagatcttgttttgttttcagcatgacatgaaaggttcattagctttgttttacacatagggaagtggcttattcatgatcacgcaactagaagtagcaacggtagatttcaaattcagttctttctggcttcaaagcctgagatttgccaccaccgcatgagctgcttggagtactggattggctctcccacagtttttgtcattgtgtgtgtgtatgtgtgtgtgtgtatatgtatgtgtgtgacagacagagagaaggagaggggtgtgtgtgtgtgtgtgtgtgtgtgtgtgtgtatgagagagagagagaaagtgtgccagaaattatttgcgtacgttttaaaatctctgttaggccattttttaaatctgtaaaatgggcatgaagcatgcagagttcatagggtttctttgctgagtagaatatgggatggcttagcattgtattttttttccttttctaattaaaaaaatttcaaagccaaatcgaatctagatagaataaatttatggattttttctttagggttccttattagaatggattcttcctaatatgaaacttgagttattgaattttgtgtggagaggatgcttctcattagggtctcagtttgggaagaagagattatgttccctttaaaaacagcttactgtgtttgcaattttagatttcttatctcaggaagttcacatactgttaggataaaactttcctagataaggcatctgtacaaaggaatgaagtatatgggaaactgcgtgtgtggggagaccatatctttaatttttgaaagggctagggtagcctggtggtttggaaaaattaaaagtattgcataaaagtcaaatgtaatagcaattattgttagtgttgtaaacttccacttatccacaaatcagatgggtggcagtctctttatcttaagttctggttataaaattgaaaaagccattgattaacaaatagctgtcacaaagctggaactttcatagtaacagtttctggtgaagcttcccttgatccctgactcaatcagctaggtagagataaaagagaaattttgtattctgaagatgtacagacaattataaggaactctggttgactgcagggggaagagacacaatagctattaaaataaaagtatgacagttgggctaaacaggcagcctcaaacatcctaggagtccctgagggcaacactgtatgtagtgactcaggttcttagaggaaagtgggtcatcaacaagaagcatacaggcttgtttttggtatctttataagaatagagggaaataatgagtgtgtcagagagctcttgtcaagtttagtttcaataaaacaatttgcttaggggtaagtttatttgggaaaataaatcactgataacagcataaatactgtgttcctcagtgatgagattagatgagtagggaggtagtggggtgaggtagaaggagcatggacttggacacagatacttgattagaagcagaatcaccttagatatctctgcgccccagcttctctgtctataaattgggaataatacctgaagaggtcattgtcaggattgaatgagatgatgtaagcagtgcaccttgcccagggcttaataaatagtgatgagactggtagatttctctgtgagggggcttcaggatatacctcccttatacagacttctattcctttgagtccaccgccccccacaacatctttatgaactgtaatgtatctcatactgtacaagtcacccatttaaagtgtacacttcagtggcttttagatttacagagttgtgcaaccactaccacagtcagttttagaaaatgttcatctcctcgaaaagaaatctgtaccctttagttatcattactttattccctcatcctcttcctcatcagatgttgtaggcaccacctttcttcccttccttcccttatcttcttttcagctgtggactgtgctgatttgcctgttgctggatcatgtgattgaaattctttgaatttttctgtaaatagccaatttagctttttcccttccagagtatttgtttctttgggtgtggaagcagctgctgcagccagtgcaagggctcaccattttgcgctttgcggctgttcatatggcaactttattcaaaaccgctcctgcactgcttaagttatttgttttatacaaaaacagttctcgctggcttgcggcttctctgctgccatgttgacaaatgttgcttctagtgaaatacacaaaaataaataacagcaagggagaggggagcacagagctaagtgaattcattttgcctcttgagtgccattctcatttgttttaaaaaccaccctggcacagacagaaaaggagaaggcagagaaccgcaggaaaagaaaaggccacatttgattctttgaattgggctgtaggggctggctgaacagacaacttgagaagtatctggaatgtaggccctggggatgaggaaaagtttacaaggaatctgaataacctgcagatattcatattgcaacagcccccatttacatagtcttcagagttcatttggtatgttctcttgttttctcgttctgttgatgacgagactcaaatttaagcactgctggtgtagtagtacatgaccatggttggtttctgtcagtgtggtaggttgtgtattaggaactggaaaaaggcaaaagcgtaagggtgtgtgggttctcaagtttcgatttgaaggtctgacccacatgagaaggtggagggaatgctgacaaatattgattgcctttctgagccaagtatttccacaaatactatgttattagtattattattatattaagatatattagtattatactattatattagtatatattagtattattagtagtattatattagtatattagtattattatttgtatataacaaatactatgttagtagtagtagtagtagtagtagtagtagcagtagtagtagtagttttcagagagagggtctcccaggctggagtgcagtggtgagatcataactcactgtagcctcaaactcttgggcttaagtgatcctcctcacttagcctcccaagtagctagacccacaggcatgagccaccatactcagctaatttttagattttttgtaaagatctgggccttacaaagtgctgggtttataggcatgagccaccaggcctgacttcagaaacattgtttcattggttagcatgacaaaggttggtggtcttagcttcatttcacagactagggaggacagagttttgaggaattgtggtacttacttgccaaaggtcttactgaaattaggggagtggaatgaaatggaaaccccgtgcttccagacctagaacttgttccttttctatattagtagtaagccatcagaggtatggaagaagaaaaggagaagggcattggaaaataaggagggataacagcaagcagtagaggccaaaaacattttgtttagaaaaattgtacatcttctttgaaggtttttgttcattaaaaatcaccaggaaaacgaaagtgacttgcaagtccacaagaaactttgttttgggtgtgtgagttaagaatgatcacctgaccaattattattgactagaaaaacatttccctgagcctttcataaattatcttaatgtgcatattgttgaggcagtgtctgataaataacagcctaattggccacccagggtctgagaggtttgcttagccacaactagcctttcattctgggtctggcagattgatttctttccatttgttgcatgattttcaatgctatttatgacctaaatattctgttcaaaatattttttttttggtctattgctaatagtagatgcctctagggagaagaggagagaagcaagagtgaggtgacagggacttacttttccttatattctccttggtactttttgaattttgttccgtgtactattccatatgatggaaaggaggtaagtgtatttaggcaggtggaaggtaagaagggtagatgaaaggatgaattattgacctgaacttcaggcctttattcatcagtggtttagcctgtgggattgtttctcagcatataaacttcttcagttatgtagacatataatagttacttgttcgatttattgcatctgcaaaggtatggccaggtgtcatcatgaggaagtatagtagtatagtgtttaggcttaaaagattctgaaacctagacttcctgggttgtaatcctttctctaccacttagtggctgaacgtgaccttggatcttactttatctagcatttttgtgtctcggatagcttgtagttaaaatagtagttataacaaaacttgtggaattggaaggattacatatattacttaatccacatgaagttcttataatagtgcccaatacacagtactcactaaaagttaaatttttttttgatgactattatcacagatggtgatttgcctcatccatctctctgtcccttaatgtggtccaaaatccaccccccgccccacacccggccttaatgcccagacagtgcccctgtactgactaaggagcctttcttttgagttcactggtctggcactggctcctagaagtgctgttttccagtgacagcaggatatttggaccactgggagagtcagtgggctggggtgggcccttgctctctgcagaggtgttctttctcccagtgggaggaaacaccacttgtcagaacacagctttggcttgcccaggttcctgttgtgcagatggggcctagagtctctctgggccccttgtcatggatccaagccaaggctgtcgcttgctgagccaggaataatataggaattagtctttttcttctttatactaagcactaatcaatctacagttaactctgtatctaatttctgaaccagatgccgtgaataactgcccctgaatgtgtttttgccaataaaaggataagtttaaggcttttaatcaatgccgcttgcactcagtatttaaggtcagaatcttgtgtgcgacttattttgatcaggataattgttgggttaaaaaatgaacggtttttgaaattgtgacactcgcggttgactcgtgggtgaattaatctttgagaggatggaaaattgtcgagttcataagagttctcttgctctctagttgtctttcaggtcacttatggaaaaatatgacttttaggaggaaggcattctttttcaatgggaaaggagataagagactaatagaaatttctaaggagtcagtgatggaggctcaggggaaattggaaatgaagctgggtgttttggatctgcggtgagctgagggactggaacagcagctgtgtatgttctaggtaatattaacttgttgtaattttatgtctccagcatacctttttcaaaggaactcatgtttcctgaccaacgactgtgtactgtctagaatgaagcatagtgtttagaaacatctggggtttagatattggcttcactgaatggcctagggcaagtcactgagcctctgtgccctcagtttttataattataaaatgggatggtaatagctacctcgcagttggaaaacttaaatgtgatcatgtatgtgagaatgtgaagtgcagtgcctggcacacaagaggtgctgaaaggagcatctccttttacttctttgtggagtttgtttggctggtctgctggtctgtcatacatttgtctggtgtgcctctagatacacgtaatgtggaaatttccctaccttgtaacagtgagttggaaattgttcctgttgatctgtttttttttttcttttgtgcttagggaaaggcatgagaaaaatgagtcaggatgccctccatttctggagaagcttggtggtaattctgttccccagtggctcacaagcctgggcagttcagagaatatgagaattggtagatcatggagaactaggctctgcccctttggctatgcgggagttacttagtcttcctgaagtttcctgtccatgaaaaggggatgtgtgagggtgcaatatgggtaatgtttgtgaacaacctttgttagtgtcaggaaagtccaaaactatgtggtgtggtattttcatcatcttgagttgacaacagtgcttatccaaaagtcaattttggtattttgtcaaatgttaaaggctcaggaaataacttccaactcaaggaagatttgtatccactctggagctggaggagcttatattaagaatgtaagatacttgggctcccaggatttctggaagagctggcagtctccctgaggttcaggttctcagaccagcaggccatgcatgggggcttgtgattaagctggtgccgaacattgctgaattatataggtctttctgtgctacaggttggttttctgctgttcacatgtagtctaacagtggcctgttttcctttgcctcaactgtgacatcccctcgaagtgacctttatgaaggcagagcttggatctgccttgcttcttgctgcctactgtgtggttttgtgcagagtgctcctttccctcctctggtgtcttcacaggtgactcaactggaagaggaggttaaagaaggtcgggttaccaagcacctctcttcatgcctcagccaatccaggccccaacactgtgtgggaagaggtgttcatctgttgagaaggggtggggacaacatatgttacatacagaggctccaaggtggttttgatgagcatagagtatagtgggagaaggagcaaaggatggtttgggaggtaggaagtaaaagtttcagctagagctgactgtcaaaggccttttctgtctttagacttttactctgtaagatacagggatttgtatgtgaggcttttgactttaactctgttggaatagggatttgttgcaggctgttaagtagggaggatggtatgagagatgcattttcaggggtttcatttgctcatggcatggtagaagatgaagggtggatggtgagtagagtagaaataggaacacagaagactgctgcagtatttcagatggggattgtgtggggcctatttaggtcatctccagtgcaggtgcccaggagaagttacagtagatactgttgtacttgtaaaggaaaatgacattcgagttcctgttttgtgccaggaactttaagtaatctgcatatcttagctcatctcattctcaaaacagcaacaagcggaaggtgttatttctcaccgtttttcaaataaagaaacttaggtttagagcataagtaatttgtttgccatccctggacagctcctaaattgcagggttgaggttaatacctgattacatccaactccaagtcctttctgttcgcattacaccacactgtggccctcaggacacagcctcatgtagtgattttgcattagcaaataactttgtaaggactagtctgttaatagtgatctctttcaacattcccatgagatgagggagcacaattaattgttcagctgagggattagagatataaggaggttaagtgacttgacgaggtcacccatcaagtggtttggggcggacaggcagaggtgagtgaggcttggagctggccattttgagacagtggccttatcgagaacaagaattttccagcctcattttataaatccaggcttctagttctatagactagggaaactatcatggaaatggtatgcaaggcaagtgcctgaggctgagatggcacaaagcaccgtggtatcttggggttactttataatcaaactctctcttctagcatagtctttaattaaaacaacaatcatctccaccaaaaactaatcatctttattaagcatacagattggaggaagagtggggagtcttgtgtctgagaaagatctcaccaataaattgtttcctttgccataataattgtgttgctgagtttaataattagaattctcactctacgcttcctttttctgtttgattttacgggtctgacatcgctgttgtttttcctgggaatacttgaggtgtcacaaagagcaacattatgatgagagccatgggaaacacttgctaattacagtatattgtgcccctgttccttatctatcagtctctattggttattattactcatttaatttttatttttgagagatgaatgcacagggcagaataggtcctgagaatgaatctagagctttgcctttgacttggatggacactttgggcatgtacgggtcaagaaatagatgattgggtatcttgtggtaggagctagaggaactattaatacatttgggagtggggagtgaaggccatggactgaaaagatgccgaactacaaacctgaatgattttatagtttgctaatggttatccctggatgccatgcaccatcatgatttaactgagccttgcaaacagggacgatacttttcctaaccccctgccatctactgctttctcaccagaggtcacagggcaaagacaagtaacactggcattgtgcatgtgtgacaggtaactgtaggtagtaaagtggccacctgtaccattgcaaccctgtgtaatagtctagtgaagtgatctgctttctgcagtcaggatgccaaatacggtggagaaggaagtgacagtcatttacagtgtcatgtttagtcttttgcagatgtgcttacagttttaacaaaggcggagaagaaattatagggtgggaaagaaatgcctacagacaggctgctaaagcctaagaaggaggaaactagtatttgtgtgttttaggaatgctaagcccttgcttacatatcagcaagcaaaatattggcattcacttctgacttgaggaaggcatctctgaagtcaatagaaggaaatgcctaaacacaggcctcactcagaaagaaaggagagctgtggaaatactcaggattatctcataaaagctctttgtgtatttgaagcctctaatgaaatcagccttgttctccaggccagacaactccagttgttcttacctttctttattgtatcttttttttttcatttcttttatgcttttgtcatctcttgaaatttcttttctttgaataataccaataaaaattgaactttttgcctgaatgcagggatgacttgctagtaactaccagtttttatcagaaagcagagtgggatgctcagtgatgttgttgatggtgaggatgtccaaatcttctttttatatgctagctccattgtctgctgcatttacctgtttgtagcgttggtgcgtggaacattggggcatataaatgtttattgaattagtgaatgaagatatactgaattttttccttaaaaagtcagtatttgctttgggtcaataaagaaaccctttattttgctttttcttcataaacaccaaaatcctaggaaatattggttttactttgccacagcactctgcagcttgtacagacttttccagagatgaaaaattctttctcacttctgtattagtccttcgctttatcctctgattcctccttccttccttcccttttctgccttcctctcacccattcatgtattcattaattcagtaaatgcttcttcaacctctgctataagcactattttaagttctagggatattgttataagccaaataatgtctctgctttcatgaagcttatatttgggtggtgggtcaaggaacatgattgatcagaagaagttagatttccctgttgggacaaggctttcagagaagtaagtggttgtataggtagtagagataaaaggattgctccctgtgagggacttgctggcaggataggctgtgatttcactttattttctatttacataacaatctgaatcccaatatagtgtttaacctgatatgtaagattctgtttgggcagggttttgtcagttatcatttatatctcctttcttgaaattagatcagattcctttgatttatttggagagaaaaatgggcaatacacaatgtgtttctgctgaatattttgctatgatgttgacacagtaatgtacactttattttgattttagtgtgttttatttaaacattccattattcagaaattgttaccccctccttgttattactgtttgcctgcagttatttagaaagcagtttaattaatgttcttttaccgccccctgcttcagtatgagtttcaacacttttaatacaaagtgttcatatcactgtatgaacttactaaaacccaggacagtgatattcattcattcattgctttatccagcaaatgtgcaatacaaaaaaagatacatgcttcctctctacacatttcagtctaatatgaactgtttggttgaaatacagaaacataacatgcaattctctgggataaacgtttcactaaataaacagcagtgagaattctgaagatacacttaactaggtcagcctaggcttatcagagaaggcttcacagcataggcgatctttgatctggttcttgaagggtaaggatgtgttttccccccagggaccagttgagaaatagctagaattaattagttctgctgtaatcattgaggtgctgatcctagagtgtggcttccactgcagtactggatgtggggatgatgatctcattgcaaacacagcctgggtgggtgtttttggttttgttttaaggattctgaagcagcatatacacaaggttgacctcaggacctctttagttggttgctgctgctgttcacaatagatttagattggatagggcttcagttttcttactgttgcattccagcattttggatcagtcactttattacatcatttactttctggcttaggcttagttgttattaagtgaatcagggataaaccttaggctactctcctgcttcctttttcaaatgatccggagtaaataaaacaactacatctctttcgtcactgtgtttcgttcccatctcagaacgggtaaaatggccaatattttcagtgaaaatgtattgaaatgcatttcactgaaagaaatgttcacattcagtgaaatgtatctaaactctaaaaagagtctagaaaagctcattgacacatttgttacttgctgaaagccccagtgaattttccaacctccgtattgtccttaaaaattgccttttagttcttaaggtggtggaggtgtgtttttttcttcccccttaaaccctcttctgagcaatctttgcagagacacctggtgagagagtaggcccttctgctttgtgtgccctctagtaagagatgatcatcagcagctttatatcctaatgtagaaaatgtgctgtgctagatcatttcaacccagcaactcacctcttcatgcctaatgcctggagctagggccttgtttctctctacattagacaaaaaataaataaataaatgtgggtgaggataataataattatgatggcaggaacacttattgagtaagcaagtgtttgcttatttaatctacctgacaaccctaccagatgtaggtactgttattttctccatttggtggataagaaaactgagtcacagagagactcggtaatttgcccaaggtcagacagctgtctgcccggggaacctatacacttaattgctctgctgtactgtggttgagtatctcttatccgaattgcttgggaccagaagtggttcaggtttttgattttttttttccgagtttgaaacatctgtatctacataatgggatatcttggtggtgggacttaagtctaaacacaaaattcatttatgcctcatacacgtagctggaaggtaattttataaaatacctttaatgattttgtgtgtgaaacaaagttttgactgtgttttgactgcagctgctcatgtgagtccagtgtagaatttttcacttgtggtatcataaaagtttcagattttggagcatttcagacttcagattttcggattagggttgtgcaacctgtacttcatgagccaattgagaaaaatgccttcataatttctttctagggcctcaaacgcctggacgtcacccctgactattgcatgttgtgcattggacagttagatctcctcagtgcctgtgaacaagtgttcttttgagtgatactcttctttttgtgactgtattatataatatagctttcatagcccccactttatttgctgttattttattcccctctcatccccgcccccccccccccccccccatataaaggactcatttcaaagatgggcgaacctggaagctgaacctgactctactcttcatgtcttcaatttactggccataaaggttcagttttgtatgggatcttctgtcctctagaagatcccgtacaaatagaggctttaatttatgcttgcattcttgcattttgtgtgatttattgcctaataaatgaaagaaaaaagtttatttagatagtaaactgaaaatgaaaaaccatttttttccacgaacttgctaattttcttccattgtatagtatgaactcaatctacaaagatctggcaaaaaaaacaagtatcatgttctgtaacaaactcagttacactaacaccagaacttactgagtttaattggagataattaaaaaaaaaaagttctttttttctttttttttttttttttaaatagagatagggttttccatgttgacctggccgatctcaaactcctggcctcaagcgatcctcccatctcagcctcccaatgtgctaggattgcaggtgtgagtcatcgcacctggcctcttaatgtagatgattttttaaaatgaagatttttttcatagtaagaaaagggaaaccataattccagaccacagagaaggacttctttaatatatttaacctctttatttacagatcacttctttctagagagactaaaattagggcagagaaacctaaatcctacatacaaagagctgctgcccattcaaaataattacaagtgtgtcgggcgcggtggctcacgcctgtaatcctagcactttgggaggccaaggcagtggatcatgaggtcaggagtttgagaccagcctgaccaacatggtgaaaccccgtctctactaaaaatacaaaaattagctgggcgtggtggcacaagtctgtaatcccagctactcaggaggctgaggcaggagaatgcttgaacttgggaggtggaggttgcagtgagccgagatcgtgccactgcactccagcctgggcaagagagcaagactccgtctcaaaaaataataataataattataagtgacagtaaagcatctccccacataatcctgtatatcagtaagaaaatatgttttgagattcacaaaactcaatttacgaatctctggttgtagttatttgacttaatatataagacacttaccagaggagatggttgcaaacagatttgatgacaggtaaatttttctaaaggtctgctaacttcttattcagtcatggccaaccactgatacaatgctgagagttgctttctcctttcccctctactagcttggggtccacagaccaaaaaaatctataacttgcaaggctaataaatgcatgcttcagctgcctggaaatgctgttggactggcaatttgctgccccgctctaatagagactgcctcagatctggtctttaacctggattagctggataaagagaatcctctgggatcctgtgtgccatcacctgttagtgtgtttgctgtataaatgtaacatccactaactttgtcagatgatgtctggcctggctgctgtggctgtgattggaattgaaacatacagcttgttattaaggtagtgactggctgtgggggacaccgacgtctgttgtttttcattgttgatctagtgagttagaatgcctttcctgggctgttaatgttaaatagttcagtcctgttagtcgttttgtgagatcatctttctgtgtgatttgtgtgtatttccttgatctagtggggtgcagggtcagggactgaggggaaggtataattgtttacagaaaatgtgacaggacatggatttgaaatcagataggaagttaaggaatgccgggctcctctgaatattaaggaaaatctttaagcccctaattaacttcagaaaatccccttgctctcacagatgggaatttggctgggtaagctaataactggaatgaaggctaggagttgtgggttaagtttctccctggcaaataccaatatttcaggattacttcgactcttgtcctgctgcctcccactggatctttacaaactctgtgcagtagagattatcttgataaagattttggatgcatgttgggcctttattgaatgatgaatgctgttttttattcatttgcacatttattgggtacctactatatgtcagcctctgttcttggtcttgtatggtggtatacaagagaaacaaaattcttagccttatggaatttatatcctagtggactataaattacaatgttcactatttgagaggacccaagcttcagatgttgtggctgtttggcacactggtccgggttgaaagaagagactgggattcaagttgtagttcctgtcctgatttctctgggcctgagtttaactaccggtaacataatgacattgggctgtatctaattatttatagggttctttccagttctttcacttatgatcctgattttcccaaacattttagccaagttgtctttttttttttttttttttttttttttttttgagatggggtatcacccagtcacccaggttggagtgcaatggcactatctcggttcactgcagcctctgcctccctggctccagtgatccttccacctcagcctcccaggtagctgggaccacaggtatgtgccaccacgcctggctaatttttttgtgtttttgatagagatggggttttgccatgttgcccaagctggtctcaaacttctaagctcaagccatctgcccgcttcggcctcccaaagtgctgggatttcaggtgcgagccattatgcctaaacagcccagttgtctttaatctagttgggcttctggctaattcgtgttggtgaccaatgtttgcatattaaatcaaacaatcagttattgtactggagaagaaaataattgtttctaaaaagttcatatttcgactacatggtcatgccatttaaaaaaaagtagtaaagcaacaataaggaaatactcttttattctggaatgacatacctacctgaaatctttgagtttcccttgtgtcatgtgagctggttgattacaggtgaggagaattgcatgttcttacatgctcctcagaaacactcatcactgtgtaaaaaatgcttttttgtttgtgtgaaatcataatatagagcccattccaccatacaccttcatcatcaagctcggggatacaagcctgttaatcaagtgggaatacaggaagtgagacatgaaacactggttttattttcacacctctaaatgagtgactgcagaggatgaacttaaaaataataatgccacctcatacttgcatcacaccttttaataaggcggtttaaaaatatttagggtgaaccttcatcaggatgctttaattgcctcagcatagttgaatagtacattagggtaatgcctctgctgtgctgaaaagcctggagggagatactgtcactcaatgatgcgttgaggatgattaggtagaaccccttcagatcttgggatctcagtttcctctcaaatgcatgctgtgggtagagaagcctgggctggtgtgtgtataatttacatctgttataagtgactaaacttgtaagaacgggtacacaaggcatctttagtaagaagtaataatatctgccttagtaataatatcttctcattcttgtaggtccatttgaaatggctccatctctagtacatctttcctgactactcccacctggccatcatatcatctttctccattagatttcaggcagactagaccgagactgtgggtttttatcctgttagccacttagaggctgtttgatcttgggaagattacttgcttttctgtacaaagtatctttatttctgcatctgtaaagtgaagataagaatccctacttcatagggtgttagtgatatgagttagtaaacatgatgcccttagaacagtgcttggcatgtgctgctgtggttttgtcatcattattactccacttcttccttggtacatagctcatgttctccttaactatacggatgtatttagcgatctgccttaaattgtgatgtgttccttctggtctgagagcccttgtcacacataacatgataactttgacttggtaggtacctagtgagcatcttggattgagctcctacaggatttagttaagaattcaaagcagggtgtattctcattctgacttttaaagcctttgaggtcagttgggggcaggtcttatttgtttcttaactggtgaagctgccataccaaggccacttgcccatgatcgtctactgggtagcctgataagaaggtcagttactcaaggctgtggactcgattccattcttgctgatattactagcgtaaatgagatgcttttggataattctctgagcaatttaggccaggtgaatactggacagtaatttcctgaagtgccatgaagtggcaggaacatgatttatgtaacatgggctcttgctagctgggatgaacactggagcccctgccgtgctctggaattatgagtgcctgccagagtgcctgcctgcttttgttctagagagtttttttttttttctttttcctttaagttaaattctcaagttgcgggcaggggcgcaggtctctatggtgatgaatggagagatgttgaactggctggttgcaaaccttaccctagcagttcttagagacaactgggataaggacattttagctggttgacacttgggttgaaagtactgatgtaaaaaaaaaaagtgatgtgtgtatggggagggacatatacaaagaagtagtaccttggcattctagccagataaaggagatctgtgttttttaaggtaggagctttgagaaaaatgcaaaacttgtatatttcagcatgcagaaaattgcacttcactatcaggcaaacctcattcatattagcaagagaagtatatgagaagcatgtggttgtgggatgccattatcaggaagttgctgtgttcttgaccttgggctctggaagaacaattagccccttgcatgcaaacttgctcagtaaagaaaaagttttggccctaaggcctgtggaaccaggcttaggatggatgatgggtttattgtccttcacagccaaaacacaacagtctttctccctttctttccaggctacccacgtgagtacgttgataatatttctgagagttttaaagaattttccagcagaatgagagaagatagaaggaccatcttgataatttaaggacatgctcttatctcttgatctgctgcattttgtttttgcttctgtttaggccagtgttggtagttatattgtcttctctccactgggcggattacatgtagcaatccaaaattgtcaacataattattccacttcttctttggcacatagctcatgttctacttaactgtactaaattgtgatgggttccttctggtcaagagcccttatcacacctaacaggacacattggacatggtaggtacctagtgagcatcttggattgagttcctccagaatgttgttaagaattcaaagcgggtgtattctcattctgacttttaaagcctttgaggtcagatgggggcaggtctcatttgttttggattacatgtatgcaatccaaaagagttaggttttttaaaaaaattaattacccccaccccttttgttaaagagtcagggtctcactgtgttgcccaggttggtcttaaactcctggcctcaagtggtcctcctgccttgacctcccaaaatgttgggatcacaggcgtgagccactgcgttcagtctaatttttatttaaaatttaaaatttaaaatttgtggtatagtccgggcacggtggctcatgcctgtaatcctagcattttgggagtccgaagcgggaggattgcttgagctcaggagtttgagaccagcctgggcaacatggcaaaaccccatgtctacaaaaaatacaaagaaaaaaaattatctgggcatggtggcacgtgcctgtagtcccaggtactttcggggctgaggcaggaggatcgcttgagcccaggaggacaaggctgcagtgaggtgagatcatgccactgcattccagcctggctggcaaagtgagaccctgtctcaaaaaaagaattaaaatttgtggtacaatataaataacataaaatttaccatgtacagttcaacagtgttaactatatttacatcattgtgcaaccaatctccagaactctccgtcttgcaaaactgaaactgtctaccattaaataacaaccgcccattctctgttcttcttagcttcctggaaaccaccattctggtttttatctctatgaatttgattactctaagtatctcatataactggaatcatatagtgtttgtctttttgtgactagtttattttacttaacataccctcaaggttcattcatgttgtagtatgtatgtatcagtatgttcttcctttttaaggctaatattccattgtatgtgtataccacattttgcttattcattcattcctcagtctacatttgggttgcttccactcttggctgttacaaataatgctgccataaacatgggtgtgcaaatatgttcttgagaaccccctttaaattattttgaatatatacccaaagtggaattactggatcatatggtaattctatttttatttttttgagaaactaccgtactgttttccataagcagctagatttttaagaagtacatttaaattcatcgttttgggccttggtctccacgctgccttgagttgtccctaggtaagtgaagttctcagtcagtcacctgctctggcatacctctgagctttgacacacctcagccactttccatggctcactttggccctttgtaggttggtgcctctcattagattcaacgaacaatttctcaggatctgggcctaaccagtggtgttgaatcttagaaagactgagctgaaatgctcatcagctggtgccatgcttctcactttaggttatacctccagttgtgtttggataagagttggagtggcatgacagtctcccacagaatctgaaaatatagttccagatgtgcttctcccaaacttcttctctgccattggggttgcaccactggaaaagtgtgtgaagcaatacttcactctgacaccctgctactatatgcttgaggaagaactgaagactgtatcatggaatgagctgcccataggtcgcgcatgtgcgcacgtttgtacgtgtgtgtgttgagatgggagagggaatctagggatccttctatactccattgattatgctaacatggatcttatttaatattacaaggacatttctttgtcatcgtctttttttttttttgagacagagtcttgctctgtcacccaggctggagtgcagtggcgtgatcatggctcactgcagcctcgacctgctaggctcaagtgatcctcccacctcagcctctcaagtagggactataggcacacacaaccatgcctggctaatttttctattttttgtagggacaaggtttcaccatgttgcccaggctggactcaaactactgagctcaagtgatccacctgccttggccccatcaaagtgctaagattatagagacgtgagccaccagcctaaaaagacatttctaattagaaagtgtagtgtgaacttttgccgtagttggacttctctccatgtgggcccttaaacactgatatctcagtcatatgaagctatcaaggaccaaaataagggggcatttgccttttctgtcagtgcagaaccaataggggccaggccaggtatgaccaacccattgtatgtgcagtggcttgctccatctttctgtctctggtttatgtatgtgatcatttgcggattccagcaggtacatcctctccaataccttacctggtaagctgtctagtaaggtttatatttcagaccattgggggatccccctcttcatggcacacactgtgcctgttgcctaatattcctttattgtctgcagcatccaggaccaatttaaatgtcactttgtgaaacttcctcagaccctcctctagagcaagttagtcactgcctcttctgtgccttgctttgaggttattgtcatcactgaacctgacccagtgtattgtaattacttcagacggtctctcccaccagagtttatcctcctctgtgcaagtgctattttttagtcctatctgtctaccttagaaccttctgcagtatttggtgtattgttctgtctgtggcaattgtctggtaaatgttttatcagacaagtctctgatgcaatgggatggagtggaattaatagttttaatcatgaccatggcccgaaatagccgtttgacaacatccaagccactcactctctcagactctcacgctgggttgtgtaaattgaattctttcaaatgagcataagttaaaaaatacttagcacttaccatgtgctaggtactttgtaattaagcattttacttacataaactcatttaattttacaataacctagtggagtacatttcagtttcatagatagtgaaaaagacacacagaacggaggttacctgctcagttcaaaccctggagtgtagcctgtgagtgtatatttctttttgcatgtggttaataaattaatgttgtatttacagctttgcagagctgggatgcccttaacacatgcagctctggacctatataagctgtcaggtgtagaagagtgagcaggaaaaccttgtgggggtaactgattccttgtacaaaagaaccagatttcagttagtgatgaaaatggaggaagtgaagaatccaagtcgaatgatagaaaaggttatgtgtcgttgggcaagggttcaaaagacctagttgtcttgattagagaggaggggagctgagggaaaatgagtcacagaggaggaaataatgaagatgaagtggccagagaagacgggctcctgcaaggaggggcctgggttttagatagcctccaagaaggacaggaagtgtggcctgatgggattagctagtctcaagacaccaggtagaatgcaggccatctttgtagactgggccttggggtgtccaaaccatgaaatgcatggcagagtgtggacacacttgtttgtttatactctttctcccatcctgtacaatgaggcagaacatgaaggaaaaattaacaaacaccccaagtctcctgacacagggatcaaaacatattgatgatgtcttgcaaatctgataatttcattgaaccatgtgaagcttaaaattgatacataggcatacccttaacattaagtgctgctgtcagtctgacatagctggataaaccaatgttgaataatctattaaatatgtcagacttgaacaaagaacgtaaatcatattatattatttcagctgtaattaggtgggagataaaatcacaaatagatgagtttagtgaatatttcttagtgtgtacacagtgtcactggaatttctttccttgctctatgggaagaaagaaattgactgccttccaagtattgactgctgtccaggaagtgggaggttgaagggtgacttatgtaatgttcacagagtgggtttcatttataaattcaatgagattagctacaatcttcctgaagttaatggtgatggaaatgcaccattctgcatttagctggaaatagctagctatccaacttggagacttaattgttcctcagattatgatatgtttgcatttatatctccctcccctcctttcctgggagctggctgctgcctttattgtctagaaattaataatgcagaccagagcttgtgggtgaacagggcgatgtattgccagtcttttgatgttcctgtttcccaacccacggagtaaacttgattattgagaataaacaagggacataaactaaggtggaaaagataaagaaattgcattaggagggtccagtgaactgagctgtagctaagaaatggagataattctagtcattacttcacggggttgttgtgaagggtgaaatatatgttaaaccttcagaacagtgcctgccatgtagcaagtgtttcagtatatatcaggttgctttcattgttataagaaaactaattggcatttgtggtggatggtcagggtggtgtgaatgtgaaattcaagagcataaacatggttgtttcctcccagatggttggtatagtgaaacagacagttaagggtaaggaagtgtaggccctcattggggctacacatcacagcatgctattaatataagcagtgtatactggtcatcttttattgagaggctatggcttttttgtgtgtgtgctggtggtttttaaaatattagtttgattcatttcaggtgattttgttaatctagcaaaacatcttcttgcactttttacattataaatgaggaccatagaactttgtgtggacattgcagtcattcagcagacatttagcaaatgcgtataatgtgtgtgaatatttttttgtatgaaaggttttcgacacctgagactcactaccctcagccctgagttcacatgatgggtcggtggatttccagagaggcaggtggaggcgccgcagtgggagcatcctggctacctgagatgtgttttgaggtgccagcctcttggctccagctggagccaattggcctgttgggcatgagctacatggcatgtagagtgagctacatgacatgtagagtgagctacatggagttagaggtggttatcctacttcttctacatcacaactttgcagagcgcttcatataagacttttgtaaatttcggagatagtgtgctttatatagcaaggatttccagggacctactagaggacaacagaaggctgacatttccccctccaggccagtagcttgtctttcattactttgcataataactacttccgcttgctttttttcccccctcacctcagctgcacttaggaggacttaatgacatcatttaacgttaaggataaatataaaaccgatctgttcatgaacaccagtaaattgcacttaaaaaaaaatggtttcacataaggcagaacaggttgctacttaaaagagttaatggccagttggttttagagtagatcacaaaaagaaatgtgacttcacccgccaactccttagttaaagaaactgtgtgtttgcagtgttggagaaccatggaggaggattcagaactttaggcaggaagaactgtgaatgagtagccctgttattcccctggccactgtgcactcatggcttctgcacattactgtgtaaactcctttctcaccacctaaaacctaccaaagcacccagcgatcttcctgtatgtgaactcacaggtttttcttggataatttgcctttccattgacctactttcaagagcaattttccctatagctttagcaggtaactaaaaaggggagtggtgagaaagtaaatttggagttccaaagggaaattacttggctttgagctacttagtcaaaaacatgtattgcatgcaggtaggtcccaggcacagtgttgaacacgggggtacagaagtgaataaacattgcttctgctgtcaaggagttcacagtctagtgtggaagatctgtgtgcaagtagatggtttcagtgcagcgtggaaacctgcagcagtagaagtgacaaaaggtatgttggtagcacggaagatgcagtgctagttccgtgtggcaaagggtgaaggtgtcttagaggactccttggtcaagaagagtttggaggacaacagggagtttgcctagtagacaataaggcagattactggggcagaggaacagtggtctcttggggagattaggagctgggaatcaaatttcaagatcaggtttttttatttcggttcagtctcatacctgctgcctgtcatgtgaccttttttttttttttgagatagagtttttggtcttgttgcacaggctggagtgcaatggcgcgatctcggctcactgcaacctccacctcctgggttcaagcaattctcctgtctcagcctcccgagtagctgggattacaggcatgcaccaccacgcccaggtaatttttgtgtttttagtagagatggagtttctccatgttgatcaggctggtctcgaactcttgacctcaggtgatctgcctgcctcgccctcccaaagtgctgggagtataggcatgagccaccccacccggcccgtgacctgactttttttactgagaagaaacagaaatggggatccttatgtcttcattccttttgtttggcataggaagctggactgcatccaaaattgttaccttgtgcaatttctggataactgaagcttacacagcctgaagtgtacacaactggttaatgacagatccggttcaactcagaaattcacatttgtccagattcattcagttgccctataatcttaagtgttttttctgatgttggattcattccttctcttacttgttcaataaatgtttgccaagtatgttataaacaactgtgcagtctgatagaggtataaggtcctttctgtcagggaacttaaagtctttttgtttgtttgttttggagatagggtctcgctgtattgcccagactggagtgcagtggcacgaacattgcaaccttcatctctcagacttaagccatcctcccacttcagcctcctgagtgacttggactacaggcacataccaccatgcccagctaatttttaagtcttttttggagatggggcttccctgtgttgcccaggctggtctcaaactcttggtttcaagtgatcctcatgccttggcctcccaaagtgctgagattataggcatgagtcactgtacctggctggaatttaaggtcttaaagtggaaataactttgaaagtatagacttgtatcagattatgaggagccagactaagaagttaagacttaatgatttatacctctcagcccagagaggatgccagtgagtttctgaatttacagcctaaggcaaattctttttgatttctgtgttccttgactttatttattactgtaggataatgccttagtgtatttgaataagtttaaaaaatttatgcctaaaggtaggtttatgagctttgcattgtataaaagagtacggtatgtaagaatgaggactccaagagccaaacagccagcttttgaatcccagacctactatttatttatttgaattttttggaaggttagtgcgcagccgacctagtatttatgagctatgtgaccttgggaagttcatgtaaatgcagtgtctcttgccttacatggaaaatgtccatgaaaatcatacccacgtgaaagttattacaaggattaagtgaggctgggtgcggtagctcacacctataatcccagcactgtgggaggccaaggcaggcagatcactcaaggccgttcattcaagaccagcctggccaacgtggcgaaacacaatacatgtatctgcaaagctcaataaggcaaagcatagtaaaacagcttgcctgtgtctcatacacggtgctacaaaacctttaaactggaaatgccaagaggcacagaccaaaaaaaaaaaaaaaaaagctttaagaaaaacctttttccccaagcctttggcttggggaaagggtgggctacaacagaaaggctttttgacagtatcctccctattgctgccaaacacccagggaaaaaccacaccccatatcaccaacccctgccagtgcagctgggctgtgcagagttgatcttccacactggtccttggaagcaggcggtgcttcagttcctctgccaggtggtgtcaggagaacggagaagggtgctgatctttcattccccttgctgggcagaactagttagtactccatggcagagccaggagtatcagcggggtccagccttatgctgagcttccgtctctaccgtgtagcaaaaaaataatgtgagtcagctctcctccctggtggcagtggggctaaggggaatcccgtcgaacaccctaacttggaggaaataaaccagtgccagtcagtgcctcatattcagtggaaagttgtctgcagggccaagttgggaggcgaacttctacctcattgtctgcagcaggcaatgtgacccagtgccctgctttttccactctagtgatgatagcgccctggaggaagcagagtccacacccaccaccccatgctacatgtcaacaggggtactgcctgctaagcaaagatgtccagggctgggagcagtggctcaagcctataatcccagcactttgggaggccaggcaggaggattgcttgaggccagaagtttgagaccagcctgggcaacgtagacctccgtctcttaaaaaaaatttagctggcggtggtatgtgcctgtagtcccagctactcaggaggctgaggtaggaggatcgcttgaacccaggaaattggggctgctatgaaccatgattgtgccactgtactccagcctgggcaacagagtgagactgtctcaaaaataaaataagtaaatatcttttgatgtccgggatacagtcaaaaatctcaagaaccaggaagatcaccgcatgaatgcgaatagccagtaatggatacaagcactgagatgaatcggatgttggaattctgacaagaattttaaagcagacatcatgaaaatgcttcaataagcaagtatttatttattttaaacaacaaaaataggaaatctcagcaagaatttatgggcctaccatgagggaaatttttgaggtgatagaaatatatatcttggcattgtggcttatgcatttgtcagactcaacaaatagtgtacttagagcaggtacttttaattttctgagtaaagtatacttcagtaaagttgatttacaaatcagggattttcatccctgaagattctggttcagtaggtctaggatagagtccaataattttttttttaattaatgccccaggtggttcttgggaactcctgatatctccagaggaacctaggctagttgagaattcttcagaatattaatctgttagcaatctgtgtaaatagaaactaggtctggtaaattatgaattaaccagataactacttgcagaataaacagaatacataattagaaatcattaagtgtgttatcaccacatggaaataattttttgtattttttttattgggtagtgttgtgaagaatattacatggtatccttagaagctgtaaattgtgatgctgggttataaaaaaactgtattgtggtatgtttttgcctctctcacttaaccccacccttcactccattccttctcaggacacttatcttcttggtggctaatggcagggtggattccacatttgggaactgctgttgcctgggcagtcatggttttcatcagtgtgtcccagggcgtggtgctttctgtcaacatcctgctctccatagaggctgagaatgatccctgatgcagtcatcacggcttttaggcctctcccattggcctcactttaacctgatgactatcatatttccatctaggctgcatttttaaatcttgtcaaggaagcccagggactctcctcactgataagccatttccaatccaggcctggggttgagtcaggtcaccttatgttcttactctttcccttgacttagattggtctggctggtccacccagataaagtgtagcagtgtctgaagctggatgtgaggggtcgggaagttgttgatggggatgccttcattccgcagcacacatttcaaggcaagcagatcattttcctatagcagtactggtcagagctggattcaggggaaggctgtctgtgtttcccacgtgggccgggtgagctgctagcatttctgtcagtgctagaaggaaagtcattctttcaatgtggtcccagattcaaaatcagttttgagtgggtgtcagaatgtcattcctgatagcttctctgttttgacagtgcaaataccccggtctcatttctctgcttttaaataatagatccttgagattggccctgggtaggagacctcccccaccccacttctttctctgagttcaccatgggattctcctaatctagccagagctggatttgatccttgggtcactcctgtggtctctagccctcctcagtgcttacttagttggtctttgtttctattggttgtttttgcatgtgtcgtggttatcgtcatcatatgactaatgtcagggggtcaggcacagttatagcttctaattgtgttgcgcttttggcaagggaactatgtgtgggggaaaaatacttattaggaatcgtcagcctgcattaaagggtcgtaatacttgaacaatttgcacatgatatctatctctacatcctatatggactgtgctttctaggagggattagttaggtttttcctttcctagtatagaaccaggactagtaggggaaggcatagaggaaaatactatggttctgtttcagagagagcattcttgcaggggtttcccaaatgtaaatttttttgttttttagagatagtgtctcagtctgatactcaggttagagtacagtggtttgattacagctcactgcaaccttgaactcctgggctccggtgagcccctcgcctcagcttcccaagttagtgagactacaggtgcacgccaccacacccagctaattaaataaaaatattttgtagaaatggggtcttgctatgtttcccaggctggtcttgaactcctggcctcaagtagtccttctgcctcagcctcccaaagtgctgggattacaggcatgacccaccatgcctagtcaaaaatgtaaatattaggtcttatgttactgaaggtattccaggaatgtttggatgtggtacagaagatgtgggtattgggaaacctctaagaatatttccaaattttatcttctgttgttctttaaaaaaaatataagctgtgaatacaaccgtggaaccacaagtaatataagaggagctgatttcttggtgcctgcactgctgactaaagatccagtctggttgcttattcagtaaacctttgagttagtgcagggagtcactctctgttttctcagggagcccttatttgagtaactgtcattacctctttccctaacccactacctttaattgtccttctgtggttagaaaaacttagtgtttgaaaggcatagtatctcaagggaactttagaagtatatcttacctttgctcttgggcatttccagatgaccctggcagtgtggccacaagcaaactggagaaggctgccagtatgtgcacgttttaataaatggaggatatctagcacctcctaacccttaccttctcctccatctcatcccattttctgattgaacagtcacgttatttctagtcttaaatacttagcttttctagttgtgttaatggaattgttgtatgtatttcagttgtattacttaagtgtcttctaaaagacatttgtatactttataattcagagaaaattctttggttgattgaagatcttgctaccaggtcctggtggaagcagctagaatttcttaagcagttcctgtgaatgtttcctttttatgtagatcatttcttggaaagctgtgttttaaaataaagctctacaggcactactgttttactctaaggcctttgagctctgatatctaagacatatttatttcttcaactatgcccaggacagtgctttgcattcaataggtgaccagtaagtgttgagttttgttgaatataaaattatttacaaatgattttttgttttttccctttaaaaattaggcttccgagaaaactttgggcttcagagtccctgcttccaagcccctctttgtaacactctatgaaatgaaaagcatctttggatggtatggggagagctgaacaatgtgaggtgggagggcgttggcctttaatcaggtttctggggacagatcactcatgctggttcatgctggcccaaggctgtcttctttcttgtttgtggatgtgggttatgttcctatactgagatgtgctggatgaaaagctaataaatattaatgaagcagttacttctgtcaggcacagtattggctagagagataggtagaaataaatagaaaatacagttcttgactttgagaaccttattgtgtaattggaaaggtaaaatgtaaatgccttaaaagttaattaacagtaattcttaaggatccttagattgtctaatacagtggttctcaaacattagtgtccctcagaatctcatggagagttattaaaatacaaatcacagggccttatccccatatatatatatatatatatttttttttttttttactcatttggtctgtgtcatgagaatttgcatttctcagttaccagatattgctggtccatagaccacacttggagaactactggtgtggtgcagttattctcaaccttggctgtatgttagaatcacccagggagtttaaaaaaaaacccatgccaagaccccacccactgtagaccacttaaatcagaatctcagtggggtaggacctaagcatttttttaaagctccccagatagttgtaatgtgcagtaaggtttgggacttactgctctaacgtgtcagggccacagaactttggattcagagatatgatgttaccatgggctgcagcagtgtggacagaccagaggagttagcctgatcttaaagaatgataaataaagaaaaaggaatgatttttgttcttgtaaagttaatgctgggaacaagccagttggttttctagctgtttcttgggacagactgatgagtttgtgagctcttaggagtcagcatgatttcccattcagcgtgagctaatgagtgggactgaggtgtgggtcaccaccatcaataataagcattcactgaccacattctctttttcctgatatagatgagcttgtgtttatcctaacaagcttagatgtgtgtgtgtttggggtggggtgtggttgtggactgtgcaatagtgagaggctgaactttgaaaaatgactttgccatttttacatttcatctctttaagcctctgtttattcatgtataaaagaaagtactacacatagttgtgagcctttttttttttaaaaaaaaaaaaaaaaaaaaaaaaagagtctgggtcttgctatgttgccaaggctggtcttgaacttcttgggctcaagtgatccgtctctgcctcccaaagtgctgggattacaggtgtgagccaccgtgcctgtttgttagtatgtgtgtgaatactactacaattttaggaacactgttttatttatttagggacccccagaatctatcagtgagcctgacacatagtgtctgtgcagtgaatccagattggttgaatgaattggaaaggttatcttttcacattgactgcccaggcattagaaaggatgggaagagcttgtttcctgatctttacaaaaaatgctgccaccttgggttttccaacttaggcaagaaatctgttatgttcaaaataaaggagtataacttaaaaaatatatagatagaagccaggcgcagtggctcacacctgtaatcccagcactttggaaggccgaggaaggcagatcatgaggtcaggagttcgagaccagcctgaccaatgtggtgaaaccttgtctcaactaaaaatacaaaaatatagctgggcttggtggcacatgcctataatcccagctactcaggaggctgaggcaggagaatcacttgaactcgggaggcggaggttgcagtgagcccgagattgctccactgcactccagcctgggtgacagaacgagactccatctcaaaaaaaaaaaaaaaaattaaaaaaaaatatatatatggaaatacattttctcagtgtgtatactagtcatagctacctgtgacttattctttattttgtgtatttttttcagacagggtgttgctctgtcacccaggctggagtacagtggtgcaattagagctcactgcagcctggacctcctgggctcaagcagtcctttcacttcagcctctgcagcagctgagactacaggtgtatgccaccatgcccaactaaaattttccatcttttctagagatgggggtctttctatgttgaccagtgttcttgaactcctggcctcaagtgatcctcccactttggcctccccaaatactgggattacagatgtgagccaccacagctggccttacctgtgatctaaagaggtattttcaattgatgtttggccatatcagattttagttgctattaaattttattcttaatttatcaagtttaattgattattaaaaaattgcactctaagaataagcctgtgttttatttcttggaactactagagccttcgttacaatacattttagagggctccaaagttataaaataaatactggagatttggtgcttgttaaaattttgaccttttctattaaagcccattggagtgatgtacagagaaaaggctgtcttgtgttgtgatagggccatgctccatccacaggtcctgggaaggatgatgtaactgtggtctaacagcattgtctgaatttttggcctagggcaaagaggaggagggcgggtaaagaaacctgatcagaccatttgatgctaatttcacaggtgactggtcactgtgtgcctggctgttgttatttatagagctgtaagtggctggagctacacacaggaacctgaaaggatggtctgtattagagtgtggtggtagatagaagcacagcagtagaatctagggacaaatggtcactggtgagtgtcattgctggagttaaatgagactcattagtggctgttatgatttccactcttacttcattgctattcctgagtctttttgaaagcaaacaacaaaatagaccgaaacaacctctgatagactctccgttatttttaattgaggttgataggattttaatcaggtcaacttgcatactgatttcaaccaccatttaaagagctatccacaaagctataaattagaattatagttcaaaaggtctgactgttttaacctactgctcctattccccaaattattgatggggaaactgagatctagcagggttaaaaaaccagcccagtttcacagttagcagtgatgctggagctgtgatctggatcttaaatctctcagtttagccttttctgttttctaccgtattagtcctacaatgaaaatgcacttctctgtctttaaatttcagacgttgtctccatggcctagatgaaggttatcctttgttatgatattttctcagaattactttgaaaaatggttccattgttatttcttaaaatgaaagtaatatgaaaacaaattccttctattgataatacatttgcccactactgatagttttaggaataatgagaaaagagggggccaatttatggtattggccaagaaggagcgctcagcagcactggactgctatgtgtgggctggaggtaccagcagataacactcggaggcagtgggtcctgtgaatcacagcttggcctcggcataagctctggagaccagctctcctaaggagaactgccttctttggccctgccctcagcagcctgttggcagaggactagaataattgtttgtttaaaagttttactagctaattatactgcaccgaattgacaggcatctctattagagtctttccagtctcttgaaggctcttctccacattacttgtaatcttgcctcagtgtagactgcagtggctgatttttgtttgtttgttcttctctcctttcccttcccacttgttgcaaaggccacacaccaagtctggagagagagctgcctgtgggctgggaattggctgccttcatctggtcagccatatgtggctactggaaaaagtgcctttgggtcattcattctcaggtcaccaggccctagagtaaagccctaaacatgggctctctagcagaaagacttattaattccccttctcttaagtggaggcaaggaggtgtttctgaaccttcagaataacccgagggaacttgaaagtacagattcccggatgctatctcctggatgtgggttcaggttcagtaggtctgaaatgggaccaggttttagaatcttcttcgcggcccggctcacacctgtaattgcagcagtttgggaggctgaggtgggcagatagcttgagttcaggagtttgataccagcctgggcagcatagtgagaccttgtctctactaaaaagagagatcagctgggcgtggtggtgtgtgcctgttgtcccagctacttgggaggctgaggtggcaggatcacttgagcctgggagatcgaggctggagtgagctgtgatggtattactgcaggtggggtgacagagtgagaccccatctctctctcttgttttttttttttttgtttctttttaaaagaaccttcattacattaattgacttccaaggtctcatccagtcatgatggtttttgcatggtccctaccagtagaagatggatttcagaccacagggaatttatttgtagctacagtcaattttcaaattatttgccttacaaatgttttcaatcccagagacctttttcccagctggttcctgggttatattgccaaagtccctggttggtatgcactcgagaactgaaagataattttcttcttgattttaagaaaagataattaaggagggaaatctaccattaaaaaaaaaatcagacattacaaccaagtataacttttagagcagatcctctattgggaaggagcaatatgttatgttaccttgtatttgagcagttaattagggtcagatgtagttagttctcatgctttggccttgcaaaagtaatcccctttttggaaaggctttgttgagtccctaggaattattttaatggtctctaagtatgtttaactcagtcataatattctagttgtttggatttgttgtgtattgacattgacttagatattctcccctgctctgggctttacctcttactcgtacccaaatccatggtccacatgctgtggtgtcccctgggcatgcccagccttgccatgtgtgcaaggtaatccctttgaccctctcaagagggtgctgctcatcttttttttttttttttttttttttggcttcacttatcccacttgacattgccaaacgtgctttgacttgaagcaccgctgctcctgtggctgtctcctttgcttctcctcttcggctcattgagaatctgtttgagatacttgtcatcctttggagattagaactcactttagagggaggaatgattttacactgggactgttaggatcagtttaggaggaaacaggcccacgatgattttaggaggggtttctactgtggtccttgtaaccacatagtttgtactgagctggacactggccatttgagtagatgcttgttctccagttatagaatggttcccagctggcagatttcccactgggattcagtttccttggccgctgctgtttgttgtgctcacactgatttttgcggcatctttccaggcccttgagtcttttccaagcagaagaaatagcagaatgccttgccctccccttctcttctccttttgggtattccatggctattagggaaggacttcctgtgaaataaaatgagggcaaaggaaagtagcatgcctgtggcataaaaatgctgttagcaagcttgaggcatatcagagagattggtcctaagagtaacatttactgcctttctgcttttgaacttttctttcccccttcctttgcctgtttctgaggtctgggatttatccagaatttaagaacggactgtttttgatcatttgaataggtatcatcattcagcagggaatacatgtgcagactgagatgtctcttaaagccaatttatagtataagtcatttgaaatgatttcttgagtcagtaatgcatttctgcttcaaattctctgcctggatttgtgcattcatctcccattttaccaggtgatttgctttattatgctgctatgacagcccccctccccaaccttcaactgctatccccagatacgtgggcatgcttttcagggtgagtagccattaaactacccaaaatgacaccgaacgttgtctacacaggcttggaaacatggagggcctggattccagtaaaattctccaggctgcttcgtcaggctattgcagaaaagattacagggtcctttaagattagttttggagagatctaggcagatggatgggtgaagtcccaatgggaagtcagtacccagttgccacttggaataatctaaaatcctggcatgatctttcctctcataacttgaagtactcagctagaggagagcctctccttcgcaagacccagctatctctttgagaagaaaagggggtttggatggagtccaaccttctggtttgttttgcccgtctgccatttgccttttccttgttggtgtttgctgctgtttgttctttggagtctgaggggcttctgaccttggctgaagggcttctaaccctggacaggtcccgaaggagtggcatcagatagttgtgttttaatttcacaaatctgttatttctttaagaggaaatgagcaactggtagacccagaacagtaccaaggggagctggggagttgttatttgtaagtgtagagaaagaaaggaacagttacagggaggtttggtgcatgatacacagctgatgccttcagagaataggaggttttctttctgtgctttttctcataacattggaggaagaagaaagaggaggcatgtggcttgttggtggttgaactccagtgcagaagttaacattccactcatttagctcactaatttattaattaatttcacaaatacctattgtgctactatgtgccaggcacccttctaggtactgggtttacagtggtaaacaaaaaaaggtccttgctgtcgtgaaccttatactctagccaagggggtggtggtgatgaggacatatttataatggtggtggtgatagtgataaatactatgaaaggaaaaaaaaacaagaaagggaagagaatgggatagggagctattttagtaagtgtgttcatggaaggccttataaatgactatacaatacataaataatcattaaaatgagattttattacctaaaatattttgaacacttcagttgttcaaattattatggaatgctagcatgcatagggactgaaaatatttttttctctgaagttttgagggttttccaaggatttagcttctctttgtttctctggatattcagactcacatagctagattagagttcaccatcacagttgctttcagcattgattgagacagtcttatgttgtaagggtctgctttttacaaaattgctataaaattgttctgtgtgattgagaggctccctctcactcaaagtagatgtttggctgtttttgttgttctgttttaaacagtaatgagtaccttttggtaattaaagtccccttcacaaaactgtagtgagtgatgaataagacataaacaaagaatcccttctgcggagcagagtgccaatggccatagacataactcaggggctgtttgaccacataactcagtgcagtggcttttcaccattggaagggtggaatggtctggtatggttttctggattgctctgataaacaggagttatatttgctgtcagtttctatgaaaggacagcattatatgagccatggtttgtcaggggcctactgtgtgctgggctctttgctataggatcaaatgctaactacatctattccacaagacaccctatcacagtgattggtttttttgttgttgtttgtttttgagatgaaattttactcttgttgcccaggctggagtgcaatggcgcaatctcggcttactgcaacccttgtctcccaggttcaaacgattctcctgcttcagcctcccaagtagctgggattacaggtgcccgccaccacgcccagctaattttttttatttttagtagaaacggggtttcatcatgttggccaggctggtctcaaactcctgacctcagggtgagaggtgaagccagctggacttcctgggttgagtggggacttgcaaaacttttctgtctagctagaggattgcaaatgcaccaatcagtgctctgtgtctggctaaaggattgtaaatgcaccaatcagcactctgtagaaatgcagcaatcagcactctgtgtctagctaaaggattgtaaatgcaccaatcagcactctgttaaaatgcaccaatcagcgctctgcgtctagctaaaggattgtaaatgcaccagtcagcactctgtaaaaacgcaccagtcagcgctctgtgtctagctaaaggattgtaaacgcaccagtcagcactctgtaaaatggaccaatagcactgtgtaaaatggaccaatcagtaggacattggtggggaaaaataagggaataaaagctggccaccccagccagcagtggcaacccgcttgggtcctcttccatgctgtggaagctttgttctttcactctaaatcttgctgctactcactctttgggtccgtgccacctttaagagctgtaacactcaccacgaaggtctgtggcttcattcttgaagtcagcgagatcaagaacccaccagaaggaactaactctgaacacaaggtgatccacccgcctcggcctcccaaagtgctgggattacaggcctgagccaccgtgcctgacctgtcacaatgattttttaaactgcatatcttaatccattagtgggtgacagtcagaattttattttattcagtttaaaaaatagaatcaaatagatgacatcagagtatactacacttagtgtgtgtattgtttcaaaaaaacttgttttaagtgtatgtgcatgcaggcagacatcagaaatttttatgtgtcatgctctaaaaagtttgaaaacaagcctatcagttgaggtttggtatcatttataggcaagtaaactgaaactctgaggttaaggacgttgcctactatcagaactaaaatttgaactcagctctttctggctttcagcatttgatccaattatgtttctcacagagctttccctctctaatggttttccaagactcttgagatcacagagacactgatttgctcctgacgttgttctaaaatcagaggaggaacatgcactctgatgaccagacccaagtttgactggtttctcaaaacatctttacataacatagtctatttcaggagaagggaaaagaaagatgactctagaacttgtctttattaagaaacaaggaaaatctagacactctttttctgtcatagaaagatagcctagttttaccagagaggagaaattctaaccagaagtagtatcaggatctttctctctaaagcacttaaagtcttttgttggcgagacgagtagagcaagaggaatctgccaccttgtgtaaaacattttggttttactagtcaggcatatttttgaataaccttcactagcatttattatagtagttattttattttattttgacacagagtctcactctgttgcctaggctggagtgcagtggcatgatctctgctcactgcaacctccacctcctgggttcaagtgattctcctgcctcagctgtaatcccaagaagctgggattacaggcgtgccaccatacccagctaatttttgaagcctctattttagtttcccccaactttactagagatggggtttcaccatgttggccagggctggtctcgaactcctgacttcaggtgatccgcccaccttggcctcccaaagtgctgggcttacaggcgttgagccactgcgcctagctgttacaacattttggcaccagttttacctacttccccagcctcctaggaatgaagtggaacttttattaaggacagatttttcagaggggcattattctcactggcattccttccctcttgcctggaatcacccttgaatgaattcctgattggttcagctagactttttcttttacagaagaaattgctcttggtgaagatgccagaaaaatatcgtaaaaacctgctctcttatcctcttctctgtactactttgttaccccaccccaccccacctcaagcccccagtaaaaaatgaccttttggcccagggccctatctgagtatattgtgtggcagagttgtctctggctgactcccaggattgttaatgacttccttctctgtccctaaataattgcttgaaaagacagctgtggagagacattgcccccagcttgcaggctcattaattcagccctatgaaagagggtgcaaaggaagaaggtggaagttactttgccaagagtagcaggcttgggggaaactaaaatagaggcttcaggggaagggcagcagcatggtgtcagagattacacttggagtttgtgaagtctgggcaggcttcaatctaaagaaactttatgcacaaaagcccaaatccagggaaataaatgaaagtgattattcacttttctaaagtccttacagtagcgttcctctggtattgtttgaatacagtttaacctgaagggcacttggtttttgtgcagctcttcaagaacagaagcatctaagtaagtagaaagtctgagaaattaacagagaagattccctaaaagtcagccttcattacttgaccattattcataattctgcatttgtctattcctccagtggccttgaagcaaaattaaaaaaaaaaaaagacacttctatgccccttaaaaaaagaataatcaaaacttgcatagacagaataagaatcaaatacactggggaacaaatactctgattagctgtccggttcagctctgacgcgtctagcactctgagttataagggaaacgataggacacttggtttttgttttccaacaacaggaaacatatcaggtttctaagaagatgtaaagtctttcttaaaacccaattatagaaggaatttatgcaagtctttaggcaaggagtattaaagaaattaatgtttaatgccatcaacaagttttcaagcagatgcagaactcctagtgtgggtgactttttggtgtttaccttatatcaagaatgcagcatttaaggccactttgacagagtgcagctaagctttttgggtttgcttgtgtggacaatttccattcagcaatggctctcaaacttcaatgcacatcagaattacgtgggggcacttaaaaaaaatgtatgcccaggctgcatccagaccaattcagtcagaatctctgatggtgagccccaagtatcaatattttgtaaaactgattccaaaggttagctaagtgtgaatcagtgcgttagatgatctttaacgttaattatcttagctggatttctcaaaggggtagtcctagaatgctgatattccctgttattaatttaagtaagtccctgttgtttctgttaacattctcttagaactctgagacttgtatttctgctgggacccagggctactgcacctttcttggcctataggagtgttgtcagaaccaaagtacttgttaagcagcagcttaggatcaacattagcagacctcattgtggctgttggagaatatagaacatcagatgaagtaggggcttgacgtttccacagccctaaatcacatatttcagagtacgttaagattccttttggaactcagatctttttctggccatggatagactgttgtcttggggggatgccagttgtctctccagtgagaaaaggagatgtttatgtattctctagttcccttctggaagttaaaaatacctgtcattgttagatttggtttctgaactctctgcccctaacaaagctgaaatgatgacagtgagtgaagtatttgcttaaataaatatcttttttttcaactttgaagaactaaatatatctcaacgtgttgaaacatcagagaattggctgggcccagtggatcacacctgtaatcccagcactttgggagtctgagctgggaagattgcttgagctcaggagtttaagactagcctgggcaaaatagtgagacctcgtctctactaaaaataaaaaataaaaaaaaaaatggctgaatgtggtggcacgtgcctgtagtttcagctatttgggaggctgaggtgggaggatcacttgagccctggaggtcaatgctgcagtcagctttgattgtaccactgcactccagcctaggtgacagagtcagactctgtctcaaaaaagaaacatcagagaatcattgattttatgtaatctagattttatcccattccaaattgtgcttctgtgaatacacattatggaggataacggaaagggtgtttagggaaggggatgacaatgggaggagagggagaaaagggtggtgggagaggtaatataaatgataattaccatgacttgaatcttggtaaaatcgtataataggaaccatgtggtactggtgttctgattaaaaaccacttcctggctttgtgaccttgagtaagctataactctatttttcagttttctcacctgaaaaattataatgatacctgcctgttaggattgttttgaagattgagattgttcgtaaaatacttagaaaagtgccttggcacatagcaagtactatttaagtgtttatcagagcatagtctcaacttgtcccattaagaatattataaaactgtaaggtccagatgatgctttattctgtaaaggccattaatggagatgcttgaacatctctaaattacctttccctttgcttgctcaggaagtttgctaatctaaattcttcatgctgtgctgctgagtgtcatgtgtgattgcttgtgcaaggagacccaactgggttctatccgcacttaactgaaactcaagttattccctctctagccttaattcctgtcttctaactctccaatcgatttcttggctccactaattgaaacctaccccagttttctcatgctgttgagcagggatcttcttgagactgattatgatgggagaatgacctcatagtttctgatgccatcttccaatttatgtaactcagccccaagcatgctttttaaaaataatggccctaaattgctgacatcttgtcatctgctcagactcctaaatctttttgtgttccctcgactgaatgggattcactggagcaagatgcctttgtgcagtctgcatttagtgcacttggcgagtgacctccaatagagctgtgtgttcccttcgagcaacatgggtaatgattacagcgacaatgctgctattgtgtccagaggtttggggctgtaatttcataatgaaattgaaaaacatgagattaaaaacctgaatatagcacagtaattatatttaagtatcacaaatcatctccctgtatttagttaggtgtttgagatttggcctctttgtggagtgcagtcacgtcgtttcatacatctgcaaaatggaaggcttctaatttatggctaaaatgtgggaattgctttctcttaatgggaaggtgaggagaatggtattgaatttgaaggagctggtttgcttcattgactagagtcaagaagggaggttgtacaatagctgcttaaggtaaagaaatgtttgggtcttttcatggtttaattcccagatacttacacatgactatagtctctccctttagaaattaactgacataggctggcctgggaaattctacagtcctgcagcaaatggtgcagttgcagaagtgtgaatctttacctaaggcagggtttctggtatagataaagacttaactggggtttgtttcccacaggtaagttatggatgagctgtgcctggcccatttccatttactgtctgagaatctgcatgtggcctgcaggctctgtagttgggctgagtcctcctggagtaggaggctggggaaggtgttggtggtggctgtcgataggcattcctgcaggatggtgggtggagagttagggtgaggggtgttctttaataaaggaatagaaattagagtggaaagtggtttaaagctagtgatacctccttctccttgatttctaggaactatcaagtatgaaatgaacatagaaggaagttatgaaaggaatcattattattgtcagtgattcttgattatctactataggcaaacacgttaagttgttgttttttttttgttttgtttttttttaagacggagtctcgctctgtcgcccaggctggagcgcagtggcgcaatctctgctcactgcaagctccgcctcccgggttcatgccattctcctgcctcagcctcccgagtagctgggactacaggcgcccaccatcacgcccaactaattttttgtatttttagtagagacggggtttcaccatgttagccaggatggtctcgatctcctgacctcgtgatccacccgcctcagcttcccaaagtgctgggattacaggtgtgagccaccatgcctggccaacactttcagttttggttaccatctttaaacttcacagtagacattgatacagaggtatactttctctgtgcacatatactgcctctcaccccaaataatttttgatacagcagtgcagagtgtccctttttttccaaagctttcctcccagattcttagtgaatctacgagactgagtatctgaattgcctaaggccttttatcacaaaggccttaggcaaatgtatgcaagtgtacatacattaccaggcttcatcaacatgccctactcagagacatttcggttcattaggtaggggtgggagaggttgtggcctaggaatctgcatttcaacaagcaccaggaatttttatatacaataaattctgagaatcattgccttaggaccttctttctcaggggccgggctattccagtgggtgtgttatgttgagatttgctttgtggagatgtgaacttgctgttcagtcccttttcctagcccctggcttcagtatatctttcacaaaaatacctacttttattctgtttccactggatacaaggagggctgggctttttgctgctttacccactattacagatagcaggttgggagacagtttgagtcctgtgtttgcactccaggcctactagggaagaggtggcctgcctccagcagtaaactggtaactatctaagacctatggtgctctctgtttccactggaaactcattgaaaatgctaccactattcatgtttttgacctctcagagcaaagtatataaaagcagcagttcaagtaaattcgtcaaacatttattgagtggtggctgaggctaaagtattattttaaggggcctgggacagataagtaaaacacagtttccattctccatctatcctgtctttctttctaatgatgtagacagtcctgacacagaactatggcagacttagtgtaacctgtgacatgatcgtgtctttgaacaagtgaaattaaagtgctataggaatgtctgggtgggaacagttagtttaggttaggcaaaaggcttcttaggggaagtggctttgggcagggtgtagggcagaggctctcaccttggctgtgctttacaatcacctgagagaattttgaaaaaccccaatatttagaccaaaccctataacaatcagatcagaacttctggaatttggacagagacagcattttttaaatgtttaaacatttaaaaacattaaattttttaaatgtttaaacatttttaaagcttcctacatgattttaatgtgcagccaagactgagagccactgacaaagaaggataaataggctgtcattcagatgggggatagtcagagaaggaaaggtattccaagcttgagagaataacataagcaaagctgcagaggcagcagagtgatggcttaagttggagaatgccactcaaagcgggggtgattggagcatggggctcctggcatgagcgtggagggaaaattatgctgattaggtaggattggattaaaatactgcatcaaggaattgggagacatgattttgcactgcctttggaaccccttttcacctcatattaggatggagaattgaggttcggagaacttcttgcttgcccaaagtactagtaagccagcaggcatgcttggttccctttgcaaggctctttgccatagacctgctgtctcaagctgtgcagtacttaagacttctcttttggcatctgtcctatagcacttttctttcatcagagcaccctaaaggtaatttagggtcagaatggtaggaaggtattggtgttaggcaagaatatggcacgatttcttatctttttgctgggcccctgtgggaatgatatgggagaattgctgggaatactgggggcagatgtttgcaagtaaaagtgtatatgtttctgtgttcttgcagctgcattcgttttgtgcctgattccactaaggactgtactttatctgcttattgctgtttctaggaagttaatttgcaggtgctataagtatgcatgcttcatatacttcatttattctttcttccttgaagcctctcctctttattaggcactattcatttgtctacttggtacctgtatttttttaatgtcactattttgacagtaccaataaaggtaaagccactcaattacgcagggctctctctttatgctttgggtaggtgcacctgtgcaactgaggggacggtcagtgttatcaaggttacctgttattacaagtagaagaacccacagagatcaggagagagctcattttcctccattagtaggaggtaggactatacattcacaaacacgaaccttaaaatagctcacaaaatagtgtcatacatgtacccagccatctttccactcattccttctcaaaaggaatgtagtaccatatagtagttaagaatatagacactggagccgatcttcttgagttccaatagtggctcttctactttttaaatctcattttccttcatctttaaattgaagatagtaacaatctcatggggttgtgataactaagggggtaatgcatgtaaagtgcttagaaaatgcctggacataggaagctctaagtttgctgctactactgttattatggttactattattaatcattgcaaggaaaatgtatcaacagatgaatttggttcaatactgccttctagttttgtgaccttagaatttataggaacaaaaaagatttgaaagggaggttgggctggatcatagagagccttgattccatgttttaggatgtatacacagtgagaagtccttcaggttttggtcttggtaagagttgtgaatcagaaagttaactcttgtagccaggcggagtggctcatacctataatccaaacactttgggacatcgaggcaggaggatcacttgaggccaggagtttgagaccagcctgggcaatgtagtgagacccctgtttctgccaaaaaattactcttgcaacttcatgaaaaataaatgattagcagaattagagcagttaggaggccatcttaatagtccaaggcacaataaggcaaggaaatgaatgagagcagtggcagcagacatgaagatgagcagttggatgcgaaaggtttgttctatagatagattcctcttggcttaagaaggggaaataggaaattaattagtaatcagaaatatttgcatattagtcttctccatcttcatccttgatgagaggagagcttgttatgtatgtaccattgctgggtacaggaggcagaagagctagcgccagaacaaggagctcagctttttctggtctctgcttttacgtggctcgttataaaccaggacccaattagttctttaggcatgcctgcctgttctctttccatgtaattactttgtggagcttgggttcatgcacatagttacctcgattaaaaaataagtttttggagctataaattttcaaacactgctttgagagggtctgtcaggcattaacattcaaggtttctgtggtgggctgacgatagcctctagcctctggatgtttttcacattccaggaaatgacacctgaagttttcagttccttttcgcatcttcagcaatccatagacagtggggtgaaaagatgtaacctaattgaagacggatggagtggagtagaagttgaaaatagggaagaggctgggtgtggtaactcactcctgtaatcccaacactttgggaggccgaagtgggagaatcacttgaggccagaagtttgagaccagcctgagcaatacagtgagacttcgttctctaccaaacaaacaaacaaaagctagttgtgcatggtggtacccacctgtagtcccagctacttggaaggctgaggtgggaggctcatttgagctcaggagttcgaggctgcagtgagccatgattgtgccacttcactccagcctaggcgacagagtgagactctgtttccaaaaaaaaaaaaaaagaaaagaaaatagggaagagactgcatgagtcctgccatgcagtctttcccagaattggacatttttgtggtgtggtctggaagaaggaaaacatttatggtcatacctctccaaattgaacaattgtgggaatatgtacagacagatttgcagggtagctgaaaagaaatgcagttctgttatttttttgttatagagtggtaacttgagtgaggattatgaaacattgcctagcagaactgtttttttaattgaccttcatgtataattaagaatatcaattattaatgttaaatatattggaattttaaaaattgtgattatttctttgtaatctgatttgtgctatttgccctgattatcagagtgttgtttgagattaaagtggtctagcttgggttcagtttgcaccaggagttttgaattaactaggctccatctgaatgtggaagattttcgtcgtgaggatgcaatggaatcgtaagtgtaaagggcctagtatagtgggtagtaatttattttactcctttttttccactttaaatgaagagtggctaaacttcaacttttgggacattggtctctacctgcacctccagaatgtaacctcttggggaagatatttggagacctggggacttttgcaggtgggtagtattacgcagagcccagatacccctgccttcttgtctggaaatcagtgattctcaaactgctttgtgcttgagtattacctggggggacatgttccgttttcagctccccaagccatagagttaagattcaatagacttgaggagctgctctcagtccaggattatgtgcagatcccgaatctgatcttgggctgctgtgcttttccagtgcccactcagtatttctggggctgcaaggaaggcagtggttccccttcacaggtacgtgaagctcttaactccatttttgtccttttaaattcacattaaagagagttttagatatgcaggaaaatgagaagggaaattgaccttgcctgtctctgggtcttgtgaatagaaaggaagagcctgcgcttggaggccactgggaatttgtggtgttccagaagacctctgctctcatgtgggctcttggcagcctcactgagagccacaatgggcttccttatttaagatgctcttaaattttcttttctaacactataaggttatgtcttcaccagtttctcagattttaaaaaaagaaacagggaggtaaaacaaatcccaaaacattttttttccttcttgtaaaggttacaaacataaatcatatttgagaacaatgaatggaccttattttttatcttcagaatgctgggcctctggcatcttagaaagtctctttactttcgaaaggaaggagacttgtatagtgagagcatcacactctggggatcaggtaacttggctatgctactgggcacctgggacttcttggtcagaacaagtctccactgtgagcttttttttttaatccatgaaatgtgggggtcctgaagctatcaaagcgttaatgttttatgattctagtgatgggcttctgtctgcgtgacaggcattttccagactttgttgatctatttcgagcttgtgaggaatagcatgtaccacccttcattacctcactcatggttcctcttcatcagtgctttataaactgtagtgtgtttgtgctgggaggaacgtaagagaacatgtggatcacccctttactcattttacacatgagaaagatgataccccaagtgattttctctaaggttgggacatgactggggctctccttgcgatttgcctttcccttcagtgcgttcggtaaacgttgcattaccccctcttcagggtattattctttcagttccatatgcctttcctttcccctgggatgctggagtattcagttttatttctaggcaaaagtactcctaactgtggcccctaatttttttttgttatgtatcttttctagaaagagaatttgattatgcattgtccatatgtttacatactgtactcataaatgaagttataaaatatatgtaagttaaaaatgtggagaaaagggaagtcttgtgcaccattagtggggatataaattattattggtattacggaaattagtacggaagttgcccgaacaattaaaaatagctgggtgtggtgactcactcctgtaatccttgcactttggaaggccaaggtgggaggactgcttgtggccagaagtttgagatcagcctggacaacatagtgggatcctatctctacaaaaaattaaaattttagctgggtgtgatggtgcacgcctgtagtcccagctacttgggaggctgaggtggttggactgcttgagctcaggagttcgaggctgcagtgagctttaatggcaccactgcattccagcctgggcaacagagcgaaacctagtctaaaaaaaaaaaagtgtgtatataagtacacacatacacacccctcaataaggctagagagaaaaaaattatatgtaagtatggtattttttttttcctcaatcacagtggatcagtttatgccttccctggatccagggtgaacttgttttgaggaccactgatccagaaagtggtggagttaagtctgtaccaccagctttagaatctcctgtggcacttattaaaaatacgaattttggtatctcaacccagattcactgaatgagaatgcctcctggtggaacctgggagtctacgttgtcttcatttttatgtttttaccaatagacatggggtctgttgcccaggctggttttgaactcctcagctcagagtcctcccacctctaccttctgagtatctgggaccacagtcacaatgcccagcaaagtctccattttaaaccagaggcaagtctccaggtgcctctgaggtccagcgagtttggggaaccggtattttagacaggcagggaagtgtcattcatgggttcatgagcatgggacttcttacactgacatctcagaaattgctcagctgttactgttaaatctacagtgatacagttagcactctggaaaatcagatgggcagttttcatttgagttacatatgagggactataacctgcataatcatacatggaatttcttaaaactccttggcattctctatgtggttttttgatttgtaaatccaaatatttgctattgtgcctcagtctttttttcctcattagaaatctaagctctccccgccccctcctggtgctgttccttgaggggctgtgtttttatttctgagcttttcccatttgtgtgtgttccttttgtctggagtatgcccaaccccctcacctttttacctgggcagttcctactatctaaaaaattccctataaatgacattatttttcattcttaaaatctaaagataatgaagaactagctgataatcagcatttaccaaaatagatttaagggttattatttgtaataactcatgtgtcagtaaccttatgtatgtaaggatagatcagtatcttggttattaagcatatactctctgaaacattcgaatcaaaccagtgtaagtcagataaatatgtaacaggaaatttgtttctgactattcactccaggtcaatgtattcccagctgccttgtgggtatcagggttatctgttccaggatcagctttaggaaagcccctactcaaatctccatgtagcaagagtgcaggctagttgagaacatgtgataattaaggttaaacaaaaaaatcaaggcagaatgactagaaattaggacagcagggaaagcaggggaagcggttgagctggtagaaatgggtaatacctatgattatttctgggatcaacagatacatccctgttgtagaagtccaaagcagtccttctttttggtgtcttttcctgcctttggtatgataagcccccctaacatctggcacactattggggtgacattgtgaagttacctctgcccacagtacttactccagtttgatatttttaagaaatgctcactttccactagccatagtttattggctttcagaaagtgtctggcagtgagtatgccaaaggtcaagaattctggcagagtttgatttatctctgctcccttgatagcagctagccttggaggcatagaagctcttgacaagtactatgagtcagaaggccacatgtgactaggtccctgcccacctctccagggtcaaatagatcttgcctttttccccagcccctccctgcactgttcctgaagagggctgtgtttttctttccaagccctcccatttatttacattccttctatctggagtacttcttaccccctcacctttttacctggctaattcttatatatcttttagataattctacataaataacacttctttcacctttcctaaactagaataggtattcctgctgtatgcttctatggtcccctcatttcccctagaataacttactacagtttttcgttcatacttactgttatccccctggactgtctgttctgctaggataaggattcttgctcaccatttcctcattgctaggcataaggtatgggacatagcaggttatcaataaacattttttgactgaataaaagcataataaaacaatatgttaattaatggggtgactggcagggatctagttgccaatttcagcattggtaattaacatggctagatttagctgctaggttctatgagaaagaatgattaaaaataaacagaaaggagatggaagttgatacgattaaaaacattttatgtgcctgctgatggacctaaaactgggcaaacctttctgcaaataaagctctaccttgatggtcttattgatataccatatatacatatatatgtatgtatataaataagatatacctatatataaaatatttatacctatatatggtatataaatgaatataaatataagatatataggtatatatatgtggtgtatatatacataaatatgtttgtgtatgtataataaaagacattactctccattgaagtgtttactacattatgtactatcttaaaacaaaacttcccacaggtgtcagtacaaacatgcatttgttcatttattcattcattcaacagttttgttgattgtttgatatatgtcaggcacttttctaggtgctcaagacacaacagtgaacaaaacagacaacaatctctctgactcaatggaacatgcattttagtggaagggaatgtcaataaagaaacgtctaatatctagagtattagaaactggtaagtgctaggaaggaggaaagggggccaggaaatgatgtgatgtgtgctgttgtggtggtggggcatgcaattttagattcagtggccaggaaaggagtcactgagaaggcaactcttgagtaattacctaaaagggggtgaggaagtaagccaggtgggtatttgggagaagtgaggtaggacagtgtgcatagctctttggaatgtgctcctcatccctcatgtttattacgttggccagaccagcaggttgggctttcagtggcctgtttgatcagaatctgcaaatgtttcctgtctttggatagtttccctgactaaatcttagcctgaagacgtatgttaaggggagagcgtatgtttcttcttgccaacttagttttatggaaaaggccctaaggaaaaagcctgtcttttccttttcatgggtcagaatttgtgttttgttattttctaagctctagtttgtggtggaaccacctctctcagatcttgtttttccttcagggcacagtgtatttctcacttaagtagtttatgcagtcttatcacagtgtcccctgcatggggacctgataacttactctgattgataacggaagggcttttctgtctacttctgtctccttgatggcttccttatctgttgtcctgtaacactaactgtgaactcatttcattaggtaatgaaatgttatcttctgtaattgcttatttgtgcagcagtcttgtctctgcaactggagaggaactttaggttctttctgaaccttagagtactggctcatagtgcctgtgctataaccatcattgattgctgttggtcaaagcacctgactttttggggtaagtaaaccaacatcttgcttttcagtgttttgtttttctggattacccatctatgctttgggtttaatgctccttaggacttggccttagtatgctgctggagagcccaagggaacagtatattagtaagggatgaattctttgtgaattcttaaatcttccattgcgaagatctttgtacagaatactggttctgtttatattgacagttcttcagagaattgtgtgttgactgttcatggcagaaacaccataagttaattgctgtttcaaatttcattgacactttccccctcatttggaggtcatttcctcaaaaatgtcgttgtccacatgacagtttgtgtatgcttaataaaagagaatgacaaacccaagttcagctgttgttactggactgggtggtttttagctcctcccacaatgggcaataatcagtttggggtctcagcagaattataaatacctgcatttcatagtcttcctgaaggaattgctttacttggaatactgtagttcagactgctgatgtaccgtgcactcctttctctttgatgatcagctctgaagtgcaccaattggagagaactcttgaataaatgctgtcacttgtcacatgtggtcactttctggggactgtgcatgtgccagtgggggccatctagaagccaccgatgcccactaatataacaaaactcactgggtttgcttctctataatgatgttggattgctttgctggaaatccttaccatcttggtttctctcctctgtttcctgtaaacaccaaataaaagtccttgcatacaaatgttaccatctttggaaaaaaaaaaagtccttgtagttgttaacagttacagaaaatataacctgaagacttggagtcaaaaaacaaatccctgccttcccatacagtcagtaccagctataagctaattaaactcaactgttcccacctgttcccggggaggcctctaacagtggcacatgcttttctctttgggacttaacatttttcagaactctttaaatttcattttctaggccaggcatggtggcttttgcctgtaatcccagcactttgggaggccaaggcaggaggattgcttgattctatgagtttcagaccagcctgggcaacatgacaagacactgtctctacaaaataaacaaacaaattagccaggcgtggttccaggcacctgtggttccagctactcaggaggctgaggtgggaggatcatttgagcctgtgtggttgcggctgcagtgatcattgtttgcaccacagcactctagcctgggtgacagagtgagactcttgtctcaaagaaaattttttttcattttccattgacaccatactaaacaacgtgtatttccagaatcaacctttatttccctaagaaaatgtagattgtgatgtccctggtgagcaataagttaatattggctgatagtatttgagcagcagtgacagataggaggaagacaggagggaagagatgggagtgttgctgggggagtgggtgtgaaaccataacacacatatatggtcacgtacacatctgtagtttactcaaatggcattttcacaaagcacagtagtgttgcaggtatcccccagtgggcacacagagctttcagtcctcactgtgtgaaacttctcatacctttgatgttgaatttaagttcattagtggctcctatagcatgtcagaggtttacctcacttggttcctgactcaactctgaaatgctgagtttagggtggatttgaagtgtcaccttcgtctctactttctaagagtcagtaaagagctgccatgatagttaatcctatagtgcctccaatgaagacttaaatatacttactagcccagactttgctttatcattctcctgatctattagttttattcctgttgacagccaaaatgtaggatcatgaaccccacagttacatggatggtgacagacctgagttgttgtcgagaatcgtgctgagttttgttatcacatttcttgtctcgatttgtagcatctctggattttacttctttaccagaatagtggttatcaaagtgtggtcttcgaagcagcaatatcatcatcatctgggaacttgtttgcaatgcagatttccaaggctctaccatgacttcctgaatcagaaacctttgaggaggaagccagcaatctgtgtcttaacaagccctcctgtgattatacccaactttaagaatcactacacagacagacgttgctttccttttagtctcttgagcttgtaacagttgatattttaacttttatatgagagaggacagttatatcttcctttaaactcttatttggtgcagttgattgtcagatgcagagtgctgatgtgaggatggactgtgaatatgatccactgtggcagtgtttatagtctcagcccaatgccttgttgacttaagtagcagccttgataacaggagataaatctgcaaagatactgtgaggttacatggcaaggcttttaaaatacaccaacattacatttgtggcaagtgctttgctcaatgttggcatttttgaagtcaccctttacctctgccccctgcccagaaatttccttgtgagaaatgtttttacgttagacaaactgccatgggggaggatagtcagaaagaggagacaaataatacgcagaggcagacttttttttacatttgttgctcagaagaaaaaaattccaatgaagaatgaaagaggcttcatatcctgaataaagtaaatgatctgggtaggatggtacaggaatagaatgtgactataaaaaagaaccaaattgtgcagacaagaaaatatgaaggaaaaaagaataggaaaaagacagggaaaatgcaaattcttatggaatatttttgcaaatctgtgtacagaaggaaccaagcaacgcagatcagttcttctgaggctgggagttctaaaaattatgcagtatcaaggaaggctttcttcctgagtcaagtgtaggaagcagaaccaacctttatttctctatgaagatgtatattgtgatgtccccagtgagcaataagttaatattggatgatagtatttaggcagcagtgacagaaagttttctttctcctgactgaatctcacaccaaggtccctttttatttttaattgtttagtttaatttttgttttttgttttttgagacagggtcttactctgttgcccaggctggagtgcagtggcgcgttcatagctcaactacatcctcaaactcctaggctcacacgattcccccacctcagcctcctgagtagctgggactataggcacgtgacaccacacctggctaattttgtaacttttgatagagacacacacggtcttggtcttgctatgttgcccaggctggtctcaagcggtcttcctacctccacctcccaaagtgggattacagatgggagccaccatgcccagccaaggctttttttttttttttttttttttttttttttaaaccagcgtcacaaccacagaagaaagacaagaggaagatatgaagacaaaactcaattttttttacttagtgtgtctaggtaaaggtttagtaggagataatgtagaaatgaaatatgataatagcttatttgtgttgagtgctttgatgtatgaggcattattctaagggcgttatacttgttgaactgtctacttcttacagagtctgatgagctacactctgtttgtgtatttgtttttggtggcttttttgagacagaggctcactccactgtccaggctggagtgcagcggtgccatcacggcttactgtagcctcgatttcccaggtttaggtaatttacccacatctcagcctcccaagtagctgggactgcaggtgtgcactaccacgcctggctaatttttttgatgagctagactctgttaccctcatttgctagttcatgaaattgaggcagagagagaaagtaagcaatctggccaaggccacacagctagcaaatgggatttaatccctagcattttcattccagagccttgcctttagccatcacactctactgtttctcttccatagtcgtcttctttcttgtgattccaagttaaagaattgtcatggatgagctttttccaggagtaaaggtacttgttggactcttcatcagatttggtcgcgggaaaagaggttgttgctcttccttagagacctgttctttctgcatttaaaatctgagtgtaaatttttttttagctggaaattttaaacgtgtagcaagtgtggccagcttgctcttgtaatgtttagtttcctggacctcatgttgcctccctaaaacttaaatggggttgtggttgcacaacagtatcatggaaatgaaatgaatcttaagcctaatgagtttgaataagatgagcacaatctaattttgtttccagtcgtttttcctcctttaaacaaagaatatcatgccaaattggaaacattggattgtgtcactgtgggtatttattttttactacatgtcaccaagatccagatttgttgagtgtattagttacatatggggtaaaattctgattttttaggtgtattagttatgtatggggtacaaaattaccacaaaacttaccatcttaaaacagcaaacttttactatcttagtttatgtgggtcaggaatttctgagtgacttatctgggtagttcttgcttgacttctcttttgagattccaggagtaaaggtacttgtcagactcttcatcagatttggtcccgggaaaagaggtcattgctcttccttagagacctgttcttgttgcatttaaattcttagtgtaaatttttttttagctggaaattttcaacctgtgtagcaagtgtggccagcttgctcttttaatgtttagtttcctggacctgcagccgaaatgttatctggggccactgtcatctgaatgtttgactggagctggagagtctgcttctaagatggctcattcatatggcttttggcaggaggccttggtttctcaccacatggacttcttaacatgacagctggttttaccagcgtgactgattcaagagagagaaaaatgacctaatcttgcaagtcagacactgtcacttctgccacattctgttagtcagaagcaggtcattaatggcagcctgcactcaaggggaggagaattaggcccaagctttttttttttttttttttttgaaatggagccttgctctgttgcccaggctggagtgcagtggcacgatctcccaggttcaagcagttctcctacctcagcctccggatcctgagtagctgggactacaggcttgcactaccatgcctggctaatttttgtatttttagtagagacggggttttaccatgttgttcagactcatcttgaactcctgacctcaggtaatctgcccgcctctgcctcccaaagtggggattacaggtgtgagccaccgcactccggccaaggccgcacttttgaagggaggagcattaaattgtggacgtattttaaccaccatagtaggcctgactccacacctactaaatcaaactctctgggtatagtaattttcatttttaagattctctcaaatgatttttatacacacttaaaatagaggacaactgggtatctagaagtaaatgaatgctatcatggcactatactagtttatttaaaaggccagatgtttttcacatgtttagcattctaaatatttgaggtttgtggatgaggtcacttggaagtaaaaaaaaaattttttttcaggtttgcgcttaggcactaaatcatatactaggtaatatagtacactctgctcagactgcattttatctggatgggcccttagctttttttctgttgctcattcaggcagatgagccccactctaatgtagcctgtggtatctgaccagctgctctcagtgcatatagcccaagcaggagctgtagctcctgattagaaagaatgaagtatatgtctgggcagggcaagccaaaagggattctgaggttcttgtctcaagatccagggtgaaccaggcaccatctgatgatggtctttggctcattggctcctacagctgcatactttgttaggagacatgaggggtacagaaccaggagtttgcaaagaacaatcatttgccttctggagcccttctaacctggacatcacacccttttgatgttaaatgacagacgtctggctctgtgtgacatcatacctatcttatcttagtgtacctcagctaacctcctgaggcttttggtggggaatcaggcctcattccccatcatagacataatttcctttttttttttctgagatggagtctcgctccgttgcccaggctggagtacagtggcgcgatctcggctcactgcaagttccgcctcccaggttcacaccattctcctgcctcagcctccccagtagctgggactgcaggcacccgccaccacgcctggctaattttttgtatttttttttggtagagacggggtttcactgtgttagccaggatggtctccatctcctgacctcgtgatctgcccgccttggcctcccaaagtgctgggattacaggcgtgagccaccacgcctggccgatcatagacatcattttcttaccttcccattcacattagctcttagccatctgaatgcatgcctacaaggaatgcaattggttgcttaagaacggaggaaacatgttatggaaatctatacttctcttcaaatgtttgtaccactcacctacccaattcccttcccaccccaatcaaaagacaaatacccatgctcagaacctgggggctcacattttacctgaaattccacaagtaacagaagcacacatttaggggataaaaccctagagagagagtaacacaatcctggctgccatctcagaacaagagagcattgtacccagagtccatgatcacatactggaatgactgtgtgacggagctgacatgccccaataggtacaacagattgttctgcttgtaaccaatcaataccacaattaacaaatatttattgaacaccccggaagcaccctggtatatactgtcctcatcagctatttgttagaataacacgaaacctcctgatcctctgtctgccttcaggcttgcctctgccccaataaaatcaattctctacatcaaaaccagagtgacttttcctaaaatatacacatttgaccaggtcatttaccttgaaatgttctggttgatgttcagcatccagataaagcccacacttcccagcatgacctaagaacctgaccgtgtgactctgcttccctcttacagcttctccacacatgttccagcgtccaggcactctccactcctcgtgcctcccaccatgcccacctctcttgtccttcccatctttatgtgccacataacagcggctaagagtgccggcgtcagagctcataaggctttgattcaaaacccaactctatgacttaataattgtagagtcttgggtaaattactggatgtttctgagcctcagattcttcgtatacaaaaataaaccaccagcctcacaggattctcataaggattaactgtgatcatatttaaaatgtttagcacagtgcctagcccataattaagactgagtaaatattgctattgctatattgatgtatggaaagcccttggcacacagtagttgtttaattaaaaaaaaaaaaagatccttgtctccgggagcctcagtttttttttgatcattggaacttctcagtgtgacattcagagtttgatataggagtggggatggcattggtgtgggtagagaactagggttttgagggaaagagagagaaagttgataggaggagcatagatgtaaaaaccattgtgtgtttccatgtgatcttccttccgtttgaatatgactaaaaatgtcattcgttttggggcagggaaaaatggtagactaggattcggaagaaactgacattctgacgttgagtaagtcactgctttgcgcctttattagttcatatgtaaaattggttcatcagatactgtttttgagagctttttaaagactagaaaacataacgtgaaataaaatgacaatattatacccctaattctacatttacagcatattcaacatttttttgaaagcaacatttttgtttacacataacagatgctgaagcacacagccccctagaaatggaggttgccaggaggataaagaagatcatgaatgctgccagtgtctctaatctttgccctcattccttgtgtgtctctcatttgagaagttctcacctttcctgggggttctctggccagagtgtttttactctgcaccactctacctgccgttgactgggttaccttcataaaagaggaatctgaagggccttatgggaagagtactgctggtggacacatggaatcaggaagcatagtttgaaatctagcacagattaaaacttgacctaacactcaaaaggttttcttctctgtgatctagggctctctgtggtcaccatattgcatcactatgaggtttaagatgaatgtgtgggtacctagcaaaggtctggcatgtgatggatacaggacagtcttgtcttttcctacttggacacctgagatagttccccagtgtaccctgaatatctgaatccaaaatcttcagtcaagaaggagcctctacggactagatccaagcctccctttctgatcttatttctattcattaccttcatgctccccctcccgtccataataattatcctccagactcaaggcccttcacgtgatttttagtttattacaccttagcttttcctttcttctgtatagactttgctgtacctgcaataagtgatacctttcccaggtccatgggacttgaaaatcctgtttccatcaagcttttccgcaaaccacccctcctcaccaggtgggagccatcgttcattccctgttcccccaatgcatgttgttttgcttctattatagctcttatcacagtctgccttgtagcatagtcatttctgtgtgttttccctctggattcggagcccctggagggcaaagactatgttttattttatgctgtatttccccacccccacagtgcctagtgcagtaggggtttggtaaatactgcttgaatcaatgcatgaatgaaattgcctctcctagttctgtttgcaaggctgtaatgcagaccaggtgaatgtagaattttggcttactggatttagtttagcataggaagggagttttccaagaagcaatagtggttttgaaaacagaaattgcctttaatcttgtggaaaacatatgccagccctctccataatagtctcaattacaggagagcatcgtgttactgtaaaaacacaaataaataaacccatgacaatactgtgtttgggagataaaaaccacataaaagccatctttccccaactctccagcatcataattagggtatttctgggaggagaaaaaaaagacaccagcaaaaaacaagtgatactatgtttaagaacacttcttgctattggcaagatgggagtagggagttagattttccatacagcacaaatacaagggttcttcccagctcctaccaggcttgatgctatatagattacactgcatgataaatttgggcactagaggtgccaaagatggtggcagaacctggagggcagaaaatgtcacccagaaggtgatgctgtgaaatttattgctctgccacactttacctaaacatgtcctattattctgaatgctgggtcttcattggctcagggatgcccttggtgcgtccgttgccatgggctacaactttcaactgtattttgtttattgctggtcatttaagtctctatctggtttttttttcttttaacttgagggctccagatttaggttcttttgaggtaagagtaggaatgactttgaaatattgcctacttttgtcagtattagttaacaagcactgagggctgaatgacactgaacagaacccagccatttctcagcacctctgttgccactaccctggtctgagttgccatcatgtttcacctggactgcctcagtagcctcccacctgacctctttgctcctactttgcctccctgcagagtgttcttcactcagcaaccagagtggcccttttaaaatgtactttagatcatatcactcctcagttcaaaatcctccagagtgcctcccatttcactaagaatgcaattcaaagaccttacttaccatggcctacaagacactgcacggtctagtgcctgctatctctcaccccatctcctactatccccttagattaatcctctctgacccttcagcttgcttgctgttcttgaacctggtcaagcatttcccaactcagagtctttgcattattgttctcttagcctggaacatttggtcccagatataaacacatggttcatactctcacttccttcaggcccctgagtgtcaccttgttggggaggtcctgtccacctgtatttctattgctggagcaagcacttaggaagtctttgttggaattgtgaataagcattgcccagagattctagcacatttggaaaaagagagtgtggtttagaaggacagtggctctggagttggagcagttgggcactgctgggtttgcctgccccccattggatagatggctgatgttgggaaaattatttaacctttctaagcctaggtttctctactagttaaatgagattatgtctatctctcagaatcgttgtgaagagtaagtcagataatgactgcaaagtgcttggcaatgagtcttgtacacatactgggaggcttcctaaataccacttctcacaaatcctacttcctgcttgtgaaatcatgttatatggaagaaggggagtgtctgaaaatggtttgaatcttgtgtgtaattctcaagtaccagcaagtagttgtgattatatttaaagcacctagccctgtgcttggcatatggcaggccttaataaatacccaagtcttcctgcttttaatcatcagacttagactctgggtgtgaactaaggtagctctgtgggcacacagggattttggtaaacagaaaaagaagtcagcagctgaggtaggggtggttcacagtcttgcttgtggttcaacagggactgcatttatgaaaatggcaagtgagcccagggcaattggaactttgggccttgccagcaagtgtggtatttcagtttacatcctcagagtaagtacaatttcaccattattccattgaggctctccttgccaagaaaaacccattgtaaatttctggtttaaaggttctgcagttttagggagttgtactttttgttgctttaacattttcttggcaccacacattttaagctgcactggcttaccttgtaaatagtatacacattttgtgaaaagctgaaccacgtcatttgttttcctatgttccttatgggaaatggtgatgcttctgccccactagttcccctgggtttctgatcaggcagtttggagtgagaaaatgagactgagacaaaatatagattgtcagcaagagattggagctgtattcacaaaagcactttgtggacatggtagagccaggcaggagagaaaagtctgtggccggcagggtgtctgtgtgacgtggacccattgtgtgtatgggctcctcccgctgtaccagtggccagctcccagccaggccacccgggcgagggcctctgaagcagagagccctgcacagtctggagccgctctaacccagtgtactgaataggactccaaagaataggagctgtgttccctttgtcacctgcaaccctgctttcagcctgcacagtgaatgtgcacttgggggctgaattggcacttggaaaaatctgcaggaactttgtgtgtgcacagcgtgtgcccagcggtatgggcgaatggagcgtgcacgctggagatgtctgggggctgggtgcttgcagaggagggctgacctctttatgctgcagggtttgccaagaatgctccgcccttgacagtgttgtggccaacagaaaagcattcgtggcatcttaatgaaaggcagcagttccttttttcaagaatgataggcattcttttcttgagcgaggtccccatttagggatggagagagaagccaattatttttcagttaaaatttattttttaaaatagtgatgcctcagttgtaaattaccctggctttgccatgaagacatttacagctagccttctgacttggttttaagttgctgccttgtagaataataaaatagtagcccaaactgtgataaggcatcaaagactttcatatcctatctgtgtagctgatgtgcgttgctccatagctagaaaatggatatattttctgaaagggaatgggtgtatttccctttaccttgcagcttgcacataatcgaacacttcttttattgaaattgggggttttctcccttggacttaataaggagatatagatatctatatatctatatatctatatctccttaagagggagtttcataagttcaaaagttgtcaggttgaaaggattgaggtattggaaacaacaatcttaaagttacctttggaatgatagatctttgaaaaaaacaggtagtttatagtacattggaggaaatgctctgttgttttgcatcttctccaggcctctttatgactactttttttttgagatggagtctcactctgtcgccagactggagtgcagtggcatgatctcagctcactgcaacctccgcctcccaggttcaagtgattctcctgcctcagcctcccaagtagctgagactacaggcacatgccaccatgcccagctaatttttgtatttttagtagagacagggtttcaccatgttggccaggctggtctcgaacccttgacctcgtgatccacctgccttggcctcccaaagtgctgggattacaggtgtgactacttttttaaatgcttcaatgaaacttaacatgatgacctacacatttcagctgcgcatatgttctacctgttaatggtgagatacaacagagccatctttgactacttcacgctgtttactctaagaggcctgtatcattagatgacttcctgttggaagcagtaatttgtgtttggacttgggtgactgtcagtatgaatctagccaagaaaggtcatgtcacctgctacacagtttgctagagggaatacaggccaagccttttgcctctgaaatcaaagtactgtagaaggtgtaatagaaatgatgcctaggtttgtgtattcagggcctgagtttctgattaaagctgttaacaatgggggcaagctttccccgtgggagacaggcttcttggatctaaacctttctgacatctcaaagctttatttcctgatgatttctaaaagggaaggagccagccccttgaaattaaaatatcgacttacattccgttctccccagacggaagaatattagcagattgaatcagttggggttagtactttcttttatgtgttaaactcagttattctggctaagatcagatttttgtctaggacggagctgaaacacatgcggaatcttgttggttgagggctggaaacgaaggttggcttcacacaggttgcttctccaaaccgtaggtaagctcttcggccccgtgcacagcattcacagctgctgtctgctgcgctttcttgctccatcctgtctagtctcagaagtttcatggtactaatatcttggatccttacaaaggactgacttttgacccagttgactgataactatagagtactttacagtttaccaagagctttccttcatgtttgctctttacatcaaaattacaagatgggttttattatccacattctttttgtagatatgagggccagagaggttatgagttagccaaagtctatccagtaattgacagagccaagattctaggctgggacatctgattccaaatctactgctcttcatgctcctttatactgcagctacttacctgctcaaagtatgtcattcactcattcgttcagcaagttcttggtggcatgggctttgaagccagacagctgggtcccagtatctgctcactagctttgtgacctctgttacctcttggaacctcagttctttcatcagcaaaatgaagatagtaatagtacctatctaggaaggctgttgtggagtcctttaaacagtgctctggacatagcaaatactccataaatgtttgccattcttcttcatcatgggctcactcagtggtacagggactccacaccagtgacagcactgctgttgaggatcacttgttctgatgcaaatatgaaaatagaagactgacaattgcatagtaaagggattgctaagatataagcaggatgctggggaagcttgaaggatgaacagctgtgttttcgattgccaagaactcggctctctagcagctcacccttgttgcctctacccctatttggtcacattcctgtcttactcattccttgctgaaggcagtatttaatgtgcaggggttttatgggtactttgtgtataacctctttgaggaggaagagaaggagagtatgtctggctaagggaaccttagtggtcatttgggattataagacctatatttaacagttggaggactgttcaagacaaaatagattccaaggttctggtgtgcagtgttctgtctgagcaccacaggatatcatatgtgagtggcttccagtgggttgctgagggaggggactttgtgggggaagtaggccttgagttggacctgaaagaaatgaggatttggattatgagtagcagaagcgtggagagctgggcagaggtggagttatgatatttaaaccatggcctgccttgggtggcgggacagccctgcccggggatgtgggtggtccaggaggcaggtgctgtcccctcctgcatgagaacctgcctctggaccccaacaggatgcacacagcttatccccaccctctgcaaagctacctaataatatctttgtgtttatggtaatgttttttgctgatttggtgggagataaaacctagagagacccacagcatggatgctaggtctgagtgggtctgtgagctgcaacctagctgcagcccctttgtttgtgagctgtttgcctgcatttaaatgccatttacataaggagctgtcagagttgagttggcccatgattattccttgatgtatgttgaaaaaagagaagaaaagaaaaccctggctaatgaggagctgggttccttttctccattgatgacagcttcctttctgatctgatggtccgtcagaaactaaggtggtgtgtgactgtggggttatgtccccgctgaagccgtcttttcctcagagttgtaattgatggggagacctgtcacttgttatgctgatgctgtgcagatttttgtgcagctgccagccaagagagttgtaggacagcatctgattgggtgcaggttgtggcaaaaatgataataaatagagagctggtgagggtagattttgattgacccgagattgtatattattaaactggagtctgcatgtacatgtcagtttatgaagaaccagacccataatccaactttaggactgtggcagttcgggtttattaaatgtgctttatatcactattaatattgaggagcaaagaggaatatctgtaatcttttaatctatgcaataatggtttggagggagattaccagatacattggactattgtttgtctataattgtattcagaactctccgaagcattgatttgtttctggcatgctgatttggctcagcagtctcataaagctcttttatagtcctctttgctttgtgttttccaaaaataattggagaataataataatgtggctggcgataaagaagagagagtaaggttgaaagcaaatttctagccgagtggatagccataaacatcttctatgctcataaacacctgggtctgtgacctttgtgtttataagatatttatcgcctcatgggctctctgtttgggggttaccacttcagtgccttgtaaaatttgattgtgtttagtaagtagattctgaatttttgctgagtagggaaaaagtgcccctcacctttgttttctttggaacaaccaatctgccaagaggggcagatctcaccaaggacaggagcagagagcttgggtgtgcctgagttttgtggaaatggtacagtgggacccagtaagggtatcttttgtacttgattaagtggcttgtgatggaaatgacttttgaacggaagggaattgtgcaacacatcaaataaactcaagcagtgtcgatgggttttccttttccagtagaaatggaatttttgattcaagtcgaggaagctttcttgggatttggatttttgccacttcctcaccctttcttcccatttccaaaacaggcctgaggaaatgagccagagaaatggtcaaattcagtttcattgactttaatacgaaggtatgactaagtgctgcaaaagcacagttgtcttctatcttcagcagtcctctaaacatttcttggggaagttttaggcactttgtcaacctctattgtcctcctgatggtgttgcttaattactcttgaaggaaacagttggattcctgtgaactgatgacaggtgtatgctgagctgcctgtgtaaactattggctgcctgttcatgttgtgcacagtggatcagaggcatatgggagaatgtgccaaaacgggaatcttaagggagttttttaaaaagtaaaaattgtttgcttttttgctgtggtgcgaacatggctcacttccgccttgacgtgctgagctcaagtgatcttcctgtgtcagcttcccaaatagctgggaccataggcacatgccactgagcctggctaattttagtgtatttttgcagagacagggtcccactatgttgcctaagtgggctcaagtgattctctgtgccttccaaatcattaggaatacaggcctgagccactgggcccagcccccagtaagctttattataactcaactagcttcattataactaaagtatgagccagtcttgaggtgtataggacctatatttatcaaaggagactgttctacctaagacttagtttcttgtcctatgaggttaattgctgctgcatttcatggagtttatgagatgtgcttccctctgcccttcttcaatcagatggtactgcctgggagtcatatacatgcaggactgataaagagcggctcccacagtggcagtacctacagtggactgtgctgtaggtaaagggaagctccatcacactggcatgtgggaactggactaaaaggccacgaatcccccaacacttactctctgcccagctttgtgaaatacaaaataattatgagttccagactccagagatgctttccacctagttggggaaggagaagtttaggtcagtggttctctaagttggtccccagacaaggagcaccctaattctctggggatttgttagaattgcagattttggggcatcgcccagactaacagaattggaaaccatggatggtgttttacaaactctgcaggtgattcagatttatgctaaagtttgacaactcctgctttaggttcatcagttccagggggaataaatgagtaaacaaggcacatagaattaagggcttcctatagggcacagcgaaggagagaataaggtgctttatagcaggatgctaagctggactgtcaatcatgtgggaaaggggtcaaagactggaagagcagggatcatcaaggcagtgtttgctggggagagaagttattgagccaggttttgaggactgaataggagagaaagaggtagagtagcatgaatgagctcagatgtgatagggagggttctgttccttcaagagcttagttaagtgtagtgaaaacacacacacactccggacaagaaaaattaatgtaaaatcaactatagaacttaggcaggtttatgaagaagaaaatatattcctcacaagttggattcctgtgagttcatctcttttattacctctggcaatggtgcaattaattggggccagggctctgcacctggaaaggctttataacgtgagattctcaagaggaagattttatttgcctaaggctactactttaaaagtgagagaggcactcatgaaaattaggggtaactgtaaaaagtgataagctgctcaacatagattcagtgcccagtatgtataaagtgctgtgtgtatactggagagagggaactggaatctaacttggggatgggggtggatccagaggagtagagatatgaagaaatacacatttaagtccagtaagtttttcatgcacctgtagtcctgagaggtgaagccagctggacgtcctgggtcgagtggggacttggagaacttttctgtcaagcaagaggattgtaaatgcaccaatcagcactctgtgtctagctaaaggattgtaaatgcaccaatcggcactctgtaaaatggaccagtcagtgctctgtaaaatggaccaatgagcaggacgtgggcagggacaaataagggaataaaagctggctaccccagccagcggtagcaatgcagcactgatccccttccatactgtggaagctttgttctttctctctttacaataaatcttgctgctgctcactcttagggtctgcaccacctttaagagctgcaacactcaccgcgagggtctgcagcttcattgctgaagtcagggaaaccatgaacccaccgggaaaaacaaacaactccagacgtgccacctttaagagctgtaacattcaccttgacgtccaaggcttcattcttgaagtcagtgagaccaagaacccaccagaaggaaccaactctggacacagtccaagctactccagaggctgaggtgagaggatcgattgagctcaggaggttgaggctgcagtgagctgtgattgcaccactgcactccagcctgggcgatagagtgagacagggtctccaaaaaaaaaaaaaaaaaaaaagtctagtaagtttttgttttcctttaaaggcagaggggagccactgaaggttattgagcagggaagtaacaagattagagttgtaatcatgaatctaattaaaaaatcagtgactggagggaagtagatgggttagaaggctagtctagttttaatactgtgaggcagatgagaagggcttgaactagcagagttctagaaaaatggtgatgtaagcaacaatagagtcatattagttaagggtgagagggaagaaatatttacaattcactgtggaccagccacttatgcctgtcattggtagagcttaaccatcacaattttagcaacacagagattgatttttatagaaggtccaaaggatatgtagcttggagacatattcaagatttgactcatgctgggtgttatggctcacacctgtagtggctcacagctacctggtaggtcaaggtgggaggactgtttgagcccaggaattgggaccagttgggcaacacagcaagatctcatctccaaaagcaaaagatttgattcaagcctgcctgcctgcaaagcctgtaccctttttgctctagattctagactttggcgaatagaatgatacattttgtttataattggacagttgttgatcttggcagaagtgttgactgctgggaggtgttaagagaaaggaaaaagcagcataagatatggaagtttgtttgatgaaactgtatctcaaagagtttaagagttttagcacaggacagatagaatcttgccccacccaagatgatggaagaacaaaacaaagtctgtgctgttttctttgttaaccagagttgagagtggagtccaatccaatatctgcctagtgggagtctcttgagtcctgatcccatgagatcatacatatggctgctactcctgttgtgaggaaggttgcaattttagaaataaacctggagcttttgaaggtcctatttattacttcagcccacttactgccgaggtccccatgttttgcaagtgacaaaaataaatctaaaatggaaaactagggagaaggtgagagaaagtgtccagagaaactggggactttgagttgtttggtctaagctacttatttgcatttttgtctccacttcctagcaagcatattggtacttagcaatggtgggaggaaggcagaactgtaaaaaaaacgaagtcatcattctatccttacacttgagtttcctttcagcaacctctctctcccttgtctttgtcccgtctcataacttaggcgtgatgtgctgctgtatctgccttgctgccttctcctgagtggaagctgcagctacagtgttggttattacacctggcaattagattgtgcaggacagtagttggctaggaatggcataaggttgcatgcctcgttaaatctgaactccactcagcatagactcttgtagaagcaagggggatttgtttaggtaaggagcccttgaaaggagcctgcttgttgaactgtatgttgagcagcagtgatgaaaagatgcctaaacatgtgtcccacagcagctacagtccatcagcattggacacattggtagatcacccctgctgttaacacaggtcttttcagcttactcgtttgtgtacttaactgttgagtgctcttttaattaggggcgactaacatcaaagtactatagttgtgccgggcctgctaatcaacaggtttcacttatactggggatcacttcagctttacaccaccattatcatgacattgatttttctgtgcacataaaaggaagcacttactgaatacaggaaaaaatcatgattgctaggtggaaaaaaaaacaaaaaaccagcaagaggaactcagttacccagggaaaatgtaaacgtttcatatgaacattgacagtgaaatggatttgatgagttttgaggtgattttgttagatactttgagagaaattgagaattctgtattccgaagagacagccggacttgaaactctagaggtatgattttgaccaagacctgaacttctctttgcctcagttttttcatctataaaatagggttagtaataataccaacctcactgagatattgtgaggattttgtgagatattgtgagattgaatgattagcttagtcactggatgtaagtactcaaattatagctattaataagtgtgatacggctgggcacggtggctcacgtctgtaatcccagcactgtgggaggccgaggtgggcgtatcacaaagtcaggagttcgagaccatcctggctaacacggtgaaaccccatctctactaaaaatacaaaaaattagtcgggcatggtggcacctgttgtcccagctactcaggaggctgaggcaggagaatggcgtgaacctgggaggcggagcttgcagtgagccgagatcgcgccaccgcactccagcctgggtgacagcgcgagattctgtctcaaaaaaaaaaaaataagtgtgatacttaatgtcataaatcattgttattatttctgagaactgatatcttgtggtccattgttgtggcagaagtataatttatataggaaccgaaaccagccctcgatttttttttttaatcgccgatcttggttgggcttcactatcattttcatcagcttcacaacccctcagttctgagaaccctccttgccatacaagccactggagtgtctgcgtttcctttctgtggacattgtcacctttcccttcattttggtaaggccatggaaacagagcaatcagataaaagacctgggcatttggcactttcattggccatacttctccttctggcttgagtttatatgtggtttggggtagttactggtgaaattgagctttgcagctgtctacttaatctgcatttcctgatctgctttggctggcaatcaaaagctgtatctatttcggagattgcgcaataagacttttaatgacaagttaaaagacaaagggttggtgggattgaaccttatgcagaaaatacttcactatacttcggtggctcctgtttactggtgattttgtgtggatagtaacttaaaatcaagaaacatttttgctaacatatttcctgggccattttagaaagaaatttctttatttagccagtaagtagagctttctttagcgtttacatagttatctttttaatattaatttttgcaatccatatgaatgaggccacatgtcctttaacaattttagacctcttctgttatgcattactgccatctgtcagtatgagagaaagcttcctggggcagaaggacttaaaacaatggttctcaaccctggggtcacattagaatcactggcagagcttttaagaaattttagtgcctgggccagttccagatacatagttgctctgggatggggcccaggcattgatgtttttaaaaaactccctaggtgattctagggtataactgggctgagaggctctcctccgaaagcactgtcttaatggaagaaccagtggcatgagaacagttctgctttttctcagcagtaaccttgttgtcttccattgcagtgctgattttgacaatggagccatgcggttgtatttgggtagcggtttggagggtaacaagtgtgtcttttgtatctctgaatcctctgcagccagtctagtgcctggcatatactagatgctcactatcctccacttcacttcttttggatgactaaataatggaatggagcccagatgtactagcctttttacttaatccctgagcctttctccttcagtggtccgtaagggagcaggtccacaagcatacacttttattgttccaggaggaggaagacgcccagcttcggaatgcttgaggcataaaactgatccttggttaagatcagcagaggcttgctgtgtgcaacataaattgtcaggtaaagaagcaattaacgtagtgccatttatttcctctttaagcatctagtccttatgagtgttgtggttctgcactccaactggaaacaggttctctattgccctgttttgctcttaaacacagacacctttttcagtcaagagaattagggccttttaaaaactcttctttctttcttttcctttttaggtagcccatattgaatcaggtcctgcagctatagttattcatgcagggagaattctatgaacacaggggagaatggcctgggagtttgataatttgttattttttggtttgtagattgagaagtatattaagtaaggataaccccttatagttagttagttattttatagttttcctgtccagaaggttttaatctctcacacggctgtggactggcaaagtaactaattattgtctccagtttatggataaaaaaatttaagatgcggcaaggttaagtgacctgcctaaggtgatagacctgggccttgaatccacagcttttgactgtaaatcccttcagtacactgagctttggatagtacttttgcttggattagaacaccctataaatgtgactaatggcatctcagggttctgtcctggctgtcatagttgaatcctttatttgcattgcatgtgcttgcttgtgtgtgtgcgtgtgcaactattaatattaagcatcttgccatttgcctctgtagagcacagttgatagacgggaatatacacttgatgtagtcaagagagtgtcatcttttattaagaattctgatcttgcctctccaaaatgcctactttcacttttagtctattgtaagtgtgaatatttgtgtgtggtattttattcctaggcaaggtgtttttctcagtctatgttgtgtgtctaggatgataatgttaaagcttaatatatttagttttggaagactacatttttctggggtggtttatgagttgttttccttcctccaacaaattattgagtgtctagtatgtgttctatgctgtctacctttacttccatctcaaggaagtctaggataaaaataacattgtttatctgtgaagggataaagagtcaacacccatttcatgtcagctctgtctttattaggcatttggctattgagctttctaatttcttgacttttgggagtgtttctcccagttaccagacaggtccagggtgggaaatgctttccttgggccccagaactagctcatggagaggtggttgtagcttctgggaattttgaaaagagccacacccaggaatctgcttggactatgtgttctttctgtcctgcctttactctcctcttttctccctcttataagcaaagcgtctttttgcttccttgcccccaatcccagagagactgttaacttatgtttgcatgtaaggagaacagtcagagttaaggatctcaaactcaggaaagtggtttttgtactcaagagctccctgtgtgtttgcgcagcacacttacctccatccaggatgcacttatcctgcgtagatggattgtaaccgtgatagagggggaaaaagaagaggggaaaaaaaaacccctaaaaaaaccctggattctgaagatggctgcagtatattcttcaatagaaatttgaagcatgaagtggattttagaacaccacatgaagctcttcttacttaaaacacaagaacttaaaacttggccaggggaaaggtgtagggaggtggagaaaagcactccttccatttaaggggaagtaagcacttgacttcatcaattgtggttaagataaacaaagcttatctttttggttggcatcagaaggggcatttaaagtctcatgaaatgagagaagggttgttctgttccttatttactgtacttgaacggagtcactgaaaaccttgatgggatgtctctatgactgctcattcctagttgtctgcagcactgtggccagtgaatatgctggttcccacagaggaaggcccacagcatggtttccttcctcttcttttaattttgcctcgtgtcttttgtagacgagagtgctctgcagtaattcttttgtagaaactgccatgcctcaaatcacattacataatacaggctggggaccagcattccgtgaggacttgatcaatgggttgggaaacaaggttgatagcattgctgtggaggagatgtcaatgcgaatttgtcagctcacctcacatccttgcttgcagaactttgattttatttaggtgttcacttccatgtggacttgagttcaggggggtacatcttgattagtctattccagtcattatatttctactccttgtcagtgatgggcttaggaaggtccaggtctggctggctggacatgaggggaaatcttgtgtgggcacttctagaaaacgtttccttgattttgatgaagagaagtataatttctatctggttgttgtctgcatgtggtgctttgaaattggcagttgccatctttgaaccgtgagccagcgtaagaggacaggcccacatgcaggggacagcaaagctgtacaaaagatagatactatctttgatgatattgtggagctgttgaattgatcagcctgagtccattccattttgggacttcttgttatgtgtgagaaagaaaaatcacgttttaactattttggctggattttctgtttccttcagtctagtgtattataactgataactatcttaccccattcatacaggatggtttgagataaaattagaaaatattggaaatgcttttacacaagtatgacacacacaattaacatagacattaacataaatattatattgtaatgtccagtgttctcatactttgcttccatatcacttctgctagcattttctccaaagcaaggggacaggccatgaggatgaaaaacagccatttaaaaactgtcttgggggttttcagtattctttctgtaagaattgacatgatacataactcctaaaacatagtataaggcaaaaattattctttcctgatgaacttgtatttcttcttattggaaagtggcaaataaaataatccagtataggaggcatcatgctacctgacttcaaactatactacaaggctacagtaaccaaaacagcatggtagtggtaccaaaacatacatatagatcaatggaacagaatagagacctcagaaataggaccacacatctaaaaccagctgatcttggacaaacttggccaaaacaagcaatggggaaaggattccctatttaataaatggtgctgggaaaactggctagccataggcagaaaactgaaactgaaccctttccttacactttatataaaaattaactcaagatggattaaagacttaaatataaaaccccaaaccataaaaaaccttgaagaaaacctaggcagtaccattcaggacataggcatggggcaaagattttaccatgaaatccccaaaagcaattgcaacaaaagctaaaatggacaaatgggatctaattaaactaaagagcttctgcacaacaaaagaaactatcatcagagtgaacaggcaaccaacagaatgggagaaatttttgcaatccatctgacaaaggtctaatgtccagaatttacaaggaacttaaacaaatttacaagaaaaaaacaccaccaccaaaaagtgggcagagggtatgaacagacacttctcaaaagaagacatttatgcggccaaaaaacatatgaaaaaaagcccaacatcactgatcattagagaaatgcaaatcaaaaccacaatgagatgtcatctcatgccaagtcagaatggccattattaaaaagtcaagaaacaacagatgctggagaggctgtggcgaaataggaacgcttttacactgttggtgggaatgtaaattagttcaaccattgtggaagacagtgtggcgattcctcaaggatctagaaccagaaatgccatttgacccagcaatctcattactgggtatatacctaaaggatcataaatcattctactataaagacacatgcacacatatgtttattgcaacactattcacgatagcaaagacagggaactaacccagatgcccatcagtgatagactggataaagaaatgtggtacatatacaccatggaatactgtgcagccacaaaaaggaatgagattatgtcctttacagggacatggatgaagctggaagccatcatcctcagcaaactaacacgggaacagaaaaccaaacagcgcatgttctcactcataagtgggagctggataaggagaaagcacagacacaaggagggtaataacacataccaggagcagtgtgggaggaggcaaggggaaggagagcgtcagaacaaatagctaatgcatgcagggcttaaaacctagatgatgggttgataggtgcagcaaaccaccatggcacacgtatacctatgattacataggtatacctgtacattctgcacatgtatcctggaactttaagttaaaaaataagtaaatacataaatacataaaaattcagtatgttttcttgttgtcttatttcaccaatgagctcagatccaactttaatggttaataacactttgtctaaaattcctaatatatcttctaatattttctagttggttttatttattttagttattttaacaacagtgagtgatctgtatcacatcctcctggaagtaccttggatttcattataactgaggaagcgtttgttatttgtttaaatgagtgtcccagatagcttgcaatggagcatatttatttgtttactctcttatccattcactacacatttattgagctcgtactaaaaattagccagacacttaaatcgttttctttggcttgattgtagagctcataaacaaaagtactaggaatttagaattgtagatcacagagcattagaataggggaaagtcatttttcattgttgagcctgaggagagtttcgaaggtgacttgaaggtattgatttgaggaatgccgatggttttcatcttcttttcccatcactaaactaagtatactcccttcagaggtagagagccaggagacctttatagtagtgaaaggacaggaaaggaaggctttcatagacagcctggtactggagtcagtattcaacagtgaaattctggggtatagaaaatagttaatttatatactttaattcccacctgatccccactccccaagaaggttggaatccttgtttttcctccttttggaatttgctactttgaagggtttttttcttttgaaggaataagaacagtctgttcattgtgctatttagtgcaattagaattagggagcaatatttgttctgtgagttatctaccctgacagaagctctgatagaagctcagaatagttaactgccctcatagaggcttggggcatcattgctggaaatgagatgcctaactccaggacttcatcctgtggactgcagaattaaacggaaccaaagaaaataagcaacaaaaaacagttggaacagcttctcagtggacttactgctgccagtcttggtggggaagcaccagtgcttcttggactctggctactttgatcttcccagggtgctggagaacctggaaggacccaggttgtctctcctatgtccactgtaagccttggtaagaagcatgaaccttctgtaagccaggacccaactgaccttttaagatttttttttttttttaatcatctgaacatgctatgccgttgtcttggcattgctttgatcccagatgtctcagttttaaagagcacctacactaagtggcaaggagaaattagaattatccatattgatgatgaaaaataaacctcagagggcttccaattgcaccctaattcttctcccttaggatattgagagagtgaggtgtagaatttaaagttaaaaaattttacatcactttacttaataattgaaagttacttggctttggcccttggcatgatttaaatcacaatggatttgagagatgctttgtcattgacttaattttcagggttttaactcattcagtaagttggcttggcagccctaagcagcattagtattttgtgtgacattttcaaaatatcctttgaacctatggtaatccctaaggcagccatgttctaaaactcagagaaggacctccccaggggcttgaaatacctgtgtttcctcccctcaccgacaaccccctaccctgctccccatagcaatgttttgaggttgtgtgatctggatctgggttgaactcctgcagcgttttaaaccttttgtttctttcttctttaataacaacagtgtttcttaccctggtcatctattgagaagtgtaggtgaaagtaagcatcaacagaatggtgattttgaatatgggaatgggttcttgggagccactgatgtacctatagggactggggatatgattggtagttctagaatgacgttgcagttgctctatacatgacccatcacgtggaagatcctgacctcagcagcacacagcaagcatgtaatagctgcagagaataatgctgagcactagtcaactggtaagcattacagactcccctgcttctctctcccatgggtcaactggtgttgaataacagggagactagtactttggacatttttacctactgaagttgactcatgctgttcctttagaaggctaataaatttttggtgattaactgaataaattaacaacaggctaagagaataattacagacctatttaggaaatctagttcttggttttgcttggagattcttgccagaactttaccttgtaagttagatatttttacctgttgcttctcagaaaaacctacaagcatactcttaggtttataccttctatccctaacaacaacaaaaacattaactgtaaactgcctcctgttatctgagggtaaagtcgtaaaaatcaaagaggaattttgaggagaaagtcttggtaacagaaaatactaattagttgtctgtgttgtgagatgtgttgcttgagagtgtctgagcttcagagaatgtataatttccctccttgatgtccacaaggagcttctaggatactttattaaaagacgagtaatcagttattattcttcgtaggtatatctcaaactgcagctttaaacagaatcaactagagggctttgttacaatacagattgctggactccactcctggtggtatggtaggtctggaaaagggcctgagaattaaaatttttaggtcctccagtgatgtctaggttaccggtccgggaaccacccattaagaatcactgttgtatctggtcctctgcctctttctgcacatcttatatccatgcagcaggtatgaaaatgagctccccaaaagcattcaccttcactgttgacctgattattatataattataattggatctcaaccttttaaaaggccaatcgtatctgaactacatattaattataaatcttagtgaaagctctattatattatctcaatttttttttcttttgagatggagtctcactctgttgcccaggctggaatgcactggtgtgatcttggctcactgcaacctcgtctcctgggttcaagcgattctcatgccttagcctcctgagtagctgggattatagatgtccaccaccacgcccagctaatttttgtacttttattagagtcggggtttcgccatattggccaggctggtttcaaactcctaacctcaggtgatccgcctgccttggcctcccaaagtgctgggattacaggtgtaagccactgcgcccggcaattatcctgatatttgatcctgaaaaatcttgcttgaacttgaaacttgtcctagaatgtctttgaaaagttcatattccgataagtgtattacattctacaacaattatgctaaaaggttacttcacagaaaattatatccacactcatgatagaatcatttggaagtttaaaaaatatggtcatggttggactccatccaagactgattgaatatgaccctctgggattgggcaccaagtaatatacaattttgaaaaatttccaagggattttaatgggcagctaggtcatgaaccactgcgataggccttggagagggaggggagcagcagggctctggtaagtcctttacacttgctttaacctgctgctctttccccttcccactgttaaactcccctgcacctctacgtcactcttctttacaggctggctagcgtcatcacattgtaggtcgttttctgtgggcttaggaaaacagtccaacagactgttaccctagtgcgtgcaatgaaaggcctttattcttagggttcaaattattttacaacgaaattgtttagtttggagcctagccagtttcatctcttctatactccaggttgatcttctgttttagatggtgttcctcactctgccttcttcacctgaataaaggaaaggcaggcaatgtttccagagctcctgagccacccttagtgctggaggcaggtttaggaaagagctggctccctcattgctaaacagaattaatgttgttcaatcactttattctggctctgtgaaataatacacaggaggaattgctgctttatgactttaatctgataaactacctgctctggtgtgttacattctgtgtgtgtttctctgccaccactgcagaataatctcagccttatgtgtagcaactagaatgcaaggttcaaaactcaaaccaagccttgatgcagacgtcaaataagaactactttagaatgctctgtgataatgctaggcacttagcatgactgctggggctcctaaaaggagccaggaagcagcagagcctgagaatcctataacatttccttttgagcttgggcctgaagcagccaaatgctgtaaccaaataaaagccagtttaccttttgcttttcttatgtcttcttttcttgttctcgtcttataaattatgttcacacttttccttttttcttttccattcatgcctttcctccgttttctctgtactccatgcatctgccgcctgtctgcttgcttggtttttcttctgtgttctctcagcttttcacttttggaagagtcaggaatcttgtatattttgagaattagcgaaacatcgtgggtatttatccaaagtggaccttgtacagtctcttttatgctcgtttttaatctcaccaatttctagaatctcactaatttctaggtttgttaagggacaacatggtgtattgctggagatcaagacacaaagagtaacagagcctcagagctcattaatggtggtctgaaacaaggaaaggagaattaaaataatgtccttaacccaggacataagagatacagatagagagatggcaaaatccatggcatatctgtgacggttttctttttttgtagaaaatatcataaatagatcttagaactctgatcttctgatttttcttaacacagtactctagggagaggccactagacaagatgaatcccatcactgttagtgggagcttagagggaattttaggtgagggaaaatacggagataaatgccatcttttgagataggtcttttgattcagtgttgaagatttgtgtcaagagactcccaaaccataatagatattgcaggccttccctttactgcctgttaacccaggcatgtgacaagagcaagatttctagagattgccatagaggaagaataatttcagtgactttgggaaagcctgaagactgatttagggtgaaaggcacatgtcattaaagagtttcattatagattgctggttttattaggaggtaagtggttggagacattcgtttcctggaatcatgtaggacatttaaagtgttgaatgctatatacaacaccccagaggtgaagaagatgtttatcaatttaggtgcacagatgtcagtctgattattgggaagagggtgaagaggtttgacagtatcagagtatggacacatttgagcagcagcagctcattgtcctagaacgaattgcctcctggccgtgatttattgacatagctgatggagggactcagcagaagccaccatttatctgtttcttcagttgaccattggaaagccttacaaaattatgtgcgtgagaaatgtcaaagtgacagatttgggttcaaaagattgtacacttttatacatccaccctttgcccttctttttggacttgagtattttagacaaaactaacattttcttcagcttagtataaacagatttctgctcagattagctgagaaggcatacaccatgttatccttttatggatgagtgatacatgtgatgtctttgtcaaataggaattgccctctgccttgtgtgtttggagagatgactggccacacctctgaagcaatcagctgtggccaaattaacataatatggtacctgtacataaaactaaatatagaacaattttatctttttgtagtaaggatactatattccgaagaattcatgtaagttgaattatttaaagtggatttagggacattcattgtaaagttaatctttggtaaatccttgtgtggtgattttttttctctcctcttttgcatccccatttgaaagcccacaatttaatctatttgggtaaggtagattcttatgtgattaaatcactccagtttatacgcattgaggagtaaagtcaccagactaaactcctcaggaacaatgacagagagttttgccatgggtgtttgggaaaactgcatttactttctgcacacttaaactctgtttcagtccacatatttgcacgcctaaaaaaattaacaaattttcacagtaacaatgatactagcgtttacttattgctcaaaagaggtattgaccgctatagtgtgtgtgaagttggaaactttaggatgatagccatagtttgtacttcgagctcactctagtgggggaaatagacaagaaaacccataattagtacacagtaaatgttaggtatatttctcatgtgaatgtgtgcagtatggtaactgctcgttagaggggaccctatagaattgattacctataagagaccttgactgcgcttgggatagttaaggaaggcttcatgaaatagcgacaaatcagggttagctcctggcctgggatgatggctaaaaggactaaagggcgagtctttgcctcagtttcttatttgaaaatgaggataataataatccaactttatagagattattatgaggattctgtgaaacaaatgcacatagatagttaggcagtcctggtaattgggaagacatcaataatgatgtaagttatccatgtccctagtcctttatttcttacaacaacaatcctttcaagacagtagtactttccctattttgaagatgctcagagaggttaatttgcccaaggttacccagctagaacttggtagggttcagctttgaatctagacgtctctctcctggttaccttttgttctctttatgctactcagggggcccaaaatgattccagctgcttcctgcttcattatccccctaagtgccccactgagaggagtctacaattgcctgcccctcctctccctgcctcctggtcttgccatgagtcactgctgagccatttgtgtcagagaggaaaatgggggcttgctattcacatgtagcaatttgctatgtgttcttgcttatttgccagggacaccagcagagaagcgttcatcaagaggcgtcatgtttgttaagggaccacatggtgtattttaaaagctcttaactctctctggtatcatcgattatgctttagcataagaaataaagtgacactgagcctcttattaataatacacgttttccatttaactttgactggttaaatctggcataaaatgcagacttgcaaaccagcctccctgggatgtgtagcttctcttaggctatttatgatgcggatctctgttgagcagcagcctctgcctgcagctaaggctctggactagatgttctcttttccttttctctcttgatggcatggattgttttgtttcacaaggctcatgttctagatgggattgtagctggtctactacaagctggtctagttgggattgtagattggtatggataaatactgaaatgggagctggtatctgacaactggaggggttatatatgtgcccccatattctgatcaagctttggcattttgtgcatttggcaaaagtcagtggtcaatatttgaagtttgcatgaagttagaagaattttgggctctgaatatgagatgacttagagataatatgtttattttacagataaagaatcaggcctaaagcgattgatgatgatgatgatgatgatagcagaatctctaacaatggttaagccagacactgttcagagtgatttttgtgttaacttgcttgatcttcacaatgactctgtcaggtagacagtattattatccctgttttacaagtgaggaaactgaggcacagagagtttcagtcatttgcccaagccacatagctggcaggtgatagagctggggtttgtacccaggctatctggatccatcaaaacctttgctatctgtgtatcactacactgtagcttgtccagagttacaaagctgggcaggaatagtccaggacccaaatcccagtcttttgttggctgaactatatttgttatttaaagattcttttagcagtggaactcttctttaaatggagatattactagatagcacaaccaaataaaaaaagtggaaacttagctgctgtggtttaagtgggataggccaggcattgaccatgcattccctttattcagcccttgctgtggcttctgagaaagccacatggagcatagttttattttatttattttaatttttagtccctacaacaagactcacagtagggatatgattttaaaccctggctctagttagggatatgagctccagattgctctcttttgggtcacaattaaaatcctaaccggcaacagatatttttggtcagatctggtcattctctctgcctccgtacccattgggggcaaactatgaagcttttgtagctgcattattgtagatttgcaggatttctgttcgtaatcagaatcgggtatgtgttagaaaaaggccttcctgagtgtatgaacccctttgcctgctgacagtctctgggctggagttaacattaacatctgcatgcccagaggacagtgaattgctaacttttcactggctttctttttgcttggacattttacagtgctccagggtcatcattctgggcagtacttaccttgtaagtacctgattttggctcttttctcactcactagtctgtgatctagtcttctctctgtgtctgcagagttcagtcccatttctggagcaaagcagtagctcagtaaatgtcagtggagttttttgaatcactttttattattccagattataggcatatatgtatagatcaagtaggctgaatatgacttaatccccaagtttcttctataataggaccttattttatctctccaagtaatggaataaagggatggaagctggtctagttggggttgtagatttataaacaagacattaatctgaagcttatattcttttagagagttacaagaaaacccaagatctccccccatccccaattaaacactttgttctttgtaaggatagtagagtagtaggagtgggggtattcaggaaagcaggtcttaaggcagaagaatcacatcaacatcccaagttctattcctcactgcctcacgaatggtctgctagccacctgcagttgttgttgttgttgttgtcgtgttttgtaggtaaaggaaatatggcaggagagtgaagtataagaggtccaggagcttggtggaggtggaggagaggggggatggggaaagataaagaggcagataagaaacaggaatcattgtagaccagtggttttcagagtgtggtccctggaccaacagcttcagtgtcagctgggaacttattagaaaggcaaatttgctggtttcactctagacccagtgagtcaggaactctgatgggggtgggcagcgtctttgaaaacctttacttcactaactttttccccctctatcttaaatattcccaattgttttaggttttagttgattcccatattatacttcaattgtgtgtcagtgagtaggtctgtattaaaggagaactgttgaggaaacataaagaaatctctttgtattccaaaaagcgtttctcagagttaaattacatgttttgttagtgtctgttgcttttgttcagattaagctctgaaacaaaattaagattctcgtcaaggcttgagcttattaatagctgtttcatttgtttagcgctaatttaaaatgtctgatatctgtagaggaagtgctttataaaaacacatacttgttaagtgttccactaggagaagcactgtgaagtccaaaggatgtggagattaggcaaataactgtggttttgttgagctctcttcagtgtaatatatgtgtgggtgggataagaacactgggcttcacaggtcgaagaggcttccactggtcagatttcagacaatttgtgcattcaagagaattactgcaactgagtgtaaaacactgaacaaataaaaattcttgaactcatagtgatgagagatggggtgggaggagagaaagagacagacagacactctgggcatcattggaggtgactatgatgtcaacttctcattctataaattgtaaattacatgaaacaaacaccctgtctttactgagaaactgtagttctttcatgattggtaagagaaacctctgctttacaaatggatgctaccaaataaaatatagaaggatacagaatatcagcatttgcatcctgcagtgaaaatttgaacaggcaagtgccgtcaatgcaaaactagttgaaagcatgttggggaacagaataatcttattagagaataacccacaaattaccagcaaaggggaaagtatacccttaacaatggcggtcaccaccttaacaaagtggttcaacttagcatcacagtggtaggatagcctgacagtaggagcttcctgatgtgacgaactacacagcatcaccaacaatttatgccaaaaatgtttaacctgaatctaaccaggtgtattaggctgttcttgcatggctatagagaaatgactgacactgagtaatttataaggaaaagaagtttaattggctcatggttttgcaggctttgcaggaagcatggtgctggcatctgctcagcttctagaaggaggagaggggttggcacatcacatgacgaaagcaggagcaagcaagagagagtgtgggggaggtgccacatacttttaaatgaccagatctttcaagaactcactatcacaaagacagcaccaagccatgaaggatccactctcatgatccaaacacctcccaccaccagcattggggattacaattcaacatcaggtttgggcagggacagatatccaaactataacacaaggtttacagaaaatagaagggtttgaaaaacaaattaatccacaccaggaagaaacagaccaaaaatgtgggtcattctcaagaaaactggtatgtctgatcttttcaaaaagccagtgtcgtgaaacaaattgctggtgggtattactccggattacaagagactaagggaacataacagtcaaattcagtgtacaaatcttgatgggatctggcttaaaaattataactgctgtaaaagatgtttgaggcagttgtagaaatttgaatatggactggctatcagataacattaggaacttaatgtcttaggtgtgatagtattttggttgtgttaggaaaatatctttattcttaggagttgcttattaagtatttcatgaaagtatcatatctgcaattcactttcacatggttccatgagagagacgagtgcatagataaggtgattttggcaaagttttaacaattttgaatctaaatagtaggcatatgggtgtttgttttatatttatatttatattcagcatagagaaagctgtgaattcaggaaaagtttatatgtaatttctgagatttctagctcatgcatgcatttctgtttgagaatgccttatctagaattttttatcaagaaatctgaatggtgtttaagaatatcttatctagaaatatgttggcatcttaatattatggtttggtagataaaatggatttttttaaaaaaagacttgcaaagaagtggatgaaatgctaatataagaaaattagattttataaggaacatgtgaccagataaacttgtcctaattattgtgagtctctttaaagcacataccttaggacattgtgtgttgacgcttttactgttcataacatattctttaagaattctctcagagccttaagatgatttgtttttgagaaacatctgaagtctcctgtagcttattctgatgttatgaagtaagtgactaaattttgatcacagaagtgtgtgacagggaagtagtgggatattctttgcccctctttgtgtcctgtgatgctggtggaaatttcaaaggaagagtttcaaaagtagtttactttgttcaaactctctagccctaaaccatcagtgacaccagtgagtgtttcttattttacctatttgggtgtgttagatgtattttcactgggactattcttttggtcagagagcctaaagttaagtgtttgagcttctggtcctgtgatctcagcaactggacttgattcaggtgctttgactcaagggcacagtggtagcatcaccaaaaatagatgaatggcagcagatccctaatggctggctctctgctggttgcccgtctcagctcaggacttccgagaggtataaaacctcactgatagccaggcataatggctagggtttactcagagatgctgggggcttgagtgtagtattgctctgttgtaggctgataatggagtatgtgccaggtgggggcaggatggtatccaggcagtgtgggcaaagggctgcagttagtcccttgttacactcagtgacaggtgactctgagctgtctggaagtaagataaagtgattcaaggataggatccatacctgaaagagaggtattcagaatagcatttgaagtcaggtagacttcagctcttccaatggacctgcaagaggtggtcaggaaatatctcatagatgaattaaagaagtgttacatgaaaatgtaaaggggcaaaccaaataaaatgggttcattaggtcccaggactagtggaggggcattcatgttggaatggagagtagtgagaattggggaggggttgcataggggcttgttcttagggcagagtttttcaacaacaggtatatataagaggtcaaaatttaggaagtctgttagagaagattataaactccatgaggacaggagacatgtctgcattgttcaacactggatacttgatataatgcctggaaaatagtagatgtgcagtataaatttccgttgaatgagtaaaaatgttaagtggcgaataaaggaatgcatggggatgatacagacaaagcagtaatctgtggtggttgatggctgacctggttgtagagtaccagggggaatgtgaatattttagatttcctcagaggctagtttctgagatgttttgtttaccagtgtggtaaccttctcatggccctagctcaaatggtaatcaactagtctttgcagcacaactgtgaggtaaacatgctgtgtccattttagagaagaggaaactgagattcagagagatgaaggaatttgcatgaaggtccacaactaagaagataagatgtgaaactagatatttcagctcttgaatacaatcttctttttacttgagcgctcaatgctggggacagttctgcttttcaagtggcctgataaatagtatctttgtatcatgtgagagttattaagactgtgatagaaataaataaggaaaaattcacataccagccaatcctcgttactctgcttattcccctattcatcatttggctgattgaatactgaagatgataaagctgaatcggtagagcaatgtgtgattaaaaaaaaatctgctattccacttaatgggctacagttattagaaagaaatagaaaccccagttaatgttagtatgggctacttatttaggaaaggagatttttaaatgaaataagcctttcctttttattatattgctggagacagttttcatttttgcccacctggtacttaaatggttattgctataaggaaaccagtcttactgataaccgaatgaaataaattaaacagacacatgcaaacaaatccaaaatgtgcctgagaaagatgtggtcttctagctttcagtcattcagtgagacatttggcagagatgggtgcagcagataaaactgtcatggttttcagaagtcattccaagacaccagagaggaaacatgacagacactggaaagagaccctctttcagatatgagtaatatatattttatactcatattaatatttcattggagagaaggtcaaaatctacatttaaatggaaatatttaaaaagcagaagcataatatttgactaagtgaaacactcagggtttttcaagaacacaagctgcacccctgggacctcagctctctagatctgttgtttcttagagcacggtagaatgtttgaattcctttagttttatcggtagatcttagccctggcatttaggaatcttaatccctctactccccttccatttgaccccgaattgtgttacatactacctaacagtgtgttcagtgcacagtatggcctctctcagtcctataaaattatttaaatttctaaaaattcatttttctggtcctgtgaaatggacataataggattgtggagatggacataaataagatgctttcaattatgagtaatggaaaacccatctaacaaagtatggtggcaagaagatgggaataggaggcccagggtttattcagaggctgtgttcatccttcgtttccctctgctattcaaagtgtgttagaattcaccttcaggcttctgacctcatgattataagatggctgccattgtttcagaataatttcttcatggcatctaaaacaagaagatgggatgccaggagcaaaagaatcttcctggtacctttttcctcctttttatcagagaagatgatttttcctcaaagcctacagaagacttgcctttatgtctcattgaccagacttgggtcacattaccactccgttatccctgccctcaaactggcaaagagaatcaagaagaccttgattggcgtagatcactcatgcttgatttcctgaggctcgtctcattgcctctctcagaaacttggggctctatttttattagctaagaagggcaatggttattgtctgccacagtgatgctcttgtgtgaagtaaaggtgcataaaatgcatgtcttccctggactttagtgcatccttggtttgtaagtgactacgattacatgaatcagaaataaatcaggaaaaggaaagttggtaattttggcctattcctgcagaaatcatagcagggaggggagtgtttgtgaacgaagggagggtccagttctctaaagctgtgctggtgaactaccactgcatagggtggccctctgctgaccctagagcaagctggaggtgagacgagtttgtcaggacatcccagattctttcttctgtactctttcctcttctctgttttccaccaatccaatcaaaggcagtgctgatgtagtcagcacaactcctgggatgcaggtgcctggggctgcaattctgttctgacactgactgtggacattctggttctgggcagccacttgaggtaacaataatgatacacagttcctgcttttaagaggttcatgatgaggagcttcactgctcccctgttgctttatgacaggatgaggattcagactaaatgaccacttccctcttttctcactctcaagttttatgatttctttcaagtttatttgggattttttttttttggtctgtgccttttgttaatatattctacatgcattttgcttctaggcatattgatattcacaaagtttaccactgacagttgtagtctgagagtgtacagaaaaaaacgtagttgaccactctatgattattctggactctgtgactctcttaatgcaagccaagaccacattagcctttttggcagtcttattactttgtggcttttgttgggtttgcagtcatccagaatttctaagaacaatatttggaaggtggctttgcagagacttgagccactgaacttctcttgtcatgtgcttcctttacttcactcctttctttaatatatgcctggcattgggcccagaatccataatacgatattcataataaataccaacatcttttgagcactccctatgtgtcgggtgttacactaagtgctttacaggtattgtttcatttaatccccacagcaactttcttcccctttttctggagacagagtctccctctgtcgcccaggctggagtgcagtggcacaatcttggctcactacaatctccacctcttgggttcaagtaattctcatgcctcagccttctgagtagctgggattacaggtgtgtgccaccatgtccagctaatttttgtgtttttagtagagacagggtttcaccatgttggccaggctggtctcaaactcctggcctcaagtgatccgcctgccttggcctccaaagtgctgggattacaggcatgagccaccacacccggcccccacatcagctttctaatctaggtgttaataattcccattttacagatgagaaaacaatatggagcaagctaagtcatttgagcaaagttatatagtagcaggtggttgaggcaggactagaatctaggcaatctagtagcacagcccaggctcttaaccttgaaatgcaccttaaggcattttataaatttgtcttactttccttaatttttcccctctcccctaccccccagtacatgcataattgctttaaatattattacttgtcctgtctttcaagctggcttaatagaacatacgacgtagagatcaaaagttacagagtactaaagccgtagaataagagtttctttattcattaattcatcctttaattcctgattgactcagttcctgaggtattacactgagcgtgtggatagagagaggaaaaagacctagcattctgcctttgaggagttcacaaagtcatatggtaaatggtgggcctgagattcttgtcccgcagcaaattctgtcattctttgtagatcatggggaaaactttgcattttgctctaagtgtgctgagttcagagtgtaacatctactttgctccgccatagcctttaaaacaggattcatctctgagcctcagcaccagtacatctctgggaatctacctggccttcttcattatgtcctgcttccctgacctacatttttttcctttttcagattgatttgttgttcaaaaggccggtgcccctggaatgaggacctacaagcttacttttatactagaaaataaaagactagaagaatcaagcctttgctcagatcatactttgtgaggtgggcaagagtagaaagccgaacacttgaacgtgagagcgaggagggagccacagatgaaggttgaggacagagaaagggaagctggagggctctaaacttgcagaggcctgacctggcacttcatctgtcgcctctgaaaacagctctgctcttgctcttgctctattctcatccaagtactaggcgatcctccttttatcacttcccagtttcttcctttagtttcctctaaggtcattcctcctttgcactggatttactttggagtaacagttgttggtgggaggttctgattctgcagagagagaaactgaggcatgggatagagaacagccatctgtactttgtcctgtaagtcattagagactggcagagccttgtcatagatcccgtggtttgctgtaagccacaggtggccctcataccctcataggaatagggaccttcttccttccttaacatgattggattttgtttttacctgaaaatacgagctacttctaacagaaggaaagacgattgcagcctgtactgcattgcccctatctgtaaccccattaagaggttgtaaatagtactataatgatatctcagtcatttgttttgatgtatccaggcttttaataaatcagccgcagcttgcttaataggaatatgagagcagagcacgttgctgccagcagctgctagtaaattataaagcattcatctgttttacaagggaattaaatgtttgttctctttaaagggttttgactaaacaagggtgtgtgcgtgtgtgtttgtgtgtgtgtgcacacacacagtggcttcctgcccatgccctcccaggtacagtagcaacctcaggttcctggggaacacctgtaaccaaagccatatgaattagagtgcccccaggtaaaccctgtcattattggtctctgctctgcgtgcatctctaaagcaatatttgttggattacatttgtcttccacgtcaaaggattctgtgaaatacaagtcccatttcccgctttctcctttttttcttaagactgtctagggaaggagctttagataaactatacatccagcacaacattcaattgtctgcacaattgagttagcctactttatttgacttttatgtttacatttgaagtggactccccccgccccccgccaccaccttttcgacacccttggttttattgactaaataatcttcagaagacaagacatcagagttggtgcttttggtggaaattaaaccacagcaggtgtttcaagaccagctttggcaacactgcaagaccctgattctacaaaaataaaaaaaattagccagttgtggtggcgtgcgcctgtagtcccagctactggggaagctgaggcaagagcatcccctgagttcaggagtttgaggctgcagtgagctatgatcatatgactgcaccccagcctgggtgaaagagcaagattgtccaaaacaaaacaacaagacgtggggtccagctaaccaatattcaagagctgttggctacttatcttgtgaccttcaacaagttatataggtttttaaaatctattactttattttttgttacttttaaatttggaaataattgcagatttataggaggttgccaaaataatatagagagatccagggtgaccttcacctagtacaatatatgtgtatagctctatgtcgttctttgacatgtgtacattatgtaaccatcactgcagtaaaagcacagaactgtttcatcatcacgaagatctccctattgcttcctttttataacaacttctaccaccttccctatcctcccctccactgtcttacctcctggcaagtactaatctgccttccatctttataaattttattcatttaaaaattatataaatgttattacacatttgtatttatataaaatataaaatatatcacataaatatgaaaatatgaaatatatacattaaatcatacagtacatggctttttgaggttgactttttaaactcactgtaatgctatccatcaaccttgttgcttgcttttatgaatgtttattctttattactacctagtagtattccatggtgtggacacatcagagtttgtttaatcattcgcttattgaggaacattttgattctttttacttttgggctattataaataaagctgctaggaacaattatttacaggtgttttgtgtggaagtaaattttcatttctgtgggataaacactcaggattgtaattgctgagttttatagtgtttggtttttaagaaatgtcagacttggctgggcgcggtggctcacacctgtaatcccagcactttgggaggccgaggcgggtggatcacctgaggtcaggagattgagaccagcctggccaacatggtgaaaccccatctctactaaaaatacaaaaataaattagccgggcgtagtggcatgcgcctgtagtcccagctactcgggaggctgaggaaggagaatagcttgaacccaggaggcagaggttgcagtgagctgagattgcaccagtgtactccagtgcaacagggtgacactctgtctcaaaaaaacaaaaacaaaaacaaaaacaaaaaaacccggaggttgcagtgagcccggatcatgctactgcactccagcctgggcaacagagcgaaactctgtctcaaaaaaaaaaaaaaaaaaaaaaaaaaaaaaaaaaaaagtcagacttttccagagtgactgtaccattgtacattcccagcagcagtgtatgagggaatcagcatccttgccaggatttggaattgttgctgttttttaatatggctgttctgataggtgtgtaatgatatctcattgtgattaatttggatttccctaatggttagtgatggcagacatttttatgtgcttatttgccatttgtatgtcctctttgatgaaatgtctgttcatgtcttttgcccattcttttggattatttgacttttactgttaagttttgaaatgttctttatgtattctagatatcagtatcttgtctgatgtatggtttgcaaatattttctcagtctggagcttggcttttcattattataacaggatgctttgcagagcaaaggtttttaattttggtgaggtcaaatttatcagcattttattttatggagtatgcttttgatgtcatgtctaagaaactcttcaccaaacccataggtcctgaagattggctcctatgtcttcatcagaagcttaagctttacattttacatttaaatgtatgacccattttaaattaagttttgtgtaagtatgaggtttaggttgaggcttatttattttttgcctatgaataatctaattgcttcaacactgtttaaaaggcatttcttctaacattgaattgcttttggatcgttgtcaaatatcagttggccatagttttgtgggactgtttctaggttctctattctgtccgttgatctgcgtgtctgtcccttcgccagtcccttactgtattgattacagtataactatttagtaagttttgaaatcatatagagtgattcctcttactgtattcttttttgttaatagtttcaggtattctagtttctttccatgtaaatttttagaacaatcttgaacgtatttacaaaaattttgcagggattttgataggaattatgatgaatacttttatttttatgttttgtagagacagtgtctcgccatgttgctcaggctggtcttaaacacctggacacaagcaatccccccaccttcgcctcccaaagtgccaggattacaggcgtaagccactgcgcctggcccatatgtgaaatctgcatatcaattttgggagatttgatatctttgctatactgaactttcccatccatgaacactatatgcctttccttttatttagatcatctttgatttctttccatcagcaatttgtagtttttagcatacaggtcctatacatcttttgttagatttgcatctaaatatttcatttttctgagacattatacataacattgtaattttgattttgcttttcctgtgttcattgttagtatattgaaatacaatttgtttttgcatgttggtcttcaactttgcagagttgacttctaggagtttttatttagattttttgggatttttgtaagcatatcatctatacgagcatgtcatctataaacagggacagttttattatttactttctgatataccttttccttttattgccttattatgctggttggagcttcagtactatgctgaatagtggtagtgagagtggacatgcttgtcttgttccaaatctgaagtgaacaagcattaggtctttccctactaaatttgatgttagttgtaggtttttgggtagttgttctttgaagctgaggaaattcctttctattcttggtttttataaatatgtattgaatgcttttttgcatcaactatgatggattatgttgattggtttttgaatattgaaccagctttgcatccctggaataaatcccatttggtcaggatgtataattctttttatatattgctaaattttgtttactaatattttgttaaggacttttgtgtttataagaggtagtatgtgattttttttttctttgctggtatttttagggtaatagtagcttcataaaaattggaaagtgtctgctttccctgttttcttttcttttttttcgagacagaatctcactctggagtgagattcagattcagattcctaggctggagtgcagcggctcaatctctgctcactgcaacctccgcctcctgggctcaagcgattctcctgcctcagcctcctgagtagctgggattacaggtgcctgccaccatgcccggctaatttttgtatttttagtagagacagggtttcaccatgttggccaggctggtcttgaactcctgacctcagatgatccatccatctcagcctcccaaagtgctgggattataggtgtgagccaccgtgcccggcccctgcttttctaatgttatcatttattgctaaaagtttaccgttagtactgcttgtgtcccctaaacttggtatgttgtaatttcattttcattcagttcaggtcattgtttaagttattttgaggcttcctgtttgacccatagattatttgccagtgtgttttttagttcccaagtttttttagattttcctgttatctttctgttatttatgtctgcttttctttcattgtggtcagagaatacactgtatatgatttcagttcttttaaatttgctaaggtttgtattatatcccaggatatggtctatgttatttgttctgaggtcatttaaaaaaaaatgtggcttatgctttgttaagtgtagtgtgctataaatgtcagttagatcctagcctgttgatggcattgttgaaatcttttacatttgctgattttctgtctagttgctctatcaattaattgttgataaaggggcattttagtctccaactaccttttgtctatttctcttttcagttctgtcagtgtttgcttcacactttacaactccatttttttgccacaaatacatttgggattactatatttgcttgattgattgacttacatatcatttttaatgtccctctctgtttctactaattttctatgttctgaagtctacttattttattcatgtaggtactcctgttttcttttgactgttttcattgtatatatttttcatatttttactttttacatatatttatcattatacttgaagtgagtttatggatagcatatagttcatgcttttttattcattcaaccaatctgtattttaattggtatatttagtcactgtacctttaatgaaattattggtgtgttagaagacccaggcagctcatcactttgaagttccttgcatcctaaggtccctagcagttctgcctgttctctctaccttcaagaatcttttaatgttcatgttatatatataacacccaggaattgttttactgtacttagcagaaatgataggaaaagtacatctgttccatctttctggaactgcttctttacttttaaaattaaaaaaaattattgatacacctataccacaatattgctgtaagtgagatgaaagtgaaaaaggattcaacatttaaattctatttggacatcagttattatatctaagtgatatatgaaatcatgttgctctagaacaatattaacagattttatgaggttcccttataggaatgaaaatttatacgtgtactctttctttctctttgacaccactctacccttttctccttctctaacatattccattaagaaattttactcaaacttatgctttgcagttggaataccctaataccgattataagtcctgaatcatttattaagtaccttgtaattgcccagcactgtgctaccaatgcctttcagtgactttctaaattcaccctgttaggtataattatcttactgtgtagctgaggaaacagaggcttagagaagtcaagtgatttgctaaggtcacttagctagggagtgttaaaactgggacttgaatacaggtcttagagtttaaagttcatgctcttaacctttatgttttacttcctccctgtattctcttgtacttcatcaacctgaattctttagagctttttgatctgttgggacctagtttgaattcttaagcattttattatttttatttgcttcaatgaaaggtaaaagatataacctagattttatccattgctagtttcttttagtgccatagtggttttatctgtcagcgtgtctgtgtgtttcttaatgttcctagcaaaatttaagatgtgatctagtaactgtattcttccaattgattcatctttagtgtcactttaattttatttttgaaaaattaacgttatcttctcatttctctgttggagtgtgattgagtgattaattcagcaattatttatagagcctactgtgtgataattattgtgcgagatgctggggatattcagtaattatgtgtttctttgttcttgtaattgttctgtgactttagttacatctttcttcagaatctttcaattcacaagtcatctgtaagatttcactcattttctatttctagagtgtagtccagaaaccatatgtgtttgtgggagtttggtttaattttggggaagatattgatacttctaaagttaggtacaccatggtctactgtttacttttcaatgcaaatagagactttattgatgaatgctttccttctcaagtacatgttttgagattggtgaaaatctacagaaaacaaataattttaccccttacgctgaatgctgggaaaagaaagggtcttgtctataaattaagagcattacctatgagcttcacaatgtacgtgatggacctagtctgtgtaaaatgaagattctagaagcagaagaaaatggcttcaaaagcaaatcagaggttatagttcatggacaagctaagtactaaaccaatcttattgttgtgaaattaacattttctgttttatctctgtggtatcacggaattttattattggacaggctaatagagatctgtttgagcagcctattcattttatagacaagaaacctgacacctgtagaggtaaaatgacttttaaggccttttgtgatttagcctccaaacttgaagacctgggcccttgttactgtatcctctggactgcattttagtaatattttatcatttcattatagtctcatacttacccaatattcttcctttacagggtttcagttttctcaactcaagagagtagataaggcacttaatgtagttcatttctagttggagtctgtaaaggtttatgaattgctttgttaatccacgtcactttgtatcttagctttctagactttaaatgttggttgtagtccgtataactgccagacttaacttataatgaatgccttcaggtaggtagatatttgtttgtgtgtgttccgtaaagaacaaacaaggggctaagaattatcaactcttgctgtgagggccccttagccaggcttccaccctctgcctcttcagtcttagggacttgtcaaccaacttctgcttcagggcctcagggatggtgggtggtggggaccttaggttggctaattttaccatggcatgacttccatttttaagagttattttcttggattgagacacagttagcttgcctgtggcttccccgcagtgattcttctgagtggatggaataaatcaagtttctctgtgtttcctgactaaatattgcaggttgtttgtgccattcctcactttttggattttagataattcactattctacatgcttcattttttttatgtttcctcaggtgagccccaacttttaactgagtactttagaaataggctgagtcccaaggggtcagtggaactttcttgttccacctagcataggcctgaaacagaggctcagtcttgggactccttccttcagcctggaaggaagaagtgagggagaaaggaagaaagtgatcaccaaggcaggcctggtgcctagaagctgagctttgagaagcatactttagtaacgcattttctgtgtcctctcctcagttaactcgtctcttgaatctttattattaaaaattaacacctgaactggtaatctcagttcctgcggtccctctctgtatttcaactttacatcagccactttttttagtattataaacaggagatcttttagacccctaggcttccagttttgattggccgtcaccttctagctccctcatctcattacagactaagctggatgcattaactagttgcatagtcttggacaagtcacttaagtattctcagccttagtttcctcagttgtgcagtgggtctcctcacacctactcacttaagaaataaatgaaataatgtgtgtgagagagttttctgaacaagaaaatattagctaaatatcatctttccttgttgtacccttgtttctacaggacacagttggatcagcggattcagtgcttttcctgggatctcttacaggttccctccatgcttgttgcccttgactgatggtatattggaacatttgtacacagtggccttgaactatagtgggcacttgaaatggcaacattttgtattcttctaggaactactgtttttctttgaaaagccaggaatttcacggctccagaggaggggatgcagaagctatttctttttattttcccctgttaaatcagtataatgagattctatgtgcatagtaatccttaagctctttgcctagttccttttgccctaggcaccttggagtgatggaattgtagtcagtcagacatgtgcagtgtattcacacatacacttagagggctcctcgtctgctccccctagctaagcagcccctttgaaatgtctaataaaatccctgctcttgtgcgctgcattgaaacaaagcaggctcacgcagtcctggaaatgagccctgagaggtattatttctatatgtcggtctttatttgcctgttttgacagtgtcgtacaatgagggtcctgctgctgatgcagcagaatcacaaggagccgtctttgctgtgtaaattctccctcaaaggtctggcattcgacctgcctgctaaaccctctttgaaacaatgcaatgacaaaatattttcttcttactgataataggcagattataattgctataattgcttctacctcattctctgaagggaggaaagtagggctatggaatgagtgcttaaaatttttatttatcgtcttagagatatagatggttcatttattatacagaagtttacatagcagcctctaagtgtacgttgtttctcaatagttggaattaaattcgtacttttggactactgtttattaagacattcccgggaggctgaggcaggagaatggtgtgaacctgggaggcggaggttgcagtgagctgggtttgtgccactgcactccagactgggtgacagagtgagactccgtctcaaaaaaaaaaaaaagacattcctccttggtgatgaataacacctgtgtgccaaaaggatttttctcattggctctgattaaggggatatccagccaataaccgtagcaagccttagggtgaatttttggcaatctccaggtctagtcattgccttatgggcagtctgatggcaccttgggcattgtcttattgccctgagcacaggtgttaggggcatggagtctgatgagccgtgctctgctgtctacccccagtctgttctccagaccccctaaccaaacttctcatagaggtgaccatcacaaggacctggtgtgtggctagatcagtgacaatttatgaccacttctggggaaatagctcagagtgcacgtccttcgtgtggtaggtccaaaatattatctttgtatgttcaaagtagcataagctttagttgctgctgttggtttcaggagaatcacctggatgtcagtgccttggggttattaataatggtaaaaaaccagtatgagggtggagcttagaagtagaccaagacttgtgagtcatgcactgctttttaatttgcaagctaaataggtgctaaaactcacctaccctggctgctgagatagtcactttctcctggtcctcctctattgtaaagagaagaggttggacttaatgcccttcaaggtcttttctctctgactttctgtgaaactccaaggtgagtcctaaattttgttttggtctataaatttaaatgcttcccctgctgagctgctttgggctgagaatagaatggatggaatttacaccttctctctctctctgtcccatgtgatgctttgattggctgctaacagaagggaaggtggtcagaaggcaaggaagccttggcaaagaggaagaggagtgaaagtactaaagaataggaacaactgggggtcagccctggaataaaaaagacttcacagggcagttactaggcttgcctcactctttggaatcatgagaggtttgctaggtatgtactgtaaggcccgtgtggccagagactgagtcttggatttactctttttgccctgacattgccttgtgtagcactggatatcatgtaggtactaattatttcttctttacttaacttcctggaaaccgctgcaattgtcaagtgaatagaagtgaataggactgttatattaaacattatagagaagggtccatgctcacagcatcttcatcattccaaatattgtgcttgttgaagcagagaaccttgtcaggacagtcattgtaccaacatttacgaaatgaaagcaagagctattaaccactgtataagatttgaggatattgtgctttcaaaggaagcaaagagggtttaaaattactccagtgggatatctctttagcctcacttaaggattgtttaaaaggaaatagaaataaagattgtttcaaaagaaaaagaaataaagttagaggtgaatagatggtatatgtaagagctttatgttttggtcatactaagtttattgttaagttacaacaaaaaaattgttaactatcatgtctccagttttgcaggataattttcttttaatgtattccaaaaactgacctcagaatttgatgaagtgttagacaagatgacaaacagagagactgttagtaacgggcagaagtcattagtctcagactcatattcatttgtttgtggttattgattctagtcactcctattcttatctccatccaaaaataggcattaaaccctaatctcttgtggatgtttgctttgtagatttaggagaataagaacatgtgaccatacctggttagccatctcaagatttgttatgagctagttgacttcaagagccagtgagctgggttgtgcaggatacttgttactggataattctacttcagatagatgctctagttgctctgctaaaatcctctgttctgtcaagcctgtcagagccagagtgaaaaaacaaaacaaacaaaaacaacaacaacaaaaccctagtagagtacctgaactctaaattacagagtttaaggactgaaaatgaccttgaggatccagagtaggactctcaaactcacatgttcctggggtagacaggtagcagagtgaatgaattggacaactataagcaatgggggagactgaagagacattcaaatttagaaaattttaaggacattatacctgcctgacaaagaggtgtttttttttgttgttgttgttttttgttttattttctgtctctgatgcttgaatcaggaggacaaagagctctgatgctgattcagctgcaattttgaggacccttgaccctaactatcaggttatctatttctggtttaaggatgatgacctgagttacaggtaggaaaaggcatttaaccaaggagagacagctagtgagggctggagcctggggctctgaggtgtagtctgaggttctttctctacaccatggtgatatctgaaggggaaggcaggaacacctggatttcaatcagggatttaaaaaaaactttctatttttttagagaggtataattaacatacaatcaaatgtactcatcttaagggataacttgatatattcttatgtgtgtgtcctttcatgtcaccaccacccagatcatcccaagattctccttgtgctcttttccaacatcccccacacccctgcaccggaatcacaatttaccagggaaccatggcacttttccttccacttgcagagctggtccgtctgtcactggcccagttcctcccctcacctccctctcctcagattcaattgtaaagagctatagcaaacacaagggcacatgttgcttaatttttttttcccacataacccaacagaatcttgggtttctttaaagtaagctctctaattatgccaatgccattgactcaccaagtaggatgccaggtcccacagggtgtgtccttcacagggttctgagggtactgcttcttgcaatgtcaactgctttatacaaaagcatatttaaggtcacatgatatttgccaagttattaattattcggaggctacttttcctctgaaagaacttcagatgtccgatgtcatgattttattaaatcaaagacccatatttcattgtaatggacatggcactcaaaacctgggaatcgactcattgaaaatgtagccaacacaacactgaaaacaaagcccacctcacaggcaatgcagcttccttaaaaaaaatagctgattcccaggctgaagctgttaagcagatttttatgcagggcttcaagttactaaaaaagcaggattcaatatgcctttctctttgatttgtaggagggggtgggaagtaatgctgctgctctccccttacccccttcagaagggcttttaccatattctgaaagcaatgcttgaaggacccataaatggattttggctgtctcctagtgcagggattaacatagaattatagaagtgtgctgcatggtggttgggaaaatagggaggatgccattctctttttggagggacatggtgctcccgtctcttgcctgtggatgttccctataaagcagcctgtcactgtgaaaaatgcacacactgtaccatctcacagttataaaggttaagtaagcatcttgagcagtgccccactgcttttgtactttccataatgtcagccgataaaggattattgaaaaaggcttgcaaggagataaaaggcttgcaggttgaggttaaacaattgaaattttctgttcccagtgtagtaaattaccaatggcagatttaacgtttgttaattattagagcaaagtactaaggattgttttcttttgcctaattaattacctcatctggagtggaatgttaattcagataaatgattatttcttaatacctctgaagctttccttggaatctcctagaattgccagtcctgaagtgtggtttcctcacattctggggaagataggggataggtgaccaacgtgactactctcttggcctttttcccgtctcagaagatggcaggataacttgtttagacttttggtgatggagttggtttgctgttctagttagtagaacatgagtgtgcttcctggaatcctgtgcctcataaccaagtttttgagttagtctctcgtgtggttttgaatttaacattgaacattctttttacctttggtaattctcaatttggggcacctgccgtgaacattaaagatggtatcctttggaaaggacactctagtttcttaacttgctttttacctttaagttattttacctcctgatgtctgttcagaatgctagaggcaggtttttattctttcttggatctaaactatatcacctctaatagttgtgaatagataatattcaaaaaaggtaaaatcatgactcatgcagatataaaatatccacatgtcaaaaattttacttattttaaatgagggaaccagatagatgttacaacaggtaccaaggagaaatgaaagaaccacaaatttatatggaataaaggaaatgaaaacgaacccacaaatgaacacaaaacttttgggggagggttgttcctctaggggacagaatgtatttgcatagctatagacacttttcagagttgtaaaatcgcccagtcagacacaaaggtaagtgtccctgtaggatgagaccattttctgaaaggagggccattaatctcttttgcttttttttagggtcagaaacttccccttagacagttgtgtatgaggttttaatccagttacttaggatgacattgtatcttcaaagtagattagagatgaattatgtgacttatttttctttttagaaggaagcttaaaggtgacttggggagatgggctggtagatctgggccattggaggcgagctacaacccatgtgaccagttaccctgcacagtctctactcctgataaggcacttattttatgagcacttttcataatgatatgaaaaggcagcgggattctgtctaagattatctggagtgaaagctggaggctgatattaaatggatagtcctgttttcttttggtgctgccaagctgagctgtttaaaatgatgcttggaaaaatgcctcctgagccaggaagttgtctgattagtgaagagatttccgagacgtttggctcagagactaccccatcataccacacatgttcttttccacattcacctgagtcttccaaagatacgaggactcggggtggtgatagggtgtacattcttacatacacatatgtgtatatttgtatatacagtctgtctatccatgggttctgtattagttgattcagctaaccatgcatggaaagtatttgaagaagaaaaaaaggatgtttgattctgtactgaacatgtacagacttttgtccttctcattattccctaaacaatatagtataacaaccatttacataccatttaaattatattaggtattatgtaagtaatgtacagatgatttaaaacatatgggaggatgtgagtaggttatatgcaaattttacaaagggacttgagcattcgtggattttaggatcttgggggatgctggaaccaatcccccacagatacagcgggacaactgtattcatataaatatataggccagagattggctttaggggagtctgcaaagttccataattatatgcatttttcttaggcagtattgtgtctgtcagattctcatagtctccaaaagttttatgattcttcaaaagtttaagaactgcttacagaaaccatgcccccagtaattattctgaatctatgtgttaccacgtgtatgacttagaagaagtctagatgaaggttccacctaattacagaatccactgctgtagccacagctggattgagttatgtggcagccctgccccagagctggggaggctgcgtgtgtgcccctccacacctgagtacatcctgggtgtgctgaaatgaagcccagggagatacaaagcaccataatgccattaaggccagcacccgttgggtaggggagaggctgaccatacagacttctgacttctgcgtttcattccctgctctgaaacctgtccgtctctcaggcttgcaatctgccttcctgtctctctgacagacctgtgacttgggctatggttctgataccaggaaataatgcaggggtgggagtcttagtcccaagcaaaataaatcactgctcccattagacattacaatgtttaaacccaagtacatctgtctgccttcaaaaccaagatttagagcatgtcaagcaggtgccatgcctccaataacacatactttgttccaacatttagtagattactgtgagattttaaattcaaattctcagacattcactttgtttaggaaataactgcaataaagcaaattgtctcctgttctttttttccccctacggtgcagccaagtgagagcaaatcaattcctagtcaattttttgttgctgttttcctccatgctagagaagagatgatgcagctctctcctgttgcagccctgtgctgggtgtggttccctctccttaatttgtcatctgaaagcaattttgttcaattagagattagaattaaatttcagttgtagggcttctgtgcagaggaaatgatgcattaatgaacacacagatgtcatcttgcagccatgatgcttgcagaacagtttcttcaggattcaaataataaaaggggccacagcagcaggagcattgtttactggttggcatactaagtggaggctcacatttatttgcaaaccatttatcattctgtatactgagagggagaacatactttatttaaaatatttgaaataatgactcttaaaatcggataacagaagcattaatgccaggtgccatgcagtaaattgcataatgctgttgggttggcactgacactgtgatttgtgttgctaatgatctatccaaatagatgggagttgagaataaaaagagaatattcctggaaagagacaaggcaactagtgaattaaaagtgtagtgagaaagggaaaaaatgtgtaggatcgtattttacttattggaagacccatctgctcttctgtacacacattatgtaagtttcactctctgtattacaaataacctgcagggtggataggaagttcatatatctgccttcagctgtttttttcactcacagacgtgaatgaacagaaagatttatgtcttgtgtgttggatattataggatggtaggttttttttttttttttaagggcgttgtgtatttagactgtgatattctgtgcactgctttgcttgaagtgagtgatggctgcgactaagaaggcagcaagtggggagtgggagtttggggaggtggaaaagggtttctgtgagacaatattggtttgtctggtctttgggcctgggctacacacatgccctttgacacttatggttaaagtgtttatttccgaatggtgcccagagctatgttcagtgtgtcctgagtcactgttgaatttttaaaatttggtagtctctgtgctgtccagaatttcttagatgtgttttgaatacagagggctctcagtatcaggtggcatccacgctggtcattgatgttgacagggatgaaatctcacttaaaaccctctaatttcctagttcaaggactcttccttattcctcttcccctgttgcaaaaggaccctctgatgttggttaagggttaatagttctgtccttgaaatgttttctttctgcgacatcacatttttcttttgctttatccatatcttgtgccaaggccattctctttcattctcatttcctttttaacccctgtgtgtactgcatcaagtcctattttgctgtctcttcgaatttagagacatcatcagtgcatatcatccattatacaaaaaagccagtaatagcccaatttttatttcctgtccaaatttttctcctcaacttcatatccatatctctcttccagaaattttattagaagcacaatgtatctaggataaaatgtaccctctccctaactcttccttaccttttataatggtgcttacgttttccatgtcttcctacttaaaattgtattcatgtttgtagtcttctccctgacttcactgctcatgagttctacctttttcttgtctgttataagtcctttccttttcatttcttttgctacctgccttgtccagatcttccttacacatcacctgcaagtagctgatcatcctcttaactgatctggtagttaatggtgtcttttgctcccaagcctgcctagtcctctgctcatctacttatttctgcctactactccaaagccttcattggctccccattgcccaaaaatgaattccaaacctcccagtcctggtgattaagtagttccctcccatacccaaacaacccagccctgtcttttactaacttttccttataggtgtgtgttttgttctccctgttctcccctgtatgcctttcaaaaccctgtccttgctaaagcccagcttggatgccttttcttggaaaccttccatgattgcccccctggagtgtactttgttgctctaggtataaatgactactgcacttatgttaaggcacctgtcacatactgtaggtatttaaggacctcctctctctgctggatgatcatcattttgatagcatattccttttgttttcaacagagctttttctattaattttaaatgcaatatactgttgcaagtagtagttggaaaaaatcacagagcaagcaaagttctggaatacaatttttaggtcttcctcaacattcctgtcacagtagatgatgtacacttacagcagaagacgatggttagaaaggtaagagcctagggtctgagtcagcttcaactagaatgtgagaactgagatagaaggaattatttccaccttcccggggattttctagcatagcctatgggttgtggtttgcccagcaacaccttaatctagttgcttatgtttagtaagcatttacagcctgggttagccggctggggttcaagactcttggcctttaggccagtgcttgatgcttctgtcagcctggaaaaaggacccatgtatcactcagtggttctttagccaacttgagcaagtaaagaagtctaggaggcagaggtcttctgccagcttcagcctttaggattgttagggtgatgtggggcctgctctggtgtgtctcgtaaagaggatgaaggagcagtgagaattgtgtagactagcagtatcctttcatctgctttgttgtgagccagcttaggtggtcttttctctgctattaaaggggaattctgactccttgagttgatgagatggagtttgggaggcagataggccttgaggacttggtgggagtttgtaatctgggcggcctggctgaattcatcacaagggtggatttttaaattgccttttttgctcacctactcaaattgagtcactgagcagtatacttgtagatgctttaacaagtagattatattgaatcacatttaataggaagatgactaacacaagggagttgttttatgttttaaaaactgctcacgttcctgaactgcagaagcacctgttctgttactttttaaaatatggtcgtgaatatttttccctttttggtttccccagggcagtgatgttctggttctgaggtctagtacagcatttcctttttggccttttgtccttgcttaaattctcttccaattcttcccttccaatccactgacccaggattagagtactaaaacctcacttgtttttccttatttttgttcatctaacttaagagtgcgtggcaaaaatcttcctttgtttttaactaagctcgttaccttcaccctggtttcataatgtgtcaccctccctctctccccctattttttcctcctaaattaaaccaacaggagtcatttgaaataggcgcagtgccagaattagcaaataaaaatacaggacacatagataaatttgaatctagataaacaaataattattttttagtataagtatgtctcatgcaatatttgagaatacttactctaaaaaatcatataggaaattcagatttagctgggcatcctgtattttatctagtaaccctacataggcatatatttgaaataaaaataaaattttacattaaagaaaacattataaagaagaaaaatttaagtttattgtgtgttaaatattcccaatgctttccttactgaaaaatgtaagactgtggacaaattatgaaacagtttgtgcataagatttataagttagctacctaatgaaaagcttctgttggctattggaatcagccatttatcctaggattcagctttatctctttgctaagaagatgctcctgattttgaggtgagaatatttagtgcaagcggtagaccattgttacatatgatatatcacaagcacctgtgtcaaaaacaaatgttgaagtattcaacaattttttcctcatttaaattgtgcccagctctcttagctcaatttcttctggcataaagattcttaacacaaacaattggatgatgaagacagtaaattcttgattgagcgaagtttttatccaagactagcttccctctgtcacccaggttatatgtggagtacaaactaattatgaagctaaatcttcctcagaccacataagtaagtctactccaaagcttaataaaatgattctgcaatatttgttccatgctttgctttttaccaagcctgtgcatacgttctgatttgattctcctgacagtctatgagagaacagtgatgatttgtctcctcattttataagagataaatttgaaattttgataggtgaaatggcttgcttaagatcaagcaagacttaaatcttgatcttaggccttttgggccattgctctttccactacctgtattgacttttgaatgtaagtgatttgggaattaggcagtttaggagtaattgtaccagtgttcccctctgctagcttggaagatgaagagctgttttcatacctgtgcattgtgctggaagaggtatttgcctttggttcagtgcatacctataatacacattgggtcttcttttgaggaacagctgcctcccctgtacaaacagcctttctgaatgaaggggatcagccaccgttgacctgtgagtttgaagtattgcactgttaatgtttgggcaggatttttttgaacatgtggttgtaccacagagttacgcaagcgaaatattcttggaaatgacattctgcacaaccgtagggagaaatattgggaagctggcaagagagtcaattctatcagtgtttattgagcacctataatgtgcattttgtgaatactggatgatgtggatgagaaaagatgtaagtcctactcaggagcccttcctgccacagtaccttcattagcatctcctgcctatcagtgcttgaaattcctggctcatttttgatatattttatttctgatttgaggcatcgtgtcctttattttgataaaatattatctaaatattttatatcacataaattattaaaataaaatattattttttgtttgttatgtatagtcccctaacaaagtttgaactttttgaggtcaaggatcatatatatatatatatacacacacacactcatgtacagaagaagttcttgaaaaatattggataagcaaataaatttgtggtattcttggggaatcttggattaataaatggatagcatccctcggttgttgtatacctatattcaaaggatccatgactcaatgatggggtaaggaggctaaaagaggcaaagtcaatgactgaattgaacatggcatatcatctcaaattatactgggaaacaacattattgtctacttgttaaccaaatatatgcagttgatatcattcaggccttgcacaagttccttagtgtataatcttggtccttagaatgaagtgagcagcaggtacatattcagagactcatagtttgatggcatgggaactgtatctttggagatataatagaaaaaactgtgccttatctgattaaaaatgatttcctaaaaagtacttggataattcctaattgtcccagttttcataaatgatttggaaaatgctgtttgagactgtgattgttaatatactgtggaagcctattaacttctttttagaattcaaaagcctttaatatatggggcaagagaacatggattgacaaatggataagagtaactaactttattgtaaatcactgttgatatttggtccctgcctttgttcttttgttttactttctttcctcataggactcattaccttttaacatattagtaagaccgggggaatttgttcacttttttccttgatgtataacaaatcatattgcttaagttaaagctaaagtagatatttaggttaaaaattatgtagatatttaagttaaaaatgtgaattgacttaaggaataatattaagagaacaatgtagcaaaaattgtcatatatatacatatctgtgcgtatgtgtgtgtaatatatatatatatatatgtattcacgttatatacagacatacacacagacatatgtaagtaccagggatgaaacaaaaaaaaaaaataaaacaacatgtgttaagtactgtgttagtactaaagatgacagaaaaaagtacaaccctagatccttggccagagatgcttacttgtcttacacttcttacagtcccctctttactacacgacaggttaacttaatcaggacagactgtataagttacagggcccagtgcagaatgaaagcatggagcctgttgtatagaaagtaggacaaaggtgccattaaaggtggtaaaatataaaatatttttcttctaggggatctctctcaactttttatggtgttttaaattagctgtttaatgttgctttaagtgaggaaaaattcaaattttaaattgctagcatgaattttaccattcatggttctgttgtgcaatgccagttttaaatgcagatatgagagcattcaacttgtatgtagaatcactgaatttatacagtttatgttatgcctcataggcacataatgtattttgtttttaccgcacagtggaaacactgcatgaaatgaactcagaggtttttatttcacttgttgatatgcacacatttaaccaacactctctaccttcagattacaatgagtaaggaaggactgaaagggactgtctttccctttcctcctgtgtcattttcagtgtgattggctaatacagggaagtaatatgtgtaagaaaaggtatgttaggatttcttgccattcatgtttgttttagaacactatttccagctttctgcctttaaattgaagttttgatttgaagggaaagtataggctcccaaggttgtctgtctttcctctggcttcgtcgtaaccataacacacttatagggtagtcccccctttatccatggggaatacattccaagacccctagtggatgccggaaaccacagatagtactggcccctgtatatactatgctttttcctatacgtacgtggctgtgataagtttaattagggacagtaagagagctaacaacaataacagagatttaacaacaataactaaaacaacagttattaaccacagtactaaaagctatgtgaatgtggtctctctctcaaaatatcttactgtactctactcaccctttttgtgatctgttgatctgataactgatctgagacggctactaagtgactaatggatgagtagcatctatagcgtggacatgctggacaaagggatgattcatgtttgggtgagacagagcaggacagcacagggcctcatgctattcataatgcctcaaaatttaaaactatgagttgcttatttctggaatttttcatttaatattttcagattgtagttgactatgggtgactgaaattgtgaaactggagataagggggactgctgtactctgatttttactgaactgtcacatattgcaggctcactggagttctatgttactgggacatacaaacactatgtgaatggggcagccaggaattcgctcgcgcctgttgcgtgtattttttctactcatggacatgttccactgtgttatccgacttaacttacaaaacaaagttcaaagataagattatagagcattaaaccaagtgccgagcccttctgagtgcagggccctgagcgattgcacaggtcacacacccatgaagctggctctgaccttaatagataaggaagcacagcagagacataagctgggcctgatgccctgtgttttcacactgaggaaagcatgaattatctcttacgttccttgtttgaaactcaggcttcaaaagtaggaaaggttagaacatcaatccattgtgcctttccaccttttatctgtaacttgctgaaatgttttcttcctcctcctccttttcttgtcatgttggatatgtccttaatatatcagtgtcaagtgttgtgtctgaatgtgaacctgaattctattctaagtgctgaaattaaaacagtgtttctctgtttagtttctaatgtattcggggtactagagtatctaaaacagcattttaagaggctttaacattttttgcctttttttctcccgaattatacaagtcatttttctttttctgatttgttgtctcctgagaaagtaggcctccctttttttttcttgcatgtggcagattagtatcctgtggtccattgcaaccactacagtggttggtaggaagtagaacttgtagaaggtgcagttaaaactactattaaagtagcagggaaccttctttgccctctcagatgaggaccaggaagttgactttcacatttgaggtggcacttgatgtagcctatattcttttttttttttttttttttttttttgagacagagtctcactttgtcaccctggctggagtgcagtggtgtgatcttagctcactgcaaccttagcctgccaggttcaagcgattctcctgcctcagcctcccgagtagctgggattacaggcacgcaccatcacacccagataatttttgtatttttagtagagacagggttttaccatgttggccaggctggtctcgaactcctgacctcagctgatccgcccgcctcagcctcccagagatatagtctatattctaaagagactctcttctaatcaagtggttatcatctgctaatactttgaggaaaaaagattaatgttccaggatttataagttcagagaactagcttaacagagtgcagtgcttcacagatctgtctggctgtggaatcagattgactttaggttgctgtggtagctctgcagcataggagctgggaaatttagtaaccttacttggtggttctcagcccttattggtatggttaaggaactttgaataaacacctgtagagatttgaatttagttgccgttgggtggggctcaggctttttttttttttttttgcatcccagagttagcagtcagggttgagaacactagcttatctcagaacatcaatattctcatttataagatgagagaattagactgtatgagatcgtcgtgagatctaggcagatgaacacagcacttggccagtcaatgtgagtgactgttatcgttaaccacccttactgattctttgctgagattggaagctagattggcattcatttcttaagctggaaacctgtgctgatttgttagaaatgctgcaaggaacagaaatgattatctatcctaagggaatgactcagatcttgttagaataccatgcccaacttctcacctcccagaagagtgtgtcacagaatagctggaattacacctactttatgtatgaagattatccctggaatagatacatctttgaggaagaagttgatttattcatttgtgtaatgtttattgatacttaatacctatcagcacttctagactgtggcctggaggaatccatagattggtaattggttggaaaagtgaatgtaaattataacacagaagaacaagtgttttgttaaggataatggaaactttaaagctaagtagaagatagccaagctgagaggcctgggtgggctagggaagaaggttattactggcagaggaagttgcagttttaaagagacttagaggctggacacagtgggctcatgcctgtaatctcagcaatttgggagaccagggcaggaggatcacatgagcccaggagtttaagagcagccttggcaacatagtgagaccgtgtgtcaaaaaaaaagaacaagagacgtgaagacacacttggcatgactgggaaacttaaagtagtttagcatgtctggagtatacttactccagaggtgggagtccagaagatggtgataagaaagaggttagaaccataagcagggtcccagtcatggaaggctttatttggagattgaaattgattattggatagccattgaacattgtaagcaaggaagtggcatgcttaaacttgcactttggagatgtcacaatcctacaacaggctgaaaggctggagacatggaggccacttgggatgttgttaatggaagtccagatgaggaggtctgaattaaggtagtagcagtgtagtcacagtgaggtggacaacagatggcggagattaagaaggtggaatttgtaggtgtcagccccaggcattgcatctattttttttttccaagttgtggagacggagtttatctctgtcacccaggctggagtgcagtgacgcgatctcggcttactgcaacctttgcctccctggttcaagagattctcatgcctcagcctcccaagtacctgggatcataggcatgcaccaccatgcccagctatttttgtttgtttgttttgtatttttagtacagacggggtttcaccatgtcggccaggctggtcgcgaactcttgacctcaggtgtgagccattacgtccagttgcattgcatctgtttgatgttgggtatctaggatgtacatctgtcaactcgtgatgcctccctgaaccttcgatgattatctattgactataatctacccccaaccctttttttttttccattttcatctttcactgaattcctctgtggatccattgatcacgctttgcatatttattccttctcccccaaccccattcttcctggatgagctttttgctctcttttaaaccattgcacttgactgtctaggcatttgccagtatatcaaataagtatgtatttgaaagtctaggtgagcctttcttaaatactggatgctcagtctaaggtatccattgtgtttatggaattactttctctcctgtgtatctaaatggtactagtttgatacttttctgaagataattgagaaaaagtaactttgatctttttttcttctgtggttcagaagagaaattatttgtttcttgctcctatctgagccagattgcaaatttagtgctaagatttctggcattaagaggattattattattattgttaaattgattgtctcattagattaccaacatgaggctcatgggacttaaaagatttatgcccatatcctggttccatttttgtgtagagcctgtgggatgaaaatggctcacaggtctgtttgtgacacaagtagcttgatagatggcctatggttcatgtgtagaaaatgttggcgactatagatttattttagtatcattttaggaagcacaaaagtggtgtcccaattgaaccttatggagagagcatcattactttccatcacaggttcagactttgggaccccagggctctggaaatggaactctttgaagaggtcagagcctctatgcaccctctcagtcaactcaactgcatgtagaggagggaaagaatgttgttattattcttaatattcttatagtagcgtctaatagtacattagtaaatagttattcacaaatggttgttcctattgcttagcaatttctgatttcagatttgtgttttggatatatgtgcatactgaccttctgccttttaataaatctagaattcatttgatagtacaaattaacaaaaccagttgtaataaaaatattgaattttaactttaaaaaatatgcagtgtggccaggtgtggtggctcatatctgtaatcccagcactttgggaggccgaggtgggcagttcacgcggtcaggagatcgagaccatcctaacgaacacggtgaaaccccgtctctactaaaaatacaaaaaaattagctgggtgtggtggcgtgcgcctgtacctcgggaggcagaggttgcagtgagctgagactgtgccgctgcactccagcctgggtgatggagcgagactctgtctcaaaaaaaaaaaaaaaaaaaaaaaaatatatatatatatatatatatatatatatatatgtatatataatatgtattatatatacataatgtattttatatttatatatattttgagatatatataaaatacattatatatatacataaaatattttgtgtatatatatatatatatatatatatatatatatatatatatatatatatatatatatatattttcagtgttcatataacaaatttcttttgagagctaccaaggaccagacttggtgctgtgggatatttgataggtgtgagacagtcttttcctcagagggtttgtatcctaggagtagggataatgataactgcataagccacctgattgatctggaattggatgcaacttttactacaggaattgacataaggatttagacccttttccagtacattgacctagtagtattaacaggactgtggcaactttgaacttccctaatgagaaaaacatgtgttggtgagcaggtattatcacatcttcccttgcttttctgtttaaatacagtatcctattcagataggcaaatctctgatgttttgttgagtgaagtctatgggccagatcacataatagatgatgtgtttgttggttgcccactgattagcttgggacttgttacctagaggtccatggcccttctgaagtcttcattatgttgttagtttcccaaaatgatccgctgacacttgttctaaatatggtttattttttgcagcttaatgatttacttatttgccaaatactgggatttggtttcagagagcatccttttctacctccttgggtatataggccttgatttataatgtctagttactctgtcaatgaatcagttagtgaccattttgagtgttaagagctttgagtaaagaagtgtgtgaaaagccttctgccaccaggaagcttgcttccctgtgcctagtctaaaccaaaagtcttcaaacttttttgattgtgaaccccagttggacaaatcacttagagtaagcacctcattttaaagttttatatttatactactgtactaatatatagatcagaaacataccgaattagaaagtaataaagaatgagatgcatatttatttatttacttaaacttttattttagattcaagggatacacatgcaggggtgttacctgagtatactgggtgatgctgaggcttggggtatgaatgaccccgtcacccaggtactaagcatagtacctggcagtttttcaactcttgcctcctccctcccacttctgatagtccccagtgtcttttgttgccgtctttatttctatgagtacctagtgtttagttcccacttacgggtgagaacatgcagtatttggttttcctgttactgtggtaattcgcttaggagaaaaacacatttaaatagacattataatgcagtcttacccctcagtggaacatcctacagaccactggtgtagacagaaagtgctagaggggtgcttgggagagagaaatcatccctgaggcacgtagtgaagaatgagttgtgtgcaggacatcaccagagtcatggcaggccgtggagaagatatagttggtaccatcttttggtgtaagcagcagggagccatggatcttcctaggaggagccacaaggtagaagtggccatgccatagatgcctgcatagcatagtgggctggggtagacggtggggggcatgtgtgtaaagagagaatgtgagggagacaggttggtatcctaatcctaatcccacagcagaatagaaaggcaaagaggatggtggtggcaggtagggtgaggaggtagtgaatatgtggacatttcctgcatgaccagaactgctaaggaggaagtgagtcttgaagtctgctggacaaacaatggtttgtagtaggagaaccctaaggtggagggagcggggaggggaaggactggccacatcccaaaaccttattatgtccaattttactgcagctgttttatgactgcaacatttttgttcaggaaatcgtttatttacccccacaccttttcttttagactaaatgacaagaaccagtgctcacatccagggtcaaagctaatctttgaggaggtggaaaacgcctccttgtttcattgtctctcttgaaagtggtgtctccctttcactctcctgcaggagagagatgtccaggtactgcctaagcagccccagtgaaaacggatggttcttgaggcttccagaggtcaatctggcataagaagtaaagaagaagccacatgactcggagaggcagaatttctttccttggacaggatagagcttttaattgaatccaaatcacatctctcatcctgtgaatgctggagagcagtacatttttaactaggaagagcatcaattatgtattagccacgatactaatttaccctgagtgtgtgtcttagagctggctttcatctctgcatagccactgatgtaatgccattgtgtttctatactcaaccagtcgctcttaagatagggtgtcctgctattgaaaagagtagaaagtagggattgctattgctgaggctctttctgtgttcttacagctgagggccctttgggataccaccttagggtgggagagctgttcactcaccgttgtgctttgagatgcagactggggcttgtccttttactctgatgctgctgctttatcagttatttggtattattgtgttccaggataaatctctggaaccctcagttatagatatttgagactttctgtgtgtgtgtgtgtgtgtgtgtgtgtgtgtgtgtgtttgagacagggtcttgctctgtcgcccaggctggagtgcggtggcacgatctcagctcactgcagcttccctccatcctgggctcaagtcatcctcccacttcatcatcccaagtagctgggactacaggcatgtgccaccatgcccggctattttttttttcttttttttttgtagagacgggattttgccatgttgcccaggctgatcctgacctcctgggctcaagtcatccactcacctcagcctcccaaagtggtgggattgcaggcgcgagccactgtgcccagcctgagattttgaacatttgcctccagaaaatgtaggcagtttctgtggctgcttatttcctcgccagtaatatattttgcttgttcctagagtactaaatgtaatgatgaccaaagtggactgagcatttcctagatcttgacactcttctaagcacattatatatattaacttattaaattctcacaaaaatcctatgaggtaaatactattatcatccctatgttacagatgaggaaaatgttaaataacttacctagtgagtgtagcataggctctggtgtaaaaagctgattcaaacacctgccttgccactgtgaatcacggccctcagtcctttcctgtgaaaaattgatttttattttttttgagacaaggtcttaccctgtcactcaggctggagtgcagtggtgtgatcataggttgctgcagccttgacttcccaggcttagacaattctaccatgtcagcatcctgagtaccttttaattttttagagagatgggatttccctatgttgcccagtgtattagtccattcttgcactgctacaaagaactaactgagactgggtaacttataaagaaaagaggtttaattgtctcatggttctgcaggctgtacaagaagcatggttggggaggcttcaggaaatcttcattcatggtggaaggtgaaggggaagcaggcacatcttacgtggcctgggcaggaggaagaaagtgggggtgggggtgccacacacttttaaacaactagatctcgtgagagctcactcagtatcatgagaacagcaagggggaaatccgtccccatcatccagtcacctctcaccaggccttacttccaatactggggattacaattcaacatgagattttgatggggacacaaagccaaaccatatcacccagctgggaaaatggattgttaatagtacctgcatacagaattgtggtgggcatgtgattttggcaggtgataagctcttcattagcattcactaccacagtgaacaccaccatcctcctcctcatcatcataattatctatccagaggatcatgtgagatgcttcaaacccctgactaaggcaatctcaaaggataatttgcctcaggtgtcagaattgtttagctgtacttgcctttccttgcaaatataatggcagaaaaagaggaaaatttagacattttgagccttttcgaagcgggaaatcaggtaagatattttcagatagataatttgttttctccttgtgctcttatcacttccttcctctttctctcccacctctgagaaccctggatgagggtagatgaagtagaggagagggtggtgacaatggtggtaaaagaaaaagtaaccaccaaacatgtacagaaccactccagcatttaattaaagcctgcagccctttgtcagccagaagctcctctcatggtgagagaggcagagagccttgtcactgtctctagaattatttgtataattcagcagctgtttccctcagatgcctaccacacgaggttggattataaagacgtatgagtagaatcgccaaggttcagacacttgtgttcactgttgagctgagagccacttaggctgttcttgtacaaatgcattagattatggttaagcagcttatggacataaaaacacattagaactttacagcactctataaattatagtttttgcagcattcacagccacaatgctaggtaattacattcattaatctactagtaagagcacataaagttgcctcccaaaccttactgtatgtgtcagtactcagctgggaaggagagtttttttcctctcctttttccccgtctttccctgttccattaagccttgtgtgggaagatttttgatgttacattgaggtgttccctaaaagaatccaataaacccattttttttttttaatggttaggctctggcaggaggccttgtaggtaatattttcatgttgagctgcacctagtaactatttttgtatgcatttattttctttttggaaatggacagatgtctcatttggaaagccagcaagttaaagcagttgaaaagagattaatgatagaatcagtggtaaatgctttttcaggacttctttttgcctctctctggtagcagttaacatgatggtccttttaattttggatctatcaggagtacaaagtattgctctcttcccatgccaaactttcctaaagtttccatctttccatatggtgataggaaatgcctccccccacagccctgtctcagaactttctcttatttgcatgtctcataaattacagaaggcagatttaggaagaaatgctggaactttatatggtgctagtatttcaaggagcaaattgtactttcttcgcattatttctcaggttaaatagaccaagtggaccaggcgtggtggctcacacctgtaatcccaacactttgggaggccgaggtgggtggatcacatgaggtcaggaatttgagaccagcctgccaacatggtgaaacctcatctctactaaaaatacaaaattagctgggagtggtggtgcacgcctgtaaccccagctactcaggaggctgaggcaggagaatcgcttgaaactgggagacggaagttgtagtgagctgaaatcaggccactgcactccagcctgggcaacaagagcgaaactctgtctcaaaaaaaaaaaaaaaaaaaaaaaaaaagaccaagtgataggctgggcgtgctggctcatgcctgtaatcccagcactttgggaggctgaggtgaaagaattgattgcttgctcaggagtttgagaccagcctgggcaacataatgagaccccatctcaatgtaataaataagtaaataatttttttaaaaagtgaaaagaaaaaataggccaagtaatacagccatcttaaaaataaaaacaaaaatggaatagagaagtatgttaacctgcaaccccaaggcaacactataagtcctgggtcatgctcagaccacattctaggcttctgctttcagttctgttcacatgaatgagaacatgaatgctagagccacgcaggtctgtgttgagtcctggtattgtcttttcatagctatgtgaccttgggaatattaattaatagtaataaaaataattaatttggactgaactcctaatacatcctaggcattacattaactaatttaatcctaatagctgcttcataagttaggtgatattattcgctccattttatatatgagaaaactgaagcttcacagggtattgtagtaattaaatgaggtattataaataaaatatccagtatgttgcttggcacattcaatgacactcattaaacacaatcttgaggatatatggagaatagatcccaccattgttcctccaatgccaaatgtaaccttttagaatgacagtttccctttttaatgacttaccagtcattaattgtatcagtcaggaagaggaattcctcacatttatttgtaatttatttactgcctgtaccaggaagtatcccaagcactttccacaaatttcattaaactttctattcctgtattccaggagaagaaatggaggctcataagggccaaggcatttgttcatgttcgtaaagccagaaggtgggaaagccagttctcggactcagatgtaaccgccaccaataaagagtagggatagcagtgaagtggtctattttcctggaatgaagcttctatggtgggaagtaatctaagcaactgattaaggagccagctttgtgcacttcaaagcagcctcagcttcggggtggagcatagagttccttttttttttttttttctttagcaggcaggaagatattcttattcccaaagaactgagaaatatttgagactatccatagtactcattggtgctgtaaggttagataactgctgagaagaaaactgattgctctgtgtaaatcagtatgctgatgagggaatgataaaactgcagggtagtaccagcgtcagcatcttgtttccaacccagctcttctctctcttgacaaaacagctgtcattttggattaatgttgaaatcaccagaatctgctggtcatcagagcagggccgatgccatctttgggatgaagtgtgctggcaacaagatagaaactggacatgggaaaaaggaaagtctccctcaaacatgctgccatccaaggcccagtttaaaccacaggctcaatttttgctcccaaactgatttcccgactaacccatctgctcatgcacacaccctcccaacctcacacagcaggcctggcctttatcatttcaggtcctgcagagctgttctctctcactgtggtactgatgccagttttaacagccgccatgtgtattgactcctctaccgattacaaatatatacgcgtttgccagtttgtttagtgagtggttttcataggctgtgatggggatttcactttcatgaatataatttgctgagcctgtggtgacatcaataaatccttctgggatggggaatggttgatttccctacatccagatgacatcctccagcccacttccttatgggaccaacagccaatgtcataacacatgcttctttgtgagagcatggaaggaaattgtttaaagtgtgtcatctgtgggcacagtttctaaggtagatacctgtgaggatgtataggcatgctttagacatggacagaatgagttatgtacttagtaactcaaaactctgctgagctcattgtggacagctcttacagataaactaaaatgcagcttcttaaaaaatgagaggacatttgcagaaagcattcttactgctttcagcaaatctatgtgccttatgtttttatatagcagtcattttctcaaatcagacatccctattgcctattagataaacacagaaagcatagattatgagtttaaaagtatcgacagcatttcaagtgctatcagagaacatttaattcagtttaattttgtgataaatctcacgtttaatcctctggttaccctgtaatcatgtctctattgatcttttctgaatgactgcctgcagtttaataaactttgccattaacccagagcttctaaaaggagagattgattccattatcaaatctgatagaaccaataagtacctaaacatcactaaatctatctataggaagctttggcctagagacaagcctgtggcttgtttaagaaactaggtaaaaatctggatatctttgcatgacctaattgcctcacagcatctgattcccttgtgcaaactgacactgcctttcatctttcaagtcaatgtagtagccaactgaaaggacagtctcttttcttgcctcaaccgtaattgtagggtctaatttattctcactgcagatatagcttgaggagtttatttggtctatgtctcaggtcagtgggtatatcttaagcacttttctgtgtctctgaaaacctgcaggatagtttgttttatttttacctatatgatgccaagggaaagaaaattctgtctggataaatcctgaaatagaagactgggggtgaagattgagagagagggaaggcaagtacagagtcatagctgtgtgaacaagctctaagacttggaaaactttccatgaaacccatatatgtttctcatgtagtgataggttatttgcaatatgtgttgaacaggaatttctactttttgtgccgcgagtatttatagctttcatcattattcattaatatttattgagtcacataggcagaacatatggaattcagggtctagagtatatttacagcttcttatttttttaaggtcagaaaggtgtcattccctgccacttttcacctcttaaataaatcggtgaaggttgtcaattttacagaaaagccaaagcttttattttctgtctagatttttattgacaatgtgaatttttcagaaggagttcggctatttgacttaggaggcatagcctttccctaattacacttcggtggggaagtggaggtgcacagaaggatttttataatgagacaatactaaactgtaatttaaaatttccttccaacaaaagaccctaatcttggcacttagaaataaatctgtaatgacgtggtgttaggcagtggaagcaggattagagccaagggactctgggtgtgttgccagttgctgattttctcactttggaaagtcacttgtttacccagccttagtttcctcatgtataaaataaaactgatggtgcctgcttagagagctattagagaattcaatgaggtgattattttaaaagatactgtaaactttttccaatgctgagttgttgtgcagacattaatggttatgaaaaagataaattagtcctcgctttatattcagaaatggtctgacctttcagtaaattatgtttagttcttaaatcaaaacccagttaggacaagagagcttgaagagtacgtatacataagagaagtctcacagagatatttgaaaggctggaaaatgtgctctggaggcaaaccctccactgaattgatgaattctaagttacatctgttgatattttttgtgtgctaaatagcctcccagtatggtaacattagagaggctgaaggaacctaagaggaggaccctacatttataggtattgaggtagattggtctctgcccttgagaagccaatcaaaattaggttgagaaaggatgtagcaattgttcgtggaatactaataggcatatatgcacttgttcatgttgattctctatgtcactgctctgtaagagaaggaatgcctgcacatcttcaataggaagttgacaacagtttctggaaagttggaagaaagttacagaattattcctttagtagtaattattccatagttctctagaaacatgacaaaacctcttgaaaaacttgagtcataaaaggactgcctcacatatatacacacacttcctgatatgctgtgtaaaactgcgtttatattcagagccacataacacaaattttgccagaagttgctttttataccactgaatagctctaaactttaaattgtctttcataaaattgtttcttgtctgctgagtggacagaatgtctctctcttccccacccttcatatcattttgttttcctaaatgggccactctgtgaagtagttctttacttctagccaccacccctgcctctagaacaatgcaaccaaccttaaccaaagtcacatatcaagagttctctgctgcctgttaatgcagatttgacttctttgtgtgtgtgtgtgtgtgtgtgtgtgtgtgtgtgtgtgtgtgtgtgtcagggtctcattctgtcaccgaggctagaatgcattggtgtgatcatggctcactgcaggctcagtcagtcctcctgcctcagcctcctgagtagctgggactacaggcatacgccaccacacccagctaatttaaaaaatatttttctggagactgggtctcactctgttgcccaggctggtcttgaactcctgggcttaagccagtccacctgccttggcctcccaaagtgttggcattaaaggcatgagccaccgtgcatagccagatttgacatcttaaaagccagagctagacatacttattgattgtcttcctggggccaggtgcagtggctcacgcctgtaatcccagcactttgggaagccgaggcgggtgggtcacttgaggtcaggagttggagaccagcctggccaacatggtgaaaccccgtctctactaaaaaatacaaaaaattagccgggcatggtgatgtatgcctgtaatcccagctacatgggaggctgagacaggagaatcatgtgaacccgggaggtggaggttgcagtgagctgagattgtgccattgcactccagcctgggtaatagagcaagacttcatcaaaaaaaaaaaaaaaaaaaaagtaatggaaactcagagaaggttgctgaagggaagctagaaggcctcctccaggacagagaagtaatcattttacacttatcacttacggtaactacaatagaatcagtgagctagttgctgaatacttctagagacattgttcacttaaagtgaaggtgtgatagtatgtgaatacctggggaagagaagaaagcgaaacatttttaggaaagaaaaggaaagtatgtgacttattactaatcaggatcaatttgaagatctgaatagattttcactggctaatcagagttattctgtggaatatctgcaacctctgcaaccacttttgatttttctgtgaatagtgaggtactgagatccagtaaattataatttggccttgatatcaagccatgaaaaagatgtttagaactaacattcattggcctctttcatttttttttctcttggggttaataaggcgatttatgttatttctaggcatctgttcatcccctctttagcatataggggaatagaaatggtttatccgggatatggatgtggtaatgtgtcttagtctgtttttgtgttgctacaaaggaatacctgaggctaggtgcagtggctcatgcctctaatcccaacacttggggaggccaaggcgggaggatcgcttgaggccagagttagagaccaacctgagaaacatagcaagaccttgtctctacaaaaaagtaaaaataaaaacaagaaaaaggaatactagatgctagtaatttataaggaaaggaggtttatttcactcatggttctgcagactgtacaagaagaatggtgctggcatctgcttggcttatggtggagttctcatgtggcttccactcatgatggacggcaaaggggagtcagtgtgtgcagaggtcgcatgatgagagaggaaacaagaggatggggggaggtaccagtctctttttaacaaccagctcgtgtgggaactaacagagtaagaacctctcttagttctattagagttcgacatgagggagggcattaatctatttatgaaggatccaatcccatgacccaaatagctcctcttaggccccacctccaacattggggatatatatatatatatatatatatatatatatgtatggttttttaaattattatttttttggagacagtctcactctgtcacccaggctggagtgcagtggtgcgatctcggctcactgcaacttctacctcctgggttcaagcgattctcctgcctcagcctcccgagtagctgggactacacctccacgcctggctaattttttgtattttagtagagacggggttttaccatattgcccaggctggtctcgaactcctgagctcaggcaatccacctgccttggcctcccaaagtgctaggattacaggcatgagccaccaggcccacccattggggatatttcaacatgagttttggaggggacaaataaactataacagaaataattagataatgtgtttgaaagtcttggatggaagtccgagaggggaagagtgatggagtagtacaattcatagcatggcccaacagcttcagaatgagaggacattcagggcatcctaatttcacaagttcattctcctttaagtttttgtttttagaaatgggctcttgctttgttgcctagggttctcaaactcctgggctcaagcagttgtctagcctcagtctcccaagtagctgggactgcagccatgcactaccaggtccagttctaattcattcttttataaacaggttactgtgtgtcctctactctgttctctgctaggaattctggcatgatgaagtcatagccattgtccttatggaggtaattctgagtattaccaggaagatccagttaccaatattttgatacactgtaataagtacattaattcttttcctatcttttgcatacagtgcttaatcaaaaaatgaataatggttgtttcaacttactttaccatcagcagtgtgcagtggttcccatttttccacaccctcactgacaagtacctcttgtctttttgataatacccgtcctaacaggtgcaagatgacatctcattgtggttttgatttgcatattccagatgactaatgagcacattttcatgtacttgttggctatttgtatgtcttcttcggaaaaatgtctagtcagattttttttaaaaagaacatattacatgtaaaaagaataatggttaattaaagcaagtatcattagaattacacatcctctcaaatgtgtgcgtgtgttactttagtggattagatttaagtgggagaaaaagcaatcgaaatttgagtgttctgcttgtctttcttcagttagcataccaggcttctgcccttggagaggcctgagaattgtgtggtgctagtttctcttctggctgccattacactatcttctgttgtatggttctttttgcctttttggactcgtcctttgtgtacgttattgccctaagccctcactgatgagattttctgcctcagtcatgctgtgctcagctttcagaatgttgttgttacggaggagttaattttttttttaaggtttccttttcgtcatgctgtatttctcagattatctggagggactgtaatccaattttaggaatccttcagggctgagagcctaaactgttttaagcaatagcatctggttgccagggactcaactactttgagcgtgttaaggtctaacggcagccaactctcaattatctgtgggaatgggagactcctgggatgttttcaattcacagagtgtgcaaaaatctcacttaaacggatagtcgtgacctcatcccacagctgagtttaggagagcttctcagtgtgtggttttgttttctttttgttttgttctcttctcacctttgacagtggcactgcagcattgacaggtgccttttatatgttgaatttatctgtacctgatctatttttttaaaccttgtccctctcatctttatttagattccatatgtgtatcattatatacattaagtatgttttaataaactgcctcaattcttttacattttaggagcagtaaaatttatttatattttctttctttgcttattggctaacgtgctcatgggaggggatgtagccaaacagtaatcaggctaccagatagaaagataagaaaactttacaaaaggttagcctctgaataataattgagaactggctgttaaaaatgaaaaaaaaaaaaaaatacgaactctaccttgtcactgaaaatgaggtgaaggccaggcagtgctcctcagtcaagacattcgtgttcacaactgagttgtctccagtggaaatttcatggctactttatggcctaaagccagtgctcccagacgtggtcatcccttggttttaggattctaaaagatgagtttcttttaatgaaaactgaatgtaatctagttgttagggataattatatgccagttgtgcatgacggcaagggcccctggtttttaaaaaccagctttatggaggtataatttacattccagtaaactgcacaaactaacaatatacaatttgatgagttttgacatgtgtatatacccatgaaaccactgccacaatcaagacagcgaacatgttcaccccaaaagtttccttatgtccctttataatcccttcttcctatctctcccaggaagccactagcctgcttgctgttgctatcaattagttcatatttcctaggattttatataaatgggatcatacataatataatcttttccgtctgatttctttcacttggcatacttattttgagacgtattcatgccacctgtatcaggaggttatttctttttattgctgagtagtattccattgattggttacaaccacagtttgtttatccattcatctattgatgtacatttgggttgtttgcagttttagaagcattgcacatctgctaggagcattcatgtgtagctcttcatgtagacatgtactttaatttctcttagggaaatacctaggagtagaacggttggatcatatggtcggtgtacttagaacttttaaagaaactactaaactttcttccaaagtggttgtgctgtttcatattctcaccagtagtgtatgtatgagcatcctctgcatccttgcccactctcggtagggtcattctttcttatttcagccattttatatgtatgtagtggtatctcattgtggttttaagttgtatttccctaatgactactgatgttaactattgttttatgtattcattcactttccagacagatatctttttttttttttttttttttttttttttttttttttgagatggagtatctctctgtcatccaggctggagtgcagtgacacaatctcggctcactgcaacctttgccctctgggttcaagcgattctcctgcctcagcctccgagtagctgggattacaggtgcatgccaccatgcccagctaatttttttgtatttttagtagagacagggtttcacccgttagtcaggatggtctcgatctcctgccttgtgatccatctgccctggcctcccaaagtgctgggattacaggcatgagctgccacacctggccccagatatcttctttagcaaagtatctgaatcttttgcttatttaaaaaattgggttgtttccttttttagttttgagaattttttttttttttttttttaagatggaatcttgctctgtcgcccaggctggagtgcagtggtgcaatctcggctcactgcaacctccacctcctgggttaaagcgattctcctgctcagcctcctgagtagctgggactataggcgcgtaccaccacacctagctaatttttgtattgaccaggctggtctcgaactcccgacctcaggcaatttgcctgccttggcctcctaaagtgctgggattacaggtgtgagccatcacacctggcccaagaatttattaaattaatatattctgtatacaaaacttatcagatacacattttaaaaaatatttttccattctgtggcttatctatttatgtatcttttactctcctggtaactcacagaacagtcactttattttcttgacagtatcttttgaagagcaaaattttaattcttgaagtgtaatttatcaatttattcttttatggattatgcctttggtgtcatagtaagaaatcttagcttaacccaagattacaagagttttctcttagaaattttatggttttaggttttacattcaggtttataatatagtttgtgttagttttttctatttagattgaagtgtggattaaaattttgcatatgattacctattctatcaccatttgtttaaaaaacttatttctctgtagaatagcttttgcctgaaaatcagttgttgatatatgtgtgggtctctttctggactattctgttcctttgatctgtttttctatctttatgccaatatagtgatgcaattttaatgtggtgtgaaagatggcactacagagcacctgacttgctcctcctctaacctactttactataatagttcactgattagcctgtttccctggataagcagcctgagtttaggaattctttcttagatatttccaacagatggcaatgtgtatgcacatagtaggtgttttgatatttgtttttaaaagatgtgaatcttagggattaatgtttgaatgccatcctggatgccttgtacattcctacagatagtagtcttctctactttctaaaaagtttaggctctgaaaatctgttcataaagtccatttgctcaaaagtccaaagttggggactgttgtgaacatatctatctagttactagttttctaatttttcatttcttatcactggagactcattattggtagaatcagtgtttgtaaaaccattcaaaaacaagtacaaatggtatacaataaaccagcaagggacttgacagaccaaaatgacaggacacagccattatgtcattgtgtcattggggacaggcaaagcacttttttctttttctcctggcttgttattttctttaaggtctctaagatcagataactaacagaagaggctcagtttaaattgcaagcccctcacatacatatacatgcatttgggtgcatgcagacacatataccacaaatactttgtaagtgatggactgccctcaggttagtttgcttggaaaaatcaggcggagactttctataacccacttcatgcaaggcagacaaattgtgccctcattttctattgtctctggcttcatctgtaatcagcaaatggagccctgcagcttacatagtgtttcatctgctatttgttactctcccttagtttgcacaacactgaaccatctcattttgaaattcaagagtggcgaggaggcctttggtggaagattgtaatttgggagaagggaaagtcaagagcaagatcgcctattttgaagaaggcggggtgttgaaggaaattgcctttgtcagtctctgagcctctccatatatgtgctactgtgaccctgccctccatcaccagtgacctaaaaatcacataatttcaactattctccaaacctattcacatctgttgtgcatggcttgtacacttaccccctctattgacagccaatatgtctaaatctttttgcctctcagccagcctcttgttggtggctccctggctttcttgccttctttcctgcttcttctatgactgtcaaatgaatgccttaaagcgttttttttttttttttttttttttttaacagatttctttcttatccttctgccctcctgcctttctctcctagtgcttgtgtaagggaggcagttttttttatctttaccctgttagggtctctagctgaggctgagtattaaattgatgtaaaatagattaacagaagaaaagcatatggattttgacacatatataggagcccccacaggaaagtgaagacccaaaaagtggcaaatcttgaatccttatttagtaggttgaacagagtggccgttgtggaaaagtaactaaaataaatgatgtggctaaaggaagataagagttagtaagatctgttggtacaaatttttctggactccccatgtctagaaacgagaaaatttcttctttcctactatagggagatcatctttcacatgagagttttttcccatctcaggtgtttctggtgataatgtttcttttctcctatctcttttgtttctatttttcaagtgcctttagctttaaaataatccttaggcctaaatagcatgttttggggtggcgtgttctgccactcttcatttgctcatgctttccttgcagaatatggactacaatcatcttattttcaaaaaattcttcaggtaattctgatggacagtttctcttgtgaaccactatcctagatcatggtagacgaatgaatcaacaggcctttgaaaattgccattcattgatcccaaaaagtttttttatataccagataatttccctccccatattatagcaatactagagactgcccaggtttccttaaggaagttcttaaattagtgctactggttggttggtggtggaggaaagcattggtgggtgtatatttacaaacaattacacaggcatgtagtcatgtacacaactcttgtgactgttgataagatgattagtttatgatcagtctttgtctttgattcttaatgcttataatggatagtttttgtcatttttctccaagacagtctgaaaaaattaaatagttattttactttataaatggtaagcagtcagtacctgtttatagagggaatgaacaaagagtggtctggtttattcaggatttgtaccaaaaaatctatatagtaatttataaataaaggtagatctttgaaaaaaataaagataatctctagtctctgaaaatataaacctgttacataataaaaagttgttatagactcttcatttcttcttacctcttaagccaccacctctagacacactttgatcctctctctctcttcttccccccccccgagtggaaaatctcaatattaattggagctaagatgattgtactactgctgctaagacttcagcaggtctcttacaagctaatgtcacggcatggggtccatttgctctgtgtagctattctgcagtgcagtgagaattccttgattaatatgctacatgaaaataaaatggatttggaaaaaattatagcatactctcataaatattaattcacatttgtatggaattacacataattttcaatatactttggaagcaccttcagtatgaaagatttggtctccaaagagaatggcataatttttttaaaagcacagtggatacattattaagcatcatttgtttattaatctgatcctctacatgcatatgatgcagggcagtaggtgggttgtgtgacaaagaaaggagctttataccctgtggggagtttttatattacacttagaagtggtacaatttaatcacattatatagaagcagcccatgatggaactcacctggctccctctgctagtgttgccattattcctgagtgtctctttatggcagctattttggttaaatgtgagactaaacacagaacatttttgagctgagcagatgcctggcatagctgactgaggttgtggacactggacaaaggaattcaattcagcagccattcattgaacatttactatgtgttaggcatagcatgcaaggctgtgaaatcaatggccatgtgcgcttgctttgatctcgacttgtcccctgaaacacttttcaccacatcctcattgcctcaggagagctacctctccgatggcagagggttaatcgtctgcagtggtagcagctggaagttaggccagaagctgcttatttgccttgtggactgttatctttgatatcttcttactcttaaggataaggcctttccccttttctggggtttcttgctgtttgctgtgatccttcgtgtataccagcagtgcacactagattccttggtttcctgcttctatcaccctttctggcttgctacactgtatgttagagacagcttagactattttaaagtcagtattgtgctttataggtttggatgttttaactagttgactcctttatttatgtatttattgactaatacattggccacctactatttgcctggtttatgtgaagtacttatgtgaagcactgggattactgagatgaactacttagtccctcccctctttcacattctttcaagagattatgcacccagctgcctcaaggcctttgcacaagctgttctctctgttcagcctttcagatctaggtcaaatagcagtcattttctcagctctaaccctctcctctggactatatcatttcccttagttttagcacccataacctatcctttagcgttgttaactcagtttgcaatgatatatttgtgtgatttgattagtatttgtcctgtaaattctaggctctatgagggtggtgacttttccccacaccattatcatcctaaacataggtcagtgctacattggtacttggcatgtactgggcacacaaaacataattgttgaatgagtgaagacctgagaatagagtactttgtattacaagaaaggtctccctgagtgggcaacactgctaagagtcactgaactagaaaagggaggagtgtgtaagagaggccttttgaggccaaggcaaatcagtgtaaaggcctgcgttagtttgtccaggctgcattagcaaaatgtcataaactgagtagcttataaacaagaaacatttatttctcacagttctggaggctgggaagtccaaggtggaggcaccagcagattctgtgtctggtgagagcttgtttctcatggatggtacctgttctcacatggtagaggggcaaatagactcccttaggccctttataagggcactaatccccttcatgagggttccaccctcatgatccagtcaactcccaaagtcccccatctcctggccaacatggtgaaaccccgtctctactaaaaatacaaaaaaaaaaaaaaacaaaaaaaatggctgggtatggtggcaggcatctgtaaccccagctactcgggaggctgaggcagggaatcgcttgaactggggaggcggaggttacagtgagccaaggtcgtgctgttgcactccaacctgggcaacaagagcgaactctgtctcagaaaaaaaatatattctggggagacacaaacattcagatcataacaaggctcaaggtctcagactaataggaatggctgatttggggagagatgtcagggagtaccatgcatgtaaagttgggagtgctgggatattgcagcagaacagtgagaaaattggatgtgaaagggaggaaagagagcggtattttaaggagaaatgagtaaaaggaaatttctattttggttttgttttatttttaaatgtacatttagatagtaaaaaatttaattgttcatttaaaaataactaaaataatataattggattgtttgaaatacaaaggatacatgtttgaggtaatggataccccatttaccctgatgtgattattacacattgcatgcttgtatcaaaacatcttatgtaagtcataaatatatatgccgactatgtaccccagaaatgaaaaaatttttaaaaagttcatttaggactgcagaaactgaggaagtgtggtaaggcttcatgagggggattttctgtgtaagaggattagatccactagtttccaaataactgagtgccaaaacattttcattttattgcttagtgtgtgcatcatttctcacagggcagaggatatttgcatgtatgtggtttgtttgatgttctgagagcccattttgcacgtggtctcagagttgtagtgacttactccacttctgataatgaataatgtcagtgtccggacactaaaagcccagtctgttggaaccttggtgtgtactgagctgcctggaggcacagaactcttatcaggtcatgtggcctgaaatgcttacctgtagtttctacagatgcagttccccattcaaggacattgatttcccatttcctacccacctcccctcatccccaaccacacacaggaataaattaaaagttgctgttgatcttggtgataatattgttgttacattttgcaaagaaaatggaaataaaggatgcttagaggaacatgtaaaaaaatataatgcattaaggaaacattttaatcatatgaatagacagttctttcttgctggctcacatccacctggacctgataaattcagttgggtgctatttcttttgaattgagcatgcacttagtgctcattttctgaaacataattgatgtaccaacttgggaaatgagtgtattgcacttccttggggaaggtcattgtgtgctggacccagcaccaaatcgaacagaaagctgctatcccagggagcagtgaaatcacttttgatgcatatacttgtgttttgtttagttttctgcccagtaataatagaaaggatatatatatttgtgatggcattaaggattcaggaaaattgagaagccatgtttcttagttttgggtcttctcatatcccactttcctatccctctcccacttagtagtaacaccctttagtatttagcctatattttgggtgtgaccctagatacctttgtaaccaccacttccctttccttctcttcttttctacagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacaggtgaggaagcttgggttcgctctttcctgtggcggcaaaatcccttccttaggtgcttcctccactgtggtttttcgtaacaggtggagaagatatccttggtgggatgctgaagtggttgtccaacaaagctgtgtgcgtgcctttaaaagaatctaaaacccaatctcagctctttctatgaggatttgaaacttcagcatggtgccctttcagtcagatgtgctttatgcaacaaagcttgatgctaagtggtactggtatttagggcagacctgtcttaacagttgtcaagatggactggcttgcaggggagagatctttgcaattaggataaatggaacaggtggatttcatcacatacattgtgcatctcatggttctaaggtgctaaaatgattgcctgtgtgtgagaaatgccttgctaagatttatattttccggggaagctcagatattgtggcatctgggagggcaatggcaaaaaatgaatttgccttttggtgtcttagttgttctccataggctataattcaagactatctttgtgatctgttgattgtatgaacgtctgataatgaggcttactggcctgttaataattaggtttcaatgatccacaagaaagtatggctcttggcatttgggaagcctttctgcctgtggaaatccccacatgagatggattaataatgagatatgaagctgtttatagcagtttttctgcacaaatccagaggcttcagtgcctgtcaagttagttacctgtgtcctgggtgtgttttatttatttttggcaggaccattgggtaggattgactatcactgaagaaagcagaggaaggaattgtggtgtacagagcaggtgctgctaattagaggtggaataggtaatttttggtttgcagatgtttctctgcagaggcagggagatctgggatcaaacaaaacaatggttcccaaaccacacagatcttgagaatcatataatgagagctactaaacctaaatttctggcccctctttaggacctaatgacatttgtagttttagaaagtttcctatttgaaaacagtcagcctggttggaagtcactcttacaaagaatcaagagtgtatttgggtgatggtttttagttaaaagattggaaagatcaaaagcctcaatatgatgtagtgggcagtttggtgtcagaattctgccttatacgtagtgaagcatataatcctggtaaaacatctggggtgatgggtttcagatggacccagaaggcttccaaggtaatgcctaaatctgacaaccagcacagtgtttccaaaggtacacttgtgtcctgaaacgccagactggagttataatagtaattattaacatttacctaatgcatactatgctacattcagtgagggagtttttatagtataacctataatttgtacaacaaccctgcctagtaggtaatatcatggttacttaacagctatggaaacgagggctcaaagagataaagtgacttgtctgaggccttgtcaatgagggaaggagccagggtttagacccagatatctctagttccgtggtttgttctgttttccatatttagatgaagttttatttatttttttcttgatagggagttggggagagggaggaaagcctaagttctataaaaggtgatgttcctgtggtatttgtgactcctaactcatgcctctgtgtgagatatgtgagaaaagtaattaatctcagtggagagagattgcaatgtaaccacccccctctccctcaggcccccgccccagcagggtaagaaggaagccttcttactctgagttaacaccaagctgcggatcctcatccttgaatctttttcttctagacgtgatctgacttttctattctgtgtcctcagaattattctttgtatttctttctacttcttcgagactttcaaggtcctctggtgacagagttttatgatcggaaaagaagactaagacgtaacacatcttaaatttgagtagcttttggtcttaatggccaactctcttgtactaatggtatttgaaatcaaagctatctttgttttaggtaacatatttgaaaagcaagtattttgactctttatgaatcatggagaaggaaagcatgaattgtatctttggccctatgtaaaacttttaaaaacaaggagtattttcttaccttcagtgttgatgccaaaatatgttatccaatcaagtgttatatttctagtaagaaggaatgcagaaggtgataattgagataaggccataatacttctcatttttaatattcttagaatcacttgtgctattatgaaatcccaaacaagtcaccatctggtaacagcccatctggaaaatgaagggcttggacttgaatgtttcttaggctcctccctctgggtcccatagttttttaaatttatgaataacacaaatacagtgttgtaaaggtctgtaaaggagtctgtaggtctgaaggtaatgccgttttggagtcagtctgtaactgataggctctgtgaagacatttatttatttttaatgtttttttttctttaaaattttgttttcatgtaatatgaagacatttaaaggagaagggtaagatgcatttatagtaggagggaggggagtggtccattgtgtgtcagtccagacaactgccatctgttatgtgatcattggtaaaaggtgacacatgagtgtttaatgaccatagtagatgttcaaaaagcttgtctgaagaatactcgtgattgctttcctatcatcctagatgcctgtaaatatcacaattactttatcgcctgcgtttgcctcttatcaggtaaagaaactgaatctgaccatcttagctgggaggggaccttgagatgagagtgagctttgaggagcatttctacattaatggattgtcatttagtgcctgttattgagaactacagatgaaatagggaagaggcgagaacttagtctttatttctgacttggttagaatgaattaggtttgcatcttattaggaaatggtacttcctgagcagacaacttaatgcacagctttcctgtaattatgggaagatgttactccttagtagagaggaaagaataggatttttttttctgagactccgttgaaggcaactgatctttttactcggagggtgcaattataatacttttataggaaagatgtatagttctaaaaccaaactgcttattctttcacttgcctggttgtaaaacccaagttcttgtgatgtttttccatactaccaaaagaaagcttttaaactgacacttatttgttggattatgtttttaagtataaatacatactgccttagaagatgctgaggtggcacctgtcttggcaaatggttgcactttttgatatgagaaatttgaatacttttcttacttcccaaaggggttaaaattatgaagaaatcaataaattacctcttatacaactcttatacaaaatagcgcatgtctttctgacctctgtaaatgaactatttgttcatgatgtaagcacttagacatgatataaaaaaagttttatcatttacttacaaggacatggtactttttttttctcaatggagatttgggggtgggaaaagcaaaagaggttgcacatggcctctccttaaggagctttattctctaattgggagaccaagtcacaatgaaaccactcaggaacacaaggaagtcaggtgtcgctaaaccgataagccaaattataacttcctgagaagcactttgggaaaacttaacccttcccagggcattgagtttaatttcagtatatctgacttctagaccatggagaattcttaaaaaatttaggactttgtagtttaaaacacacagagagcaaaagggttttaaaaatagagtaccaatgatgaaaagttgatgagcattcagagaactctcagatttggctctgactggatttctaaatctccatttagtccattagtctgtcctttctctgtagtatcaactgagccagaggaaataggcttaagtgagctagaaggcatttttaggttatatgaactcttctaacagacaccaagatgaatcatcaaaataaatcctgtggtctccctccttaactgaattttaggtgccaaaaagccattcatcttagggcagaatttcctaaagaaagaggcaacctgttgagattgctttagtcacaggagaacatcattttagaggaaaatggaggaatttgtgaatatttcaggagcctgttagtagactctaaccttgctggtaaggatggcttatgtgggaatgtcttatgtggtttaaaaatctttatacaagttgatctgggtaggtatttctttttaggaataaaaatttgctcttctctctctgaaaatccagtatggtgggagatttgtagttgacattgtaaactgtagacaccaaaagtgtctactgctttctaggaagaagaggaatccatcccagtgccaggcatttaaaattagagtgattactagaactctgcatggttgcatctgcttcatgtattgacattgtaccttggtcttccttggagtaagtgatagtggtgctatagacttaagagcccaggtgactgagccaccctctcttcccacctgtcctgatggaacagtctatcccagcccatgctctttcctgttgagagtgtttgctaccagaggctggtcccttatttcagcacgacttagacttactgcttttgtctgaagagctttctctaaatttgttactagtagaaattaacttgcaaaggaggatttataatggaaaactttgattaaacggatccagttcaagtctcgtttctgaagatctgctaattagttttggatggaaatctaggccaaaaatcacacaggtatttatccagcttgactctagagcctacaggtttctggaaatcagagcatttgagacacgaatgtaatttgggattttactgtcataatgaaaagacatgaactttgctatgtgctctttcatacatacttttgttataatatttagatgtctgctggtaccttgaactagtattaagaatgtcagttaaaccgtttctacctcatacttcaaaatttcaagtttaccatgttaattgggatttcatttgctttcgaaaaattttgtagtcatgtgaaggttacaagctaaggtatcaaataaaattctttatatttttttcctttttatgaatttaagttgcatactactttttccccttgcctaaagtatagaaataagaaaaactgtaaggaaagatggagggaataaaagattggcttatgatctctctttggaatattgattgacttgaataagagtgagatgctagttttaacatcaggtaattgaagaaccccaatctaggcttgtctgtgttcaggaattactcacgtattgtattggaagtattggtttgtaactgggattggtaaacctgacactaatataataatgagttatatgaaaggtgttttgcttttgttttatcttgagcatttggaaacaggtttattcgtgtttttcattttgtgtcttttgactctatactttgttgctgtgagccctgaatgttgggaatagtgagcataaacatcacttaacttcagtgagatacatctttggaatgttatgaccagtaataattttatcctaaatgacatttgtaattttaaataaaaatttagtaaaaattgactatgaaaaggacatagcatatgtattaggattctctggagagcaagtaccagtagaatatatatgtgggtagataagaggggattcattcggggaatttgttcacatgattatgggggctgagaggtcccataacaagccatctgcaagatggagaccctgggattcacagtatggctcagaccaagtctgaaggcctgagactggggtagtcctcaagtccaaagcctagagagcctagagtttagatgatcaagggcaggaaattatatcccagctctaggagagagagagagaccatttcgcctttcctctgtttttgttttatctggacacccggctgattgcatggtgcctgcccacatggagggcagatccttccctacttagttcactgagactcacatgccaatctcctctggaaacaccctcacaaacacacccaaaggtaatgctgtaccagttctctaggtattctttaatccagtcaagttgataccctaaattaaccaacacagcacattaactaccacctcataaaataaaacctgcagagagaaaataagctgaatgggaaaaggaactgcaatgaaaagaatgggccataattcagcttgggtgatcctgatacctacaggagttgttccataaaacagtgaccttttatatttcccaaagtaagaaaattttatatgtgtatttgtgcatgcagaactttattaagggccatttaaatcccatatattgatagaggagttaagaaagataaagtgacaggagtgattctcaactctggctcccataaatttctacaatgtcagtgattgaagaatgagggagcacatctttcctttaataaggcctagccagtacacttttggtagttgatgagggtaggacagaactccctttctttatttgaaactgtgtatttttgtgctgattaaattttacatttttccctcttgtgatgatataaagttatctgcatgtggccagatctcagctaaagaacatgaaataagcctctgtacattctgcattctaatctctgttcacagcaatcttgtatccacacaagtctgtacatgacaggtaatgagtgggaagtgggaggagatgggtgtctgtgtggtttgcactggtggtggtggggaactgagcagatggttgtgatagccacatgctgcgtgattcccgtgggagttgatggtggtgacaggcgactcacaatgtgctatttacagtttgggtttgcagtctttcggtgacatctgaatgctctttagcaactgctttcattactgcctttcgaggagctgttaattgaaaatgaaattgtgggtgggctttaagacaggcagacgcaggcaattctgtgtggtaaatgttgcttgagaactgttggatgtcttcatgcccaatttgtaattcattttctaagactgtaaaagccaaaggtgcatttggagattcagttatgtatatacataggcagagttgaatgtcacaccttgcccaaagggtcaaacatacagttattggtatgggtgctgtggttcacgcctgtaatctcagcactttgggaggctaaggtgggaggattgctttgagcacaggaattcaagaccagcctgggcaatatgatgagaccttgtctctagagaaataaaaaaattagctgggcatggtgacgcatgcctgttgtcccagtttcttgggatgctgaagtgggaggattgcaagggcccaggaagttaaggctgcagtgagccatgttcacgcaactgcaccccagcctgggcaacagagcgaggtcctgtctccaaaaaagaaaaccacacaaaacacctatttgtctggaaaccaacctaggggaatgcttggcaatcccagctgcctgctcatgtcttacctttgtgtagttctctttaaatgtatacaactgtgtgaggttcttatgtaaaatctgctgacatcttgtagtgttctctgtgagtttatcgtaggacttcatcctcctttcttcctttagctcttcataaagttactatgcaggagtaaatggttatttgttctcttgaactttgggatacatttttccttccgtatccaaggaggattctttccaggactccccatggatactaaaagctgtggatgttcaagttccttaaataaaatgttatagtatttttatgtaaccaacacacatcctctcacaaactttaaatcatctctaaattatttataatacctagtacagtgtaaaagctatgcaatttgttattatattgcattgtttaggcaataattacaagacaaagagcctgtgcatgttcagtatataagcaaccattgtaggccacatttttggtctgccattggttggatccatggatacagagggccaactgtatcatattcaagttcttacatataactttgtttcttgtaaacattttcatatgatacaactctgttaaaggcagttggagcccagaggcaaacaagagaagaaggaagagagagggtggattttattggactttgacagtggttgatgatcttgattctcttatggctgcccccagctgcaggattgtgatttgtttcttatcttcagagttgtttgctaaagcattagtagcattactgaaatggtagcttttgtaaatgtttatatgttgaattgttttattgcccatagctttgcacagaaatcttgtgctgaacaaggaatgacctccctcttggaagtgctgttaactctctttttaattaaatatgaatatagatacaatataactgcatttttttagttttcccttgaacatttcagtgaatactatctgggacaaaaccgtgctgaattatacgctttcactactatcactctttgctcttagagagcccccgaggcttggggtgaggagacacaccccttgctgtacttaaccctcagtcccattagacctgctttgccacaggaacccagctgttttaatgcatttgagttgctgttgggtcctaatgatgtttaaaagaacctgtcttggtattctaaatgaactctggagcattgcctattgatgcaagtgttgatgattttatatcaggcagatataactttgttatttactctggggctttttacacctaggggtgtgcatcctcacaccagtgctcacaaagacacacacaggagcagaaaccaaaatagctcacaaatgtgggcaagtcctgtgggggaccaccttatgtctctcaggaggcctgatgagctgtgccatgtggccttctggaacattatacctgcattcattgatcacagctctgcagaagctgccacttctcctatgtgcctgcctgcagtgacgctgatgtagcaggtcattctgtaatcactgtttgcacctgcatttgctcaggaagtgtttgctcatacatcttgaaatcatgtattacaaacctggacaggtcctaattgctggtgatggttctgagaggttgagattggctataattagatggagaagcaattagctacatattctgagtagggaacatacagaataatgtttctcaaagggtggtctttgaacccctatgtcagagcaactgtggatcttttgttaaaatgcagattcccaggtaatcaccttggcatagtccattgggtgggggtcagggtgtggcaacaaggaactggagttccttcagtgactccagtacaggtgctgcaggagccatatttttaaataaactgtacttattttttattttcaattaaaaattgcaatattgttagcaaaacttgggaagaatcataaaattgtaacaacatatcttgcggaaattaattttatcaataattggatcatatttttgttctgtacatttactaattgagttatcttccaaaatgtattggcaagaaagaaatgtttctgccagatgatgtagacattatataacaaaaaatgatgttttcaaaatagctactttttctaggtgtttactagaatggacctgatagaataattgtattctagtattctctccttaggcccactggctcactcaaataatagctgtttataaagatgctaaccggagttttttatttttcatttttttaaagttctaatttcttgttttttcccatctgtagacaatgatgatgagctcttaaggtttatacattttttgaacccttcaaattacaaaagttggtgatatttggtactgggggtcaagtgtgaaagaaatctgaaaatattgcccatatcagtggagactaaaggccatttgttattttcttcattaccagcaaagcttcagtttaataaaaatattataattgaatttacgattttgattccacaaattcaaaaagaaatattttcctttctaaagccaaacagaataaaaattctcataagaatttttgtttaaatagcaaaacctattcttaggatttaacaattgcctgaggtttgtcaacagtaggtagcattctttttttatatattgctatgaggccaaaaatgctattttcctggagattagtgcaaaataatctaccgaatagttgctaatgaaattatcatatgagaaagattattaataatgacttttgattttaaaaaatactatcatcaaattttcctaagaaatgatgatgagaaaagcagttttgaaatacaaagctgggtggtagtgggcctggtgtgcactgctggaaggttgcatggtactttgtgaaacttcagcagcccacttgcataatttatcattacctgtcccctacctctctctacttaattctgaatctgtatttctcagataaacatggcagtaggaaggatagggaaaggtgttgaggggatgtgattatatggatgtttttgaaggggagtatattggtgtcatgggatccttgggatgtcatcttgccagctggaatcctctgtggcaggggtaccttctctctgagtattgctcatgctcactgggcactgggcttgttctgcccagttggcccagcaggctgcacttggctcatgctactggcccagatcccacacctgccaagggcgagccaggcgtagagtggcaaggggtgtgtgggtgagtatattagttcttttccacgctgccaatagacacatacccaagactgggcaatttataaaaaaagaggtttaatggacttacacttccacatggctggggaggcctcacaatcatggcagaaggcaatgagtagcaggtcacatcttacgtggatggtggcaggcaaatagagcatttgtgcagggaaacacctgtttttattttattattttattttttatttctttgagacggagtcttgctatgtcacccaggctggagtgtagtggtgtgatctcagctcactgcaacctctgcctcctggtttaagcgatcctcctgcctcagcctaccaagtagctgggactacaggcacctgccaccacgcccagcgaatttttgtatttttagtagaggcagggtttcactttgttgaccaggctagtcttgaactcctgacctcgtgatccgcccgcctcggcctctcaaagtgctgggattacaggcgtgagccactgcacctggcctgaaactcctgtttttaaaaccatcagatctcttgagagttactcattatcacgagaacagcatgggaaagacccccatgattcatttgcctcccactgggttcttcccatgacatgtgggaattctgggagttacaattcaagatcagatttgggtggggctacagccaagccatatcagtgagtgagcctggggtatggccactgctcacagccaggcatgcctgctgctgcggcagggtgggcagccccaggcaccagaacaggtgctggctccatgcaaggctgtggctggacaagatgtactgcatgtggcttccactgtgggcacccctgtctggatgagggcaacaaggtggcacccagaagcttggagataccaggaaccacagagccccaaagagggtgtcacagccctgcctcagggagcccctaggtctgggctccctaaagggccgcagctcttctctccttctcattaactgcaacgtggcgagcaggggggaaagtgtgtttcagccctgtttgtgttacagctcatcagtgctgccattcaacaggtctcgagttcatgtcccatgcctaggaagaatgaggtacagcagacaactggagtgtgagcaaggcagagaggagctttatttgatccacagaacagctcccaggagacctcaagtgggtaactcctttccacaggcaggtcatccctatgagtgtccagctctcagtggagaggcgagccgcagtggtagctcctttctgcagctggtagtccgatgtctgtttgagcctggctgagtctcgggtttttatgtgcttagaagggaagaagtacatgttgattggtccatgggcaggcctggaaaaagcaccatccgattggccaaatggtcatcaatgaagtcttcactctgggcggcagactccaccgggaactggcaccctggccgctaggcttcaggttgtccctggcttgaaggtggaatttcactggggacctgtccctttctgccctgaaacctgtctgcctcccaccatcaatgtgccatccatggcactcaggctgttgatgccaagggacacctgtaggcccacgctgagccaccttcagtcctaccttggcctccctcttgtgctcatgggtgcccaaaatctggagggggtgctgaggtggcagggggctggcgtgtcaatgccacccgagtgcatgcatgcctggccaggttgtgacagcactcaggcttagcctcaattttcctctgaaatcagagtgggctccaggtatggggagaagccaggtatggggagaggccaggtagcgagagtaggcacttccaagactgctcgggcaggggcacttccccaggcgcctgagagctcagggatgcctgggtctggagccacagctgggcagctgcatgtgtgcccaggagcatgaatctccctctctgccaactcagtggagggtggggctcctgcctgttcctggccccagccggctcctcagagcatacagccccggctgcagccagcatcttggcagcggctgctccagacaggctgccactgccatcactgggaccatgtagggagtatattagggctgccccatggttctccagatagactaaggagacaaattgacatagtacagtattagaaggaaagaatatggagtttaaaaaccgttttcatggtcattctgcccctgctcttctcttccccctttcaaactgagcagacccatatttctcctttcatctctgtccttgagcctaccttcagctctttggctttcattttactccctccttccacccagtgtcttttgctagcttcttgacccagccaggattgcatgggacatcacttagatctgctctcagagtcacaaaatgcctttgcttcctgtttccttgttccttttactgtgctggttcttttcggtaaacttttagatttatcatctctagattagtgcagcattatttagctcattgctattgtactctggtttaaaaaatttcagtgaccatccacagccatctaaataagattgaagcctcttagtataggacattttaggccctgactaatcctgctgcaatgtaccttcccagttgcctttcccactctctgtaaacaccaagctgcaactacaactgctatttggatgaaccctgtgttttctccacattcctgtgcctgtgctttggctattttctttgtttagaatattcttttttgacatatttgtcttccattgactagttcagacccacttcttccttgaagtttttatgatctttttccttgtaagtaattgcattgtcttcccaactcttatgatcctttgtttataacaagggtcaccccagaatttatcagctaatttaggacattactgggaatgaaagggggaaccattaataattaccttggaacaataagcattaatcaggacttcctgaaaaactgggatatatagtcactctgtaattcacttttggcctttttcataccatactctgttttgagttggaggtatacattttcttctttccactgaaatgttgagctcctcgaggacctcactgtgtgacacagcaaggggcctaggcttatgtcacatattgggaaacaacacccttaaaaccactgctatcctttactcgaggatacccttctcatatttatagtttccattcatgtctctttccagtcttttctccatatgctagccagagtgatcttttaaaaatatacatatgatcatattattcccacaagtaaatcctctcaactgcttctcagggtattcagattgaaaatcagactcccatcatctgcagtgcccagttatccagtgctgtttcttcagcttcatgtcatgcttcccttgcttactggctccagctcccgaccttccattccctcccacatgccaagttccttcgtaccctggacaccttatgctatcctctttggaagaaatggttccccctctgttttttgaatgatgagatccttctagtcctttaggcttgaactgaaatgtcatctttcataggggcttttctcgaccatatggtttatttaactcaggatctgccatttgtcttctgtgttttgcactcacctttttaacttcctaacaccacatttataattatagatttttctttctatgtccttccttatgtctgcaccttctgctgcactccaagctctactgaggagagatatcacctccaccacagtgtttgtagcacattgcctggcacacagaaggtggcactcaataattaaagttgagtggtttgaataatttttgcaatggatgacattgctaattccacactcctgttacattccaactttaattggctacaaaaaaaagcacacacacagacacagacacacacacacagacacacacacacacacacacacacacacacacacacacaaacaatccagaccccaatacagtatgactgttgtcttctctctctggggatatgcaatgtaaaataagatactgatgagcgcatgctgcacaccaagcaaaaatttatcccaagcaacccctgcgccctgcgtggaccgtgtctgctgttctcccatggaatctatcagcagtttgtcttcccagggttgtagcctgtcaggatggtagaattgctagtgcagccaggaaaagctgacctaggaaaaccatagccttccatctttttagaggtaatccaaaagagactagacaagcagaaagacggagaggaaagttggtgggagtgaggtgaaattcactgagtactcttttatatgcaaatatttgtgtggggctctacttttttaccatgagtacaaactctttttagtatcaatgcatgaatagcgtgtcttttcactgaaaaattattgtcccacgtgccctcggtttaaaatgttttgatcttagaaaacagtttatttccttttaaagtggcccaattaattcattttccacatatttgctcattgagcaaacatcaactgaacatcgtttgtgtgcaaaccttatacaagaaactctgacataacagggaggatatgtttaatgataactctgcccatgatgtgtttatggcttgctagatccattctgacccacctattgtgaagagttcatggagagctcttaacaacaagtgaggctgaggctggcagattaaatgcagttcaaagggagacaaggttgaacatctcctagagagggaataccttcagagatacatattaaagttctttaaaattgtttctttcttattgtgccatttttgttgacctcccttctgtccttttaagaaacttttgagaaaaatgcattattctaccgaaagcatcggcaaatgttggaaatagtattttgtgtatcagttttcttggctgcttatttttaaaaataaaggcttaaataaggttcgcacatttttcactcaggtgcaatttactgggaattacctggcgcattggttttatgcttaatatttacagattattaaaatctcagtggctttcaaactgcatggaccaagaaaataggtgtattttctagaaatggttttgcttatggacactgacccactttgaaacgacttactcttggaactcttagtacaggaaagtcttatgtttctgtctagaggtggaactgtttatgataaatagaaatagctttccttttctatcatttctgttttcttggaagtagattatttttgatgcaagtagaccttcagaatttgaatagaaatttttatttatttatttatttattgagacggagtctcactctatcaccaaggctggtgtgcagtggtgtgatcttggctcactgtaccctctgccccccgggcttaagtgatccttccacctcagcctcctgagtagctgggactacaggcgcacaccaccacacctagctaattttttgaagagatggggttttgccgtggtgcccaggctggtctcgagctcttgagctcaagcaattctcttgccttggcctcccaaagtgctgggattacaggcgtgagccaccgtgcctggccttttgaataaaaatttagacttcagatttatatagtgagtatactgatgggagattgaacaattacgtgatctcaggagtagattatagagctgtttctaatttactatcaagttatttttttcccaaaagataatttataaactgcttttttgtttgtggaaatcctgtttgttaggaagtgttacaaatggtagtttcccagtgaatttatcaaaatgctgtttattcaataacattcactcctccaaggatactactcactgtcccttgacattcattcattaaatatttattgttcatgtactgctatggacagacataattttgggtgcttatattagtgaacaaaataatgaatacatctgccctagtggaagttacattctcttcatatattaaattctcttagtagtatacagcttccatttaaatgtttaacccagacctttcttctcaacttctagattcataaactcagctccttatcagagttttgctgcctagatcattcacaaacatttcaaactcagcatatctcactttgaaatctataatggtggtccccaaattgctcttcctcctcaatttccttccttactgtgtgcaccatctgctaagcatccaagccataaatctgttcatactagaaacctgcaagtcaaactcctcttcccctcttccccccattcttacatcctatagatttttatcctatgtatttcttatctgaccctctctcttcaatgttttctatccttcctgcgagtgcagtagttcaggttctctttctcttggaggtgtgatgactagcttctcatctgacttctcagcctctaatcttgccactgttaaattctgctcctcaaattcctccattattgtgttcttgacagcatgcaaattgaatcgtgtcatttgtttcaagagttttcattgactttacttataggttaatttcaactttctttatatggtatagaagcccacacatttttttgttttgttttgttttagagaggatctcactctcttgcccaggctggagtgtagtggtgtgatcatagctcactgcagcctccacctcatgggttcaaaatgtccttctgcctcagcctcccaagtagctgggactaaaggcatgtgccaccacacctggctaattgtgtgggtttttttttctttctttctttagagatggaggactcactgtgttttctaggctggtgcccacacattttaatgcctttcagagcattccctttttttttctttttttttttttttggtgcttcctaatcccatgcccctatcacatcagacttaatctattttctataatgtcttccttcacccactcctacaaatctgaattttttttttccttcagtgagtctgatcttagttacatgtgagaaatgtagtcctactaaatcagaaatggactatactacctcttagaataacatctcttgaaagggatcccctatagctttaaggggcctgctggttttttgttaacatgggtgaattgtatagtggtaaaatctgagattttagtgcacccatcacctagtaatgtaggttataactacatattgtagtagttacaatatattgttttttgtccctcactcccctctcactctgccctcttctgagtctccagtgtctgttatactactctgtatgcctttgcatacccatagcttagctcccacttataagtgagaacatagggtatttggttttacattcctgagtcacttcacttagaataatggtcttcatttccaaggacacctttgttgttgttgttgttgttgttgttgttgttgttgttgcgacggagtctcgctctgtcgcccaggctggagtgcagtggcgcgatctcggctcactgcaacctccacctcctgggttcaaacgattcttctgcctcagcctccctagtagctgggactacaggtgcccgccaccacacctggctaatttttgtatttttagtagagacagggtttcaccatgttggccaggatggtcttgatttcctgacctcgtgatccacctgcctcggcctcccaaagtgctgggattacaggcttgagccaccatgcccagccccaaggacacatttttaaactaagaaaatgttcagtttgttagaatttaatgtggcatagggaaaggaaaatgaattttagaggaccagtcttttacaaaagattactgcaaattttggtggtttcgttcaaaaacgtaaaaaagatcaatttcttttttcataatggtagttgctggacccttgtattggtgtggccattggagattacagaagccttttgttactggaaataattttcaggcctcagagttgtaagtcaagaattgcctatactgaaccctttggagtcttttcattgttacgaggtaactttgcttatgtgtgaattaatgcttaggctttcaaagcaagaaaaactagacatgatatgaactttgtcattctgctaagttaatactgaaatgaaaacttttactgatacaaagacatttctgttaccagtaaattgtgtagactttgtgaggattttgagatgtgatttatattggcttattttttaaaaagctggcttaaaaagtgaccacaagtgtgctaaaaggtttatttgaggtaaccacagtattatagttcccctggcataattattccgtattttgtttccatgagtcaaggcacaaagcaaggataatcataatgattgtaggaaacagcgcttagagctgggatcctaggattttaatactaggatcttttacttgttgcagcttccacattcctttttgaaaagctttttttaaacaatattttttagggcacaggcgaactattttagcagaatgaagcagtaatttaagaaaaatctttatattcctgtccatttccacattctttctgaaaggctactcttgggggtagaaatacagctgtggatgaaaagattgaggtaaggaatacttttctcttaaattcttgtagcttgggtcattaactattgtcatatatgtcgacctagttcatggcagccagaggagacaaggtataaaattgactgggttgtgattcagagggggaaacaatggaaaatatattgaacacttttacattactgagaccccttctacacttttttcctctttggttttagactgtataaagtattgtgttggtactgtagatacagcgtgtggctattgatattgatataagaaaatctgttaaggttcctctttcagcagttatggggatcttcattcagagcaataagatcatttctcctaggtgttacatgttggcagactgaagaagacaaagacgtcttgtcttcacattgttttatggccacgactttgaattcatttgatcacttaagaggtatcgcagacactgtagctaattagaaggaagggggcagttttattgtgaatatgttcagtgaagaagatagcagtgtttgtattgcacaggctgtatgaacgtgtattttgttggggagagagagactgagaatctggattcttgggttaaagtttctaccttgctgctggcactttgtccttaaccaagttattgctgctctttgaccctcagtttctgtgattgtaccagaatgcagatgttgtattcttctaacactgtgaagatgttatacatgctggagtacttaaaattccctcttccttaaaattgagaaaaaaaagtagattaaaaaaactaggaactacctggactttgataatattaatattttagataaaccagcactgaagtatgtgatacctacaaagaacaacacctcaagagtttctgctttgtggtaatgactcactttggtaaaattatgctgtgcacatggttattagactactgtagataccagtgggtacattagattgaaaaacgtaaatgaagtggtcttatgtatacaattttttgcagttgccttttgttgggaagagattaatatgagatagtgtaacttttttgtttggggtgggcgggggtgggcatgcctattggtggtgatctgaggattgtaactttagatcttttacattgaaattatagaaatttgattgttatggataattcatggtgaaggaatgtaatgaaattattattattattatttttaatgactaacccatgttcctagatgtattcatttttggcttagctctcctctcctctcctctcctgtcctctctctttctttcttttatttttttttagagagggggtcttgctttgtcactcaggttgaagtgcagtggtacaatctcactgcagtctgaacctcctggctcaagcaatcctcccgtttcagtcccctaagcagctggtactacaggtatgcaccaccatgcccggctgtttttgtattttcgggggaggcagggtttttccatgtttcccaggcttgtctcaaactcctgagctcagagaatctacctgccatggcctcccaaagtgcttggattacaggtgtaagccactgtacctggcctgcttttcagtttttcagtaagtaaattgtgaggcatatatgttgattcttctggctttggaaaatccttccctataccctatttatgtagactgaatgaaattgataagatacagtattttcttcctagactgttcaacactggcgtgaaatggttcttgtgtaggactccttgccctcttccaggtagctctctttattcagtacatgttttacatgcattctctgtgtttcaaacctgagagatgtcagaggaatataagagatggtccctattttccagggcttcacctctgggttaattactttgggacagtttaaagtaaataaactgtaaaaaaatactcttggaaaagttggtgaatgatacgtgcttaatttttcactaatctccctcgtggtttttataatgccatgtgtttttcttgggagggtttccttacagctgtatttgtgatcttgggctagaatttatgagctgccaccatgaaggtctgcctctggctttggcatcagagatggcgagttgtgtggtttgttttcttattgttaatgtgagaatttttcctaatcaaaataaatgcctatgtgtttttcctgactttcttgttggattgactaaggaagttgtgtgaattataaaaatttcttcctgaaatgaaggacaaaatttccaaagcaggatgcattgagattgtctgaagaaatgtatgtcttctggttttagtatttagacttgaagtttttttttttttttttttttttttaaccgtaataactaggaaaagtagaaaagttaaaagaaacaaaaaacatcacggtgggaaatagaaggagaaaaccagacatttatgaaaaccattctggatctcacagatgctattaagattagtaaacgttggccgagcatggtggctcacgcctgtaattccagcactttgagaggcagaggcaggcagatcacctgaggtcagaagtttgagaccagcctggccaacatggtaaaactccccatctctactaaaaaatacaaaaattagccaggcttggtggtgtgtgcctataatcccagctacttgggaggcctaggcaggagaattgcttgaacccaggaggcagtgagccgagatcacaccactgcactgtagcctgtgcaacagagcgagactctgtctttaaaaaaaaaaaaaaaaaaaaaggccgggcatggtaggtcatgcctgtaatcccagcattttgggaggctgaggcaggcagatcacctgagggcaggagtttgagaccagcctgaccattatggagaaaccccgtctctactaaaaatacaaaattagtgggcatggtggcacatgcctgtaatcccagctgcttgggaggctgaggcaggagaatctcttgaacctgggaggcagaggttgcagtgagccgagatcacgccattgcactccagcctgggcaacaagagtgaaactctgtctcaaaaaaagaaaaaagaaaaaaaaattagtaaatgttgactagtctcagggatatttgagctgcactcagtaggctactttgcatttgtaaaattctcacacatcaaattgcatcatctttggctttttgatttcatgcacgcagtctgtgaaaggctaagccaggtatgtggttacatataaacttactaccaactagcgctgtcctttttctactccttaagaggtttattggggcaataaactgttggcattattactcacctagcataagctgatcctttctttgactgtttttaaggaagatgttgttttatctgctaaaacaggtagcacgagattgacttcaccaaagcctcttctaagactttagaaatggcttaagcttcgctgctttcttagcacttttactgtataggccctggtatgtggtattgatacatacagtaagtataaatgtgagaagagaaaccacattttcatgctcttaagtgatccatgctgttttcacttctcagggtgatttttggttgtagccaactcagaaactctcaatttaatttgagattgtgtgaattgctttcctagtctgtacaccagaaagaatgcttctctccttacacatttcgacacttcttagtgaagatcatttacttatagagtgtatgcattatattagcatatggcctgggtaacttcagacttgttaacatagcgtgggaaaggttactgaaagcatgaggaggcagtatattatctctcagttgattttgtacaccattttgaatattttctgtacattccctttcctctagtgttggtttcttatacttatagtaaagggaaactgatgttgatattgttcaaaaaagaaatgaagtgaatttttgtatttttaaagaataaattaacatgctttaaagtgcttaaccagttgttacaatatcagttatcacagattggtatgcgttggtccatgttatgtatttgcctgaatcaaccctaagactggttggcttatttctgccttttcttttccaaaaggtatacttgacatgaagtagactgtgcctgtttgattttaagttttgaatatggtgggaggtatagattaaagttaatttcttttgcatatggatattcaatttttctgaaggcatttttgaaaaagctgtccattctccacctttgcattgcctttgtacttttgtaaacaatcagttgtccatgtatgtgtgagtttatttctatactctctattctgttcctttgatctatttgtctatctttatgcctatactatactgtctttattactgtagcttgctttgtagtaagttttgaagtgagataatgttacatagttttggctttttaagattcttttcactagcgtatgacttttagaatcagcttgtcaggttctataaagaatctggccaagatgttggttgagattatattgatcgtgtgatcaatttggggagaattgacagtttaaaatattgagttttcaactctcgaacaaggtctatctctctatttagatcttacttatttccttcagcaatattttgtacttttcagtatataagcctttcatatattttgtcagatttattcctatgtgtttcatatttttgatgcagtattaaatggtggtgttttttaactttagtttccagttcactatcaatatgtagaaattcactgatttttgtatattcacttgcattctgcaaccttgctaaactcacttattagttctagtagttttttttgtaggtcttactggattttctacatggatgatcatatttttagtgaatagaagcagcttatttctttcctcctaatctgggtatcttctctgtctttttcttgtctgatttctctgtcaggaacttacaggatcatgtttaatagaagagacaagactggacactcctgcccttttcctgattttagggggaaagacagaatcttttgccattaattctgagcttagctatacgtttttcatagtgccctttattaggttgagaatgttccattctaagtttgtcagaattttaatcaagaatgcatgttatattttgtcaaacaccttttttttgtctatcaagatgatcatatgatttttctttttttgtttattaatatagtaatacattgattggtttttaaatgtgaaaccaaaatgctttccttggtaaactctatttagtcatgatatattaacttctaaatagattgttggatttgatttgttaaaaatgttttaaagaatttttacacctgtgttcatgaataaaaattggtctgtagttttcttttgatctatttgtctggttttattatcagagtgatgctggcctcataggaaaggtagggaaatattcccttttcctcagtttcttagaagagtttgtgtagaattgttattatttcttttgtcttttcttttctttctttctttcttttcttttttttttttctttttttgagacagagttttgctcttgttgcccaggctgaagtgcaatggcgcaaactcagctcactgcaacctctgcttcctgggttcaagcgattctcctacctcagcctcctgagtagctgggattataggcatgcgccaccacgcccagctaattttgtatttttagtagagatgaggtttctccctgttggtcaggctggtctcaaactcctgacctcaggtgatccgtctgcctctgcctcccaaagtgctgggattacaggcatgagccaccaggcccggcctgttatttctttcttaaatgataggtagaatttgtcagtgaatccatctgggcctagagttttctttctgtggaaaggttttaaatgaaatattcatgttctttactaaatattgaactatttatgttatccatttcttcttgagtcagctttggtaatttatgtcttttcaaggaattttttcattttatcaaagttgttgaatttattggcataaaattcatataatattccttcattatccttttatatctatagaatctatggcaattctatatctgttgatagcctcctttcctcccctcttctctctctgtcatatcagtatgactgggagtttattaattttattgatcttcttgaagaacaagctttattttcattgatttttctctgttgttttatatttcattgatttccttctttctgcttactttagttttactttgcttatttttctggcttttaaaagtaggagctgagtttgttgatttaagatctttcttctcttctaatatagccttttgatgctataaatttacccccaaatattactttagcagcaccccaaatattctgatctgtggtattttcattttcattcagtttagagtactttctgatttcccttgtgacttctaattgaaacactccaaatattttaggggttttccagggatctttctagtattggtttattacattaaatcagtcaattaattaattaagagacaggatctcaccctgtcatccaggctggagtgcagtggcgtgatcatagctcattgcacccttgaattcctggtttcaagtgatcctctcatatcagcctggcttttaaaaatcttttgtagagatagtgtcttactatgttgcccagcatggtcttgaatccttgctctcaagcagttttccctccttggcctcccaaagtgttgggataacaggtatgagctactgaacctggcctggaattggtttcttatttaactccattgtgatttaagacagacaaacactttaactgggtatggtggtgcgcctatagtcccagctgcttaggagatggaggtaggaggatcacttgagctagtagctgagtttagcctgggcaacatagtgagaccttgtctctctaaaaacaaaaaacaaaacacacctagaaacaacattgcttgtatgacttgtatccttttaaatttattggcacaattttatggcccagaatatggtctttctttgtagatgttccctgagcacttgagaggaacgtaattttcttctgtagttggtaggaatgttctataaatgccagtcagcccaagttggtttatagtgttgctcagttttattatatccttacggattttttgcctgcttgttctatcaagagaggtatattgatgtctctggctataattgtggttttgtttctttgttcctattgtcctgtgctattttgaggctttgttatttggtacataaacatttagggttatgtggtattgattgattgatccctttattattatgagatgaccacctctatccctggtaatagtctttgctctgaaatctatctgtctgtctgtctgtctatctatctatctatctatctatctatctatctatctatctatctgcctgcctacctacctacctatatctgtcagtcatgtatctcactttattatctcttttaattggagtattttccattcaaatgttaggtttgagactttcatgttgccatttgttttttgttagtcgcattttttttccttaccctctttccctgcagccttgagaatgaataaagtatttaagatttcattttatgtcttttgttcccatattagctacaattattttcctcttttttttgtggttgcattagggaaatactatatatacactatatataataaagatatataaatatatataaaatatatataaagatatataagatatatagtatatataagatatatcatgtatatatagtatatacatataaagatatatataaagatatgtaagatatatagcatatataatatatagtatatatctatcatatctttatatatataaagatatataacatatatattatatatatacagtattttccctaaagcaccacgaaaaacaaggaaataaaaaattgtagctaataagggagcaaaagagataaaatgatatgttaaatactttattcgtccacaaggccgcaagaaagagggtaaggaaaaaaatgcaactaatgaaaaacaaatggcaacatgaaagtctcaaacttaacatttgaatggaaaatactccaatatatttatatatatatatatatatacatactatatatatctttaatttacagtggtctaccttcacatgatgttatatcacttcatgaataatacaagaatattatatttactcttctatttacttacatttacgcctttatagcctttatactgtcgatgacatgagttttacttttgtatttgttaaaaaggctacaaaacattgttactatttctgcttaaacagtgaattatcttttaaggatattttaaataattaaaaaaaaaatcttgtatatatccccatgttttcacaggatccttagggtgtcacttcgtcagccagaaacctctgtggccagcgttgcctctgcttcagtttttctcattcctgctgggctcattccacccactctgcccgacaggctgcgctcagcttgtgctaccaacctcggtcctacgccaagggtgagccacatgcagagtggcaaggattgtgtgagcaagtgagcgcagggtctggccactgcacacagccaggcttaacggctgctgcagtggggagggcagctccaggtgcccgcacaggtaccggccccatgtgaggctgtggctggaccagatgtaccacaagtggcttccactgtgggcaccaatgtctctggatgaggggaatgcagtggcacctgaaagtgcagagaccgccaggaaccacagagccccaaagaggggtattaccgggctacctgaagggctgcaggtcttctctccttttcattgcctgtggtggtggggtgttatcccatttgtgttacagctgtcttagtcttgccatctggcaggtcccaagttcttgtctcacatccaggaagaatgggttatgtggacaattgtagggtgatcaaggcagaaaggaactttattgagtgacagaccagctctcagtggagacctgaagtgagtagctcctatctgcaggcaggtagtcccagtgagtccctgagtctggctgagtccagggtttttatgggctcagaatttaggaagtgtgtgctgattggtccatgggcagccatgggtgggcctggaaaaagcaccattctagtggccaaaaggcatcaaggaacttctcactcggggttatggactccactcagaactggcagcccagcccacagacttcatgccatccctgccttgaaggtgggatttcactgcggacccaccctttcctgccttgggacctgtctgcctcctgccgtgatcaacatgctgtccacagtaaggctgtctgtgccaggaggcacctgcaggcctatactgagctgccctcagcagctccagcctccctcctgtgcttacacccaatgtctggaggggcctgaggtagcagggggctggtataccagcatgaccctgagtgtgcacatatgccgctaagtcataacagtgcccagattggccacaactttgctccatgctgcattaggcaccgagagagcagggagaggccagagaagcaggagcaggcacttctgagcctgcagggcttcccgagcccccaagaacacatggatgcttgggtctgtagccacatctaggcagctgcagctgcagctgcacctgggagtgtgggttcctgtcccgccaactctgtaaggtgcagggctcctgctaggatcacctgttcctggcccttgctggttctaagtgaacaggccttccccactgcagcgggtgtcctcgcagtggccaatccagacgggccaccattgccaccatcaatgtggttaccatttcttatgcccttcatttctctgggtagatcctatttacatctgagcgtttttcttttgcctgaaggccttcttttaacatttcttactgagagaatttactgatgatgaaatcattcagcttttgtatgcctgaaaacatcttcactttgcctttgttttcaaaatttttttctgggaatataattttagttggacagttactttttcttttagtaatttaaaagtgttgctctactgttttctcttagtgtttgccatgacaaaatttgtgtcactcttagtttctggtaatgtaacttgtctttttttttgactgcttttaagtgttttctctctagtgctgcttttgagcatttggttacattgtgccttaccctagtttccttcatgtttcttgtgctttaggtttgttgagcttctttgatctaggattcatcatttttatgaagtttggaaattttgggttattatttctttaaggttttttccccttctcttctgctttaccttttcagggactccaattaaccagatactagatagtttgaactcttcctagagtttcctgtgctactttgatttttcttcattcttttttctctttgcatttcagtttggatagttgctgtgtctcaggttcaccagtcttttcttctgctatgtcaaatctgttgttagtcctattcaatgtgtttttcatctccgacagcagtttcatttctaaagatttggttacagtgtttttaaaaatacttacaagtctctatttaactgtttgaacttttggaatacaggtacaatgattgtttcagtgtccttgtttgcaattaacctcagtgccacttctgggttgttttcactttattgattattctactcattatgggtcatgcttttctgcctcattgtgtaactggtgatctttggatgccagacattgtgaattttaccttgttggatgctaggtattttggtatttctataagtcgccttgagctttgttctgggatgcagtaaagttacttagaaaaactttgatcacctggagttttgttattggcatttgttaagggaaatctggaaaagagcttagtctaggccttggttattcctcattacttttgcaagacctttttgagtattcaatctaatcatctgtgaagtatgagttttttagtctctctcatgggaacaggcactgttcagagtcctgtgcgagtcccaagaaatgttctctataattcttttgggtgtttctttccccagccttgagtagcgtccccctgctttcgagccagtctgtactgtgttgcaggtgaaccctctgtagatctccagggctctctctctgtgtaattctcttctctctagtcctctatcctatgaaccccagctgccttgatgtcctcagactcaactctgtctcctcaattcatcgagttggcctggttctgccccagtttcatctcctggtattgcaccctggaaactctccagacaataaggtgggtcagttatagggctctcatttgtttcctgcatctcagagattactgtcattagttacttcatgtctggtatcttgaaaaccattgttcatatatttttctgagtattttttgttgtttcaggcaggagactgtatctagtcactgtttctccatcttgaccagaagtggttctcccatatttcatttaacaacatcatgaaatctctttcagccaagctcaagaccataatttgtccttctctgccttctcttttgacccaatgccttgttctttcagtcttgtcagttcttacttcctagtatatttgacattcttttgtacttaatggtaaaaatctttaggtaaacatcatcattattaacttacactaaaaaatagtaaaatcattggaatggagggaatattgtcagaatagttataagttttggtgccctatcccagtgccatctttaaggtgagtattcagggaatatttcttatacatcttaattcagtgtaaaatttgcatgttttatatgttgatagagcagaattatttcaggatgagtatatttgtttagatcttttaaaaaatgtatctttagggaggtttgtgcttttccagactgagccagaatgctcgtactgcattttggatttacacacacacacacacacacacacacacacacacactacttttttactttccagtttcccctgttacttggtgtgctgcttgaaaccagacttgccattcttacatctccagaacctcataccatgcctggcatagtggcactcaattaaggtctgatgatttgtactgagtaagctatagttttaggcttggagcattgttaaggctttgcatagaatctctgcattatacagaatcttaactgtctctacattacagtataatccacatctgcatctttgcagcttgctattatacatctttggtttgctgtgaaagagctgtcagagaatgagctctttattgcttagaattactagttaactattgttttgccattgatcagaatgtctcctttttctgttctgctgtattcattgtggtattttgttgtaatcagagatagtcttggaggtgcaagacttattggatctccgtttgtgccattgtcgcaacatcactgacttggtgaggatcagtcaggggtttcttccttctgtttttgtcatggcagtcttactttttgaaacatttgtcaccttctctgatcctgcctcctgcttttccccatctgcactctgacctatactgttttagaaggaaaagataataaaggtcagattttataaaactctgttcaagaaatactgcataaagggctcttcaagataaaagactaccccgcttgtcaggcagcctgctaatttgagagtgctgacgacttaccttgatgaggcaatcttcgaattgatgactctttttaattaattgtcttttcattgataaaacagaattgctttgttttccttttactgcccatctcttcctcacaaaatatgtttcctctccgaacacacaaactgtgttttcagaatctcccctgagtctggaggtctggacagtagtgtgtttgtgtgcttgtgtgtgtatatgtgtgcacacacatgcacagcttgtgtgcatggtatctgtgatttctgtgtgtgcttatatttttcactattttggattcatccagttctataaagacatacttgcttgctttgcatggttctggctccctctgcagccccaaatggaaaagtgctttgttgtcttttgttgctgaaaaatccagctctcggccttctttctttgagtagagcatcccagctggtatacaagtatagattggatttcagatttagcaatgcattgtgttttgacaaagcttattgaagatggaagtcatttttcaggagcgctctaagaggtgagaaaatggcaagggagggtggggaggaaagggagaaaatgcagaagaggcagacacaattgcaacattgatttggtaaatagaaagttaatgtagctacaggtattgacagtaaactttggctaagatattggagaattgcagattggaaggctagagctatttcagaatttccagggccattttattggattatacaccttagaaccttaacacacagcttctgttgattagtacagtttggcctccagtgtgagtttggctttgaacactcagtgtgactttggctagggcttggcacctgtggacttcagcttctactttagtaaaatgaatgagttagaacaaataattgttacattcaaatccagatttatgagtgtacgatagtggcttcacattatttgttttaagttaccgttgagaatttggttctcagtaatctagagctactattttagcagaattatacatgggatgcagaatagaagcttttaagcaacagtcaaccagattggtctataataactccaggataaatacaagaagaatttctggacacattttgccccagtgaagtaaaattatttacattcaaggatggatttggaaatgcaggtatttttctgttgatctgcacgttggttacactggtgtgttcagtgtgtaattacacttccatgcagttatttttgtttttgtgttagatttcaataaactattattttttctaacagatcttaaactttaatgcttctttagagtactaatcaaagtactgttacataagtaatggctcatgtgtgcgcacaggtgtctgctctgtgaagtagtccatttcaaattataccacattaaattgtgtctgctttaaagggttaaaataagtacatgtatatatttagatatataagatgacttctatttaatagataattagaatgtttatgtaatagatttatgctttcagagatttcatattcacaaagtaagttttggaaccttgaaacatggataggtcagtgtcatttggtttcttttttcttcgtttaatccttttcaggacttcggctccctgtgagttgttaatgtatagtgtttatgaatccaaataacattcattaactttcttggaaggtcacagttatgttggttctgttcgaaataagtactataaattttttagaataaaaaaggaaagtattacagtgagttttgctatccacttgccactttcctttcccttcctttttttgttttttgttttttgttttttggtagggagggaggtctccctgtgttgtttaggttggtctcaaactcttggcctcaagcagtcctcccacctcagcctcccaaaatgttgggattacaggtgtgagccattgcacttggccctttcccatttttgtgcttgactagtataagtgtcatttttgttttcttgaaacctttgttctttcccatgtgaatacacataggatgacaatagtcacaaaactctttccgtacttagaagactaaaaccagaaattgttgcttgaacatgtaatggataattgttaaaattctgcactggtttgtactgttctcgaatttttatgtaaaggtctagtttagagatttattatttttattgtttagacttaaaaggaaaacagttagctgcggaatctagtttttatcctggagcgaaactcatataaccttgttgattttagtgggaattagaaagttcagactctttttttagaggtctcccaaaattgtttccactctatgttgaaaggaactctaatctacagaagtggaggtgacagtaaggagggcaggggatgctcttcccaaaggagtttctacaatgcagctgagttagagtgcagtagaaagagcgagatctcatagtggcatgttcctgtcacagcatgtgtatagcagtcacagactctgaacccaaagactgtatttctagttggagcagacattgactcctttttctgggctgaaaacagtgaagtgtattggttttggtagcttgggttataagaaacctaaattagtttgaagtggaattatcctgatgaaagggcagttgaaagcccttgacactggacagaggattgtctagtgtctaatcttggctcaaaatgcaccagacataatgagagtcattatgaactgctgatctcctacccctcccctcagcagaccctattagacttgcaaaaatagcaaacactgtgtgtgtttggcatggtgcctgctgtgtagtagaggaagaaagcgtaccttgtttgcaccacaaccagatactggtgcatcatgttacagctctgcttggttctgagctcctctgttcaatctcgtcttgacagatgctgtcgttgccaccccttagcaagacaaatgcagccactctgcaggagttggcttttgcccagctgtgcttgccagggccccaaactgatgtgcgtgtgtacctgtggaaaggtaacaggctgtgggtgtgttatcctctgccattatgtgcattaccttttgagtttttgccattcccgaaggaaaagttacggttttgtttgttcagataaatctgaaccctcaatttctcttactgcttttttcacaacagatgttgttaggcacccactaaagatccccaggaagggtccctgccccatataagctcactttctctgtaggtagaaagaaatgcaaacagtcacataatcacaaccttaatagctatgtgtataaaggactctgggaaaaaaggacggaggggatctttggaggtgcatgccaggagagagttgtctcatacgagctatgaaggttaagtattgcttaggaggtgtagatatatgtgttgccagggtccaaggtgaaaaaggagaagtggtttgaaatgagcttggtgaacctaggtttgggcctggttttgaaggctactggcaatagggaatcatcatagaattttaaactaggtgagtagccttttcaaaatttttttaggaagcattattctggtttcagtctggagaataagattatataaaaagtgctgagagttggaaaagtgccagcctattatgttgggagaaggaagcatggagaggttttagatgtgaccattagttcagatagagtagtgaagggagataggacttaaccaacaggaagagaaattaaagagagtaagaaaggaaggtctaaggttttcagctaatactccccaggcatagtatttatagggaaacagggaaggtagatttcagtttggggcagactggatttaaaatacctgcggaatatgtaggtattaatgagtaaatttcagtgtgaagtttgtacccagagttgagaatagagcaggctgggcacatagggttctgggataattgatgttacaaattagagtctggtttagcggttagagccatgagaccctctaatccaagtttgatgtcccatggcagtttgatgcaggatgggaccaacattatagacctactgttacctgctaaaaaaggcatttagtatatttcactcctgagtccagaaagccatttaccaagagcatatctgaatttgtgcggcagggaataatataacaatgagttctgtgtattcacaatttaggaattaatttcacaagaccacaggttggaaattcttgtcctctaatgggattgagcctttgtggaaagagtgtcacctgtattttcctcatctcagtagatgaagtagttactgtttctttcccacattcagccaatagcatacattttgtagaaagcaactaaagtttttcctccaaagctttaggcctcttctctttcagttcctcttggtaagacctggcctgtattggtcagtctgcctgttctttctacttggcttacaccatctgcccattgggacctacagattttttttgttttgttttgttttgtttttgagacagagtctctctctgtcgcccaggctggagtgcagtggcgtgatctcggctcattgcaagctccacctcctgggttcacgccattctcctgcctcagcctcccgagtagctgggactacaggtgcccgccaccacacccggctaattttttgtatttttggtagagatggggtttcaccctgttagccaggatggtctcgatctcctgacctcgtaatccaccagcctaggcctcccaaagtgctgggattacaggcgtgagccactgtgcctggctgggacatacagatattttttggctgcttataagtttttgttctcctaggggatttctgggacacttaaatatgattatatccatcagtgaatgaacaatccatagagttgacatcagtggtaaatacagtaatgtgagagtctaaaacgtgagccaaagttccatttaaaagatctaaatgcaaattatctcactaaacttgagaattattgatcatctctgtccctttctcctttttctctcccttttctttccgtcgttcctccctctcttttccctttaccctcttctcttcctttccccgctccctgttctctcttctctttcccccttttttcttcccctccatcttactttcccttctctctcttctcatttgatataactgacagatttgagcagaactgtgaggctcttaggagctgtgtgtgatgtggagtggccagatgactttatgtgagtatgcacgagggactgtaaagaggctgtccagaggccagcctccctccaggttgttcctaaccctggagagtcatcatatgttatttctcatctcagactgccacagaattgaggagggagattgaaggcagctcattaaaccactttggccacagataagagtgttaagagattaagaagtagatttatctgggggaggggtttggtcccggatgaagccttttcctgccgtcggaaaccaaagatttccttgtctcttttgttctgatccatggaatggtgtggcttagctgcctctaaatctgttttggcaaggttgtttgtaaggagacatggcagggtctgtctggagggaacagaaaagagagtacatattgaatgtagatgcttgaaactagatcatagtttacctaattgcagaccttgaagaaactcttggggccacttggatgggggtgcttctggaagtttgtctctgggggtatgtgagtatggacctcttccacactgagaagagggcagagcccagtcatcagttttcatgtccctgagtacaatattaggcttctttttattattatcattatttcaactggtaacaatgtttcccctcaggaaatgtctttacctctctgaagagaagaccgtgatgccagctgttagtttgagaaatgctgcagggtcctctcctacctgctgtttctgtgctctttccatgtgttgtggtgaagcccctacctctccagccatggggccttgttcttcatcatttgttcctatcttcagtttgggatgtggcaaggagaggcagagtgcactagagaaatctgatactgtaatgtgctaggagacagcatgatgagaggttttgggtgggaagtccatgctaaacatcttaaatgcttcagaaacttctttacagaattctctgcctttaggattctcctgttcaataaatatatttttcaccactttagaaataatcttcttaaagcccttccttgaactcatgcatctgtaatgactgcccatgaccagcagtactacattgtggaatgcaagacctaattagtctaagcatgaaagaccttttagtttcatcagctaagcccccttgtcctcccaggcattcctctttccaggtgctgtctccttctgcagcttcccgtaggcctcttcccactgctctttctgctcttctataaaactccacatttaatgcctacaccttaccaaactccaggaaacttccttgactcttgcgggctatatggatctctacttattttagtttttgctgttgcaggaggaaagtatgatttttaaaatacaataatccttttgtatgtctacagaagaatgtggtttggtgagttttacatttgatgcatgattgtatccaccattgtgagattataaataaatctcaagacatgaccttgccctgaacccaaaactaaacatgaatgaaactatagaaataactggataacctctggtacatagagggtcggtgttacagggagataagcagtacaccctaacctagggaagtgcaatgagcagagaggggatggagtatgtaggtggagaagtggctaagtgtcttagatagacaaggtggaaccaaagtacatagagcctggaagctgcagaaaagaacgtaggctaagaaacaagatcaattataggtggttgagtaggtgagtaagacagaaatgtgtgaggtgattggaagggactgctacgataagccagctgtgcttacaatggtgaagataaggaatggtgacttgggaagatgtattggagaaaaatgatagggcctgctgactgagcagctcaagctttatgggaactgctgatcatgtttttaactgctatagatatatttgatttaagtaaatcaatttgtaaagatttagatttcataatgatatcttagaccatatttgcacagcaagtgaaacttaaatactcttgtatccctatcacatcatgttatctttaacatgtgtatcaactttcttacctataaatgctggtgacacctcccagttttctaggcttaatttgtagagggctcaacatgtgaacaatgaatttggtgcaccattcaagaagtaaaattcaatcatttttttctcctattcatttctaaggataggaatctttgccttatagaaatattttaaaggagcccccttaaatgtcacactctctttaggcttaaactattcttatttccaaaatgtaacatcagaagttcagaaattctttctacttaggttctctgtgccccacacaacctcacatttttgcctgagtctccccagtcttgctgcaggagctggggtagcttcagcccacttacatcctgccaggggataaacttgataccttttgctttcatgaaacactatctgtgtgaagtgagctctttgatccacagtcttttatgctgaagctaagggaggattaaggaacacctctgagttgatgaatatttgatgaggtttatataatttaaaattacactcttgttaaccctttcactcaatggagagagaagagaaacttgtataatcgtggttcctacttaggcataaggtactgtgtcttctctgggtgcatcctccttatctatgtagagcagagcatgggaacttagtaaatgtcaattgatgattggcattttttacagcttcatagagagaaatatctctttgcttcattataaccatactgagtgagatgctgaagtggaattgggatcacacagtatctgtgtatttgacattgcatgtataatggtgaacaaggcagatattccactcatcataacaacaacagtagtaatcataccaccaggaagcattctttcagtgcttactgtatgcaaggctctattctaaactcttttcatccattttaattcttagaacaaacttataaggtagatgctattattatcatttctattttataggtaacacaacccaggcacaaagagactaactcccacaaggtttcacaacttacaaatagcagagtcaggatttgaacctgggcaggcagttctcagagcctgcgttcctaacttctggctggacccctcatggtgagaagggcagagagttgacaaatcctctgaagtatggtgagttctgtaggagtctgcaacagggcgaattaacctagggaagaggaaggctgggaaggctttcctgagaaaatgtcttttgggatgaaacatgaaggatgagtaggtgctctctaggtgagggctcatggacaaaactattccaacatgtgtagtggccacaggctggacagaataaaataggtgatttggaggaacaacagagagaagcccattaggggtagagaaagtgagagagtgtgtgtcatggagtgatgccacaggggccaaatcatgaagtcctccgtaggtcccacttccaggatgtgggtcatggaaatataaagggctaaggacaaacggagcattcaaggggtagaaccatgggtataacatgatgagatgtaagctttaacgtgtttctcactagtgatgtgtctaagtcatagagggagacagtagaggacaagagtgcagtcaggcagctgatgctgtaatccaggtgaaggaggatggcagcctggaccaaggtagtagaggtaaggatggatagaagcttaggagcttattaggatgcagataataggagttctggatgtgggagatgagggtgagggaggaaccagtaacaatgcctatgttaacagtcagaagaaggttacaatgtaaccagactggaacatgaacaaattatctgcagtggagcttatttgctcaaaagaaggatcctgcaagagaacatggatggcttgtgtcatccaaatatggatggctttgcccagttagagaataattcctgctgagagaatacacatgcacgcaagcatgtacacacgcacacacatttgttgtagagggttataccctcccaagttaaggtaatttcataattgaggtcgaccctctcgatgtggtaccattgataagccccagcactacagttcagctaccaacactgagtttctcattgagtcaaagcgtgggatgatctgacagcgtcagcagcactgcacaacagtgggagggacggatgaatgccacatctataaggaattgccacttggattcaagaggaaaaggggtaattatccacatgggtaacaatttcagtttcatttctcccttgagctaactctattcacctcaaacgtctttcctgtctagagaaccaccaaaagtgtcattctgattaccatttgtaactaggtgttttctgcttaacatttggaactgggtggggtgagataaattccaagaagatgggaagtttttatattgcagtttatactacagcagcagctccagtctgccctacagaccttctagattttttttttttttttggctgtgtgacaggtgcctgtggagtttatattttgatatttgatcaaactttttaaacctgagcttgtagtaaccattatagtcgtcatgcttgagaatgtgtatttgctagtagtatagagttaacctcagtttatgggggcagggattactttgtgaggaattaaatgtggtgtttgaaaaactgggaagtgaagatcttctgcaacacaggagtttctaaaggaaaaacaattgggccagactggatgaactggttagattaaatgctatcttcctgactcagggttattatttttggttgcttattttatttttaattgttgaagatttattgtaccatgctttgctcaggacagtgtgtaaggtatttagggaaagacctgaaagagacaggaagcatgagcccttccatcaggcacctgaataactgatggtggacatattgagaatacgtagaaaatttgtatcttatggtcatattgcacttcagacttttcacaatgcccttgtatctctgttacttgattctagttttcttggctcagcatgcacagttgttttctttacttgtttatggtctgtctctcccacttaaatatcaggtccttgagagcagatacttgttctcagctacagcccagcacctagatcaatacctgacatattgtgggcactcagtaaatcttaggaggataaatgaacaaaaaacctatcttctgaatatcagtgataatcatataaaacaggcttggtatgctaccatttatgtacttctgattttgtgttttgacaggttttcacctaaggtttgtagtagttggttttcctcagagaagtttttgggctatttttctttttaagaaagggtgagtgatgtcattatgaagttgaagctataggactaatcatatacttgccctgcatctatggtgacttttttttctactggaaagaaagcccgctattaaataattattacttccaggtctgagggagactgtccagcatctgcaagagttttgctaggatgcagggctttgttcccccactgggctgtgattccatccatggagtaagctgcattgtggtagcaagtcatcttgacagtggcaagtatagcatatttcaactggtgatttctgcatgatttgcatgaatttctgtatgacaggagtcacaacaaaactgttacgtgacttgtgtctaaagctatcagtcagctggagctgtgaaaatcagtttgcatgtgtcaacaatttaatcttctaatatgcttgccaatagaaaactgacactagaattatttttctgtatttactgactagaaagatatggttatcaagtgcactgattgaaaaatctttaaattccagtctttaaatcgggaccatatgtgtgttctttccctagccaaatctatttgtgcattcacccacacatgtgtatacatatacacacacagtacagttacattgatatgtgtttgcgttatatatgtatgtattcacacagagcatgcatatgcctcatgcatattcatgagctttaaatgtgcttatagattaagatataaggatgttggggaagtttccctatctgttaactgagaataatactactgcctaccttccaagcaccttgtaagaattaaattagttaatataagtaaagttcttagaacaaggcctggaacatagtatgtttcctataaatattagcttttattattttagagtatgtcttcattctgtcagcttcaaatgggcttcaaaatttagcttcagaggcagtatggcaaagcctcagaattattgcataattcatttgatgaatttactgttattctaaaatgcctgcaaacaatttatatgtcatgcaggaaatattggtatttgtatttctaaatcaaagccatttattaaataccttagtcatattgattcctgttatagtaaattacttctctttctatgtcatcattatctcctagggtctatcagggagatattttcagtgaatttgtctttcattatcagactaaaactaacttcactgaaaacatcttcatttgggatttgaaagagaacaaattttccatttactaagaaaaaaataggtgtttgtgtattggtataaaaataggtatgtatgtaagtgatcaaatagaaaataatgcaaagggacatagaagaatttgggaatggaggtaacatacacctagaaaaacagtgacaagggcacatactattttgaagcaggttttagcaggtaatgatggtactcactgtgggaggaaggtgtgaatcatcagtcaaaacgagtgtacaaactggtgatatgaaatgctgcttaacagttgttttaaataattagatttttgttggggataaatagttcattccagacaaaagtactagggactctatagctcatctaacttcatagattaaaatgaaggcccagataattaaagtgaagacctcagagttagttaatggaagtgcaagtttcaaaaccaggctgcgatgtgggggagacagtgtcctccatgacagctctttaacagatggcatagaaactcgacttgtgaccttgaggggctcacttcagctctctaagaataattccagcccagagctacaccatatatagagtctgtagactattcctaataaaatggttttcttgtcttagagaagagaaactcagcacatacctactttgagtcaggtttgggcatgctcgaaaagggggcagcgtttttagatggagactgctggagtagactcagggtctctttcagcatggctgcctgtgtgatttgattcatgtgcactttaaaaacctgttttatctaagtgtaagactgtagaagacatatatatttagggtattgcattgatttttggaaaccatttgtgtagggtacagtatctttgaatttcactatagtaaccgagttacaaaatgggccactgggtctgctgggctgagaaccatcaaactgaatggtcagcaactttgttcatgcttcatctactttttcttttcaatcatttggggacagataatcttttggtcgctttttagactaactttgagattcagaggggcagtgtattcttggctaaaactttttgtacgaggcacactttcttttaaggtttgtgattttacccttacgtatcagatttcatggtatccaaatgcaaacatgtatttaacagttggtagggatgggagagtttgaggacagcaaagcagcctactttgatgaaagggtcagatagattttaggatctgcaccctttcttagcatcctaagcattttgagaagcagttgtatgtaggtaaaaacaaacaaacaaacaacttggtagttggtgtcagctgaactgctttttactgaatctctgctgtactagctgtgtggctctgaggcttacttccctagtctgcaaagtaaaggtaatgatacctgtttcacaatttaaaaaatagatttattgaaatatatttcacataccataaaattccactaatttaaaatatatagttcagtgattttagtatattcacagagatgcagccatcaccacaagcaattttagaacattttatcacccatgaaagaaatcctgaacccaaaagggccatttcctccctaacttccctaactctaggcaaccactgatctactttctgtctgtgtggattcacctgttttggacatttcatataaatggaattatataatatgttgtgttttatgactgccttcattcacttagcataatgttttcaatattcatgttgtagcatgtatcagtacttcattctcctcaccccccagctttatattaaagtataattggcaaaaaagtacatatttaagatgtataatgtgatgatttgatatatgtatatattgtgaaataattagcataatcaggttaattaaacaccttaatccaaatccattgccttgcatagttaccattttttgttgttgttgtttgtttttttgggtttttttttggtgatgggaacactaagaatctactcttctagtaaatatcaggaatacaatacaacattattaacagtaatcaccgtgactgtacattagatcttgagaaagtacttattttcacaaagtttgtaccctttgatcacatcttcccatttcccttgtccttgcccttggcaaccaccattctactctctgtttttatgagttggatttttttgttttgttttgttttcaagatgggctcttactctgtcacccaggctggagtgctgtggctcacggcagccttgacttcctgggctcaagcaatcttcccacctcagcctcctgagtagctgggattataggctcgtgcccaccatgtctggctggctgattttttattcttatttttattagtgacagggtcacactatattggttaggctggtctcaaactccaggcctcaagtgatcctctcatctctgcctcccaaagtgctgggattataggcgtgagctaccacacacagccgaatttgatttttttgaattctacatgtaaatgagatcatacagtgtttgtatttttatgtctgacttctttcacttagcatatgtcttccaggttcacccaagttgttacaaactgcagggtttccaatggtgtgtagtaaaggggatccttgtatcgtgttgataggaatataaattgggacagcattatggagaaccgtgtagaagttcctcaaaaaattaaatatagaactgccgtaggctttatcaaatctgcttctcagtatatatctaaaggaaatgtagtccatgtctcaaatagctatctgcactaccatgttcattatggcattattcataatagtcaagacgtggaaacaaccttaagtgtccattgatggatgaatggataaagaaaatgtgatgtgatacacacacacacacacacacacacacacacacacacacacacacacacacgcacgcacacagagacaccctctgttatatgtgtgtattgtattatggaatattatttagccataaataatgaagttcactaatttttattgccaaatcatactccattttatgaatatatcacattttgtttatccattcatcagttgatgggcatcatatttttgtgacagtgaaataagacgaagtatataaagtgctttatgatgtcttgaatatagaagcaacgtgtgttttgttgtttcttttcgtctggttggtagatttctggtgaattatcagccgcccctcttgccttgtgaggcaaggaaagcagtcttattgagtagaccatctgtctgccagttctctcatgttagtcctcaactcatggaaaatcctggtgggcactcgtttgatactagaattcacactgcttttttcagcagccagaagtgtttgagtgttaccagcagtgcttgttgtcgttacagatgctccgtacaaaactgtaaatgctgggtttaaagggattgagggagggagccattgcggcttacacagatgtcaactaatctagtgttgatcctcattctgaacctgagcattgacaccaatatcaagctgtggggtagttatgttgtgtgcaaggcttggagggaaatagtgctttggcagttcagtgcttgccgacttcacaaaacacagaaaattgctgagggcttatgtgacagaaagttcatgttacacatatgggcatcttggcgagaaaagccactgatcgtctcagtgtaaggatttggaatttcaaaatcctaaatgattactaaatgacaagtaaaatcttgattgagatagatcgttgctaacgtccaaagagattatctaaaagcattgatttttattttgttggctgtggaaataccgtggaattcatttattaaaagtagtatgtctaagtttctacttattttagatactgtaatataaaattataaacaaggcccaattgttgttacccactaggcagatttttttattatccaagtttctgtttcgggccatgaaacaagttaaaatcaaaactttcgctggttgccattttaaagataaatttgttatataggctttctaagcttggttgccttgctccacaaagacaaaacattaataatagcttacatgtattgagcagtgaatctgtgctaggctttgtgttaaccactgtatatttggattatctcattgatctaaggtaggtacggttgttattcccttcttataggttaggaaactgaggctcagagagattaagtaacttgcccaatgttacacagcttgtaagtggcatttctgtttaaagcttcccattttataaagttttgtgtttttaaatatgctttagaattttaagtttttactctgttattatttcgcgaagtcctatgtctacatacacatcaaagcaattctgtggttcttagggaattatttaataaatgaaatagccatagactgtaattacattatgagtggcatcttttagctgtgcccagcggtagcccagttgctaatctttatcccttgagtagtcaagtagataagaagtggataagcaagtggagtggtggccactcaagcaggcctccaccagaataattccaaataacttcacacagtgaattgcaacccactcaatccacttcactggatagcattgctcaaaagatattcttttactcttttatctaccttgttggcaagcatccccaagaggtcttatgcctgtggcctacagatcaaagatattttctcaaatactgggaactttgctgctagttagaattaagcaaataaaaacatacacctccagaatgtaagcaaactagtttaaaacactccagccattgtattacttatgctttaaaagtttccccacaaaacctcattaatcatataaatattttgacaaacagaaaggggacagagcagacttattattttccatcttgtatgaatggctagacttttcatctgtgctcttatcctaacatgtctttaactcttctgtgctaagatttttatttaaaaacaaggaaattgagactcagtgagatgaactgctttatatcactgtggtaagatgtgttaatagcatttgaaaaggaaaagccaaaattttctttcatttatttatttatttatttatttatttatttatttatttatttattttgagacagagtttcactcttgtcacccaggctggagtgcaatggcatgatcttggctcactgcaacctccacctcccgggttcaagtgattctcttgcctcagcctcccaagtagctgggactacaggcatgtgccaccacacctggctaatttttgtaatttttagtagagattgggtttcaccatgttggccaggctggtctcgagctcctgaccttaagtaatccgcctgccttggcctcccaaaatgctagaattacagacatgagccaccacgcccagcctatttcttgatttttattagtcacctagccttattgtaatttgcacttatctaccattagaacatcataaacccaagtgatgaacagaatggatgtaacttagtgcgtgtatgtaatgcatatgatgtaacatacataaagacaaatggaaaatgcctgcaagatagtttccctgttgtctcatgcctcagcagtaatgaaacatatactgagtgcttattgtgggtcagttactgtgttaaatgtttgtcacgaatcatcccatccagttctcacaatcaacctgtcatgtaggtgctatttttgtccacatttttatagataaggtggctgagacttagaaaaagctaacaccacttgcctgtggtcatagagctagcaattagcaaagccattgcttctaaccagtgtgcattttgccttgcacaataaactacattaaaagatttactttagtttttctacctcccaattgaagccactatcagatatatagtctaaacttagatttgattctgtttagaaacacttaatgttcctaatgttatcaggaaatttgctgttcattttttcaagatctgagtagaatgtcacattctccatgaactttccatgatgctcttcttccaaatgtttctgtagcacctggttgtagcctggctcttaggattcccctgtctgtgctctggacttctttagaagcaccttgtctggttcagttactgcctttgtttgtattgctggcacattcctttgtgcttggtgcatagtagataattaatagatatttgttaaattgaactggatgcttaataaatgtttggatctaattatgatcttaactctggtgtgtacttcaggtacttcaggaaggtcattgcagcattagatgactatggagaccctcagtgttttagactgagatgacttgccattcctacaagagatcaattgaatgaataattggggctgatttttccctaagtattgcttagaacatatactgttttttttctcctcaaaaattgccagttatattgccatactggacaaaataaaactgttagctatatatctatatctatacctatataaattttaaaaacgtagcacaaagtttctgcaccatactttgtgagcagctctgtgtattccaaggctcagaaaatcagactttcaaagctaaattttaccaatatatatcccattgaaatttgcatgagcaagcagaaataatgtggatgttggagttaggtaaatgaatcaaatcctggttcagccactttctaggtatgtgattttgggcaagatatttaatttttttcaacatagtttttttatttttaaaatggaaaagttatgcactggcagatttggaggatgaaataatatgttgggagacagtgtgttaagttacttctcaaaaagttctattataattataggttgctaatttttggcatattttcattttaaaacttttattctaatttcattcttaaacagtgtaagcatattcacagtagcttttctgatcaccttatacccaagcactgccacatgacttctggtccagtgttccaagtgaaggccaagtaatgtcaaggtatgctgtatacggattttctaggagtgtgaataaagaagaggaatggagccatccatggatggcaaagtcatgccgttgcaataagtactacatttacatatttagtacagatcccatcttagaaagggtggatttggtcgggtgcggtggcttacgtctgtgtgatttcagcactttgggaggctgaggtgagcagatcgcttgagcccaggagtttgagaccagccaggacaacatagcaagacctgtctctctctttctctctttttttttaaaggctccctgctcatgaggaatggggagagggaagaaagggtggatttggagaaggttatagcagtgagtatggctgtaaatttgcaaggaataactttttttatttccaacagtgattgctttagataaatattttattgtagatttcaatattgttgcaattgtatttgactcagcaaaaatagtttttataatttgtcaacagaacttctttaaaatggcttcctaagttgtttcagctaattatgaggtatggtgatctcaacctccttccaaccactggtccactcttgagtcttcaggcttttttttttgcttcaagagtagcattgtaagtttttagtcttcagagaacaggaagaattctagtttctcagttcttgttctgatcaggattgtattttcttttcgtcagtttgtgctctgaaactgcagggccaggcagagtccatgctacctgataaagcatctggaaccatggaaaactgagggtggatatgatgagcctctctaataccagagatagtggacagaagccatccgttttgcatttggcttttttgaggactcagtaaatccacacagagaattagctaaggctgtttgagaaacagcctgtgggataatgaacacttttatgctttttaaaatgaccacggggagcctcatcagaagaggcgattccaggattccaagatggcagctgggtttttcattgttcctgtgggacttgcactgtgaagtgtgattgtagctgatttttcctttcaacaggaattcattaggggtatccattagctaatgaactattgatataagaaaaaaggtcagttattttagagaggaaaaatgtggctttaactctcgattatttgtgtgttgggtccatttgaaggcttcttcccctggctcaaaatctggaaaactgatttgaaagaccttcagttttatttagaaagaaggaaaaacagattatttcagttactttatgttttgtgatttttactcgatttacctaaagagaaagtgctcagatttaaattctaggtaccttcgttgctaattattttttactgcacttttatggccattttttatttctaaggattgaacccttttttttgtagttttctctcaagggctaatatttatatttttttgcttccaaaaactgttaaagtctgaaagtgtaaatttatatttgtggtgtttactttgtcctttaaatgtttttgtgtacccatactttttgtcataaagatggaaaaatgatattaaattaaccaaatgaaagtaattaatgctgaacattcactaaattattaagatgttaatgtgattccaaatgcagatagttcatgggcagcagcatgtgtcctgggactccccctcaaaggttggcaaggtttgggcaattttgagggagggagttaattcttaagtagtaagctttttcgtttacctctactatttataagctaatatgcaggatcattgtaaattagtgaaaagtgcattccattgaactagtagttgtaatactgggttaaatatctaagttgtgtgactttgggcatgagtttctgcctctgtgggtcttatttttccctgttatcagaactgtagcattggactagatcatgtttccttgtgtgttttttggaaaatgtgacaatatactaggacctacatgaagtcacagtataaacacccaagggacacaacaggcatatcttcctgcctttcatatctattcacttgaggcttttggtaagacattaattttatacttaagcaaacatattaaagactgaaaggaactcatatatcttcatatagtgttaaagatattaacacaaaaatgaaagaaatattgtccatacagcaggccacagatagatatcccttgttttgtgatcagtcttttctgctatggagggcactttggacacatttgaggatcactgcattagatgacaggaaatgtgtttcttcctatgctcaagttgtgtagccatgacatttgaggatatttacattttgaatttccctcctccctcccctaaattagtggcatgttctagagaagggttcatgtgctttatttacataaaacctatctcaatgttgtttgataagaatctgttaagagatcttgtcctaaaaggatggcacttagtgttggaactggagaatggtggggtgtgaggagttaaagtaattccctaagcacactagacacgcctgatgcccctttcaagccagtctgcttccacgtggtgattctttctgattcccattatcactgtgtccccctcacccctgccatttagcctagattctggcagaatggaaatccacgtttctgaatttagtatgatttttttttctttccttctattctcagcaacaataagtactcttgatggcagctgctgtattaagcccaagagcttaaaagattaaagaaaccactaacagcagtaaggaggaagtttaagggcctgtttttctgaaggtttgtgttttcattctgatggttgagtagaaaattacaaacaggttgtgttcggcagctggaatgctctccaacatctggggagacccagccttctgtttatttcccattcattggaagggtggccagccagtagcagaaactgcaggcagagatactagaactctttgggtacataagccgttagaaattctttttttgtagaaatttcttcatagaaataccttgttctctattttttcataagcttgactgagcacttaacttcaggtcagttgctgaggaagaggtctgaaggtaatattagtacccccccaactactttcagctggaaacaagagttgtttgggcccttactgagttcctactttagagtcaagggctggccttcccctgcatctgtctgcatatacctcacagctgagcagataacatatttgtgcagctattcccttatgatttcctctctattagagagaggtggagcctatgacagactgcagagtgtttgctccattcttccccaccccgtagctttactgaggtatagttgataattaaagtatttacatatatttaaggtatatagcttgattatgagatatataagtatacattgtgaatattcaaaatcaaactaatcaatcactccacatagttaccgcttttctttttatagtgagaatacttagtatctaccttcttagcaaattttatttatgccacatagtgactatagttaacaatattatatactcaaacccagttattttaatttttaatttttttagagctaggatctcgctctgttgctcaggttagagtgcagtggtgctatcatagctcactgcaacctcaaactcctgggctcaagcagtcccgccatctcagcctcccaagtagttaggactacaggtatataccgccatgcctggcctaatttttatttttagagatgaagtctagctttgttgcccagactggaatgcagtggcatgatcatagctcactgtaggctcgaactcctgggcttaagtgattctcctgccttggccccccagttgctgcgagaatggtgccttgttctcaaaaccattttgtaaaaagtaatgtgctggccaaataaaacagaacgccagtttgttatttttggacagcttcattattttgtacatgggaaaagagaagttcgaagttttgccttatgcaaggtcataaagctggtcagtggcccaaccaggtttagaacctttatctttggggctatttgagaaattcaagtgatcccagttcaatcattagtggcatttgtggtcttcagtctgcactgagcaagggtttcatgtttggtgtctaatattttaggattattagagctaatctagcctttggagaagccaaatggattttgggggttgtctgtaagaacccatcatgatggctggaacagctcttaagtggaacttctacataaatcaacttgcatttgttctgtaacaccatgtgaattttcctgaatttccaagtaaatatattttgcatattgcttacaaattgcttaggctgtcttcatgaataatgaaagctgtgctgtaggaagctggatattaagaaggggtgtttttaaaaacagtatttcatttcttttgcttatattttctgtagcctcaagggtgtgttcagaggtggtagggagggagggtgctgttaaggtttctcaacacctgtgttcctttacagaccattatctcttctgctatcaaagaggacttgccagttaggtcaggatgcataaacctctggacagtgccttctcctatgcttatctttgctatatgtcttgttgtgtgtttagcttccataacaaggttctctacttctccagtttaagaagaaatcatctgttgtgctgaacctctattcatctcagtagggaaggcaccagcttcaagaggctgagaagagacccagagccagcaaatgagacatggggttttattaggggcttacatacaggggagagagtccagtggtggcagactggacaacatactggcaccgctcagtggcagagggctgggcaggaaaactgcagccgctttgcaaacagcatgcagtttatatagcattttcaattaacaccctccccttaacaactttcacctggcaacttgcatgccaacccaaagtttagggcctcaattccctgtatggcccatgttccgtggcatgggcagggggctcagatgttcctcctagacaaggaatgaatctctggattggccactgtgggactccctagctcgacacacacattcaggtgcatctgccatacagtgtcattttaagggtatgctcaagttattgctctcagaggtgtttaccctactattatcatttgacaataatacctatatgtgacgtacattgtctagtgacagtcctgatttccagtagctcccacaacaacttcataagtatcatagccccactttttaggtaaagaaagcagaggtttggggattgtgtcttccctagtcgacacaccttgacagtgtagaaccagcattcagaggcaaatctcacttaggcctggtgttctttccaacatgcctcagctgctgctttgccttctctttctcccttcacctggcattttgaccacactaattgtgctggcatctcattccagggagtatgggatgagatgccagcactagagtatggctttcaaaacattttttgtcccagctcacagttacaaatacagtttatgtcatcaagtatacatacatatgcacatgctcaaatgcacatacatacctgtgcttacatgtactcatataaaactgaaagtttaattatatatgcagtaaactctaatatttccttttctgttttacactgttaatacatactcacctgtaaccgttattactcactaaattggttttacaatcaagatcacctgcggttgaaacagtgctatagagtggaaatctttacggtgagttatgtgctctctcccctcaaccccttacgagatttttaggataatccatgggagcacgaaaaaaacggttgaaattatattttgatttatttccatcttaaggaagagattaaatgttgctgttacttaatatccgagttgacagtgcagcatcactcgggctgtgaaacagtcagtccagtgctctgtagagtgtggcaggtcctgaaggaagagtgggagttcctaaagtggcacactccttcagcctttcgttgtgtgatgtgctccagtttgtatggctcataaagcatgttagtaggttatattatttacttttggcaaagagaacaagtggttttatttttatttttcttttgagacagggtctcattccattgtccaggctgtaatgcagtggtgtgatcacaactcactgcagcctcaacctcctgggcacaggtgatcctcctacctcagccttccaagtagctggaaatataggtgtggatcaccacgcctgactaagttttttctttttgttctttctttttttttttttttttggagagacggggttttgccaggctggcctcaaactcctgctgaagcaattcgcctgccttggcccccagaagttctggtattacatgtgggagccaccgcaactggcagagagcaagtgatttttaagagtttcatcaaagaaactgtggaatgagagaacataaacacagggcaacagcaggaaaatgacagagttgacttttttgttttaatgagctccttatcaaccgcatcgctgggtacaaacagcgactatatagtcatatctagtagggagtcagacaaaaaattgaagctattttaacaagtgagaacttaggtttatatccatgattgttaatgatttaccttgtcctgaatggatgttgtaccctgagatattagctaatatcattatgttggataaaatattaaaagttgtattcattttatctttgtgtcattccttatgtttatttgtatattttatgatatatgtgatatatctgtgccttatagttacatatatattggggaatatgttagaatttttttgtactgataaagattcctaattaaaaacatttggagaccatttctattctggaggactaagtaattattaatgggtatcttggggtctagatgaagagaaggaaaaggtgaggacacaggaagggagtgaaacagggagggtgtttgtgtacaaattagataacaaccctcccaagtggattcagttccaggggcacatggtttggtgagtggcctgtgccttcgtgcaggttataaaaagtctcccctttctcctggcatagcagctctacactagggcacatggtttggcaaatgggttgtgggctggaattcagcaccctttcagcccttcatccttctgcaagtgtagcctacacaagtaagtatatgtaacagccctggtggtgaggtactgaaaataaataaataaaagggcgaaggacaggcattcatggatgtagtgagcagcaacagctagtcctcactcttttattcattcattcattccttcaccagagtatttatagaacacctgctgtgtgccagccatcttcaacagcaggagttggcaaactatagcccaccggccaatcccgacctggtatctttttttgtaaatcgggttttattggaacatacctgtaccccttggtttatgtatcttctgtggctgcttcttagctataatggcatagttgaataattatgacagagactgtatggcctgcaaaacctaaagtatttactttctggccctttactgaaaacaggcgtgaacctctactctagaatataaatcaggacttgcttctggtgccactgcatgataacttagccatggactgtttggcttctatctcatgttccctacttgcaagaaaatacttccatcagggccaagtggaggtgcagtagagcaggggcagagctaaaagcaacacagctgggcacatttacttcttaggtctctacacaaaccatgtagtgtaaggaggagacaaagggctaggagtccagagactgacactgtgtggccttctctctgggcctgtttcagatagtcactctgcaactacaagatggcactggattagtgattctcagacgtttttctgcaccaaaatcacctaaaaggctggtttaaccgactgctaggctccacctccaaggtgtctgagtcggtaggcctgaggaaggcctgagaatgtacatttttaacaagtcctcaggtaatgcaggtaggcagtatgactggattgtttttgtggttgcctgcctctttttggcattggaaaggggaaagccagagtattccttgaggaatgacatttggagagaaccaaattttagatgcttctgtgatatgtacaccagagctattctggactagattgtaaattctcacatttcacctatgcaaaaggaaatactttctggtctcctattagtaatcagttgtctcaaattttgcccgttacctctggaaattctggaccctcaagtgatcagtcttttaaggcagtgtggaagaacagcacctattatggcagttgatttttcatggtctctaccctgtccttcctaatataactgctattctttaccttcctgtttttcaaaactctcgtattgttcctgttgtgttttttctaaatattttcttggttacaataaagtgctaatatttaaagagcttttgggagcctgctggtgccagaaactattcaagttacttacagaatactctcattcagttctctcaaaaatccttggggaagttttatttttctcattttacaaatgagcagtaattacaaatttggagtcagagaagctaagtaatatgtgatctggacaatttcaatatctatgtatatcaaaaaccaagcttcctaggtctttgacctcctctccagtatccctcaccttcacctgctaagtatccattctcattttggatctcggactttgttatcacctaggattcgcccaggatttcactttctcggatcatgaccttccacatcatactgtcactgcatctcaggagtctgtttcttggaaaagctttacgtctcttatcctttttcttttccaacagaaatacctttctgaactatttctctctcttaaacctcttttaaaatctgcacacttcatactaaattgtattgattatgcttctagttccctagtacataataacctttggaaaaattgttttgtcttactaattgtttctatagaactctgtactgcacctggtgtatagaaggcactccataaataatggtttaactgagctagagaatatatggccagggtctgagtccgagtctgtcttgcttcacagtatggctgctatagtcaggtctgccacagctctaggcctatttttttttaatctgtctggatgaagaaggaattgtttagtaggtgatgtcatttgtgggatgctttgtctatttctgcgtatccagcatgcttttagtgatttttcattttgtcagactgcattttctcttttcaactagagttcaaacaaaataattttagataacatcctaagaacatttggaaacatgacatttcaggtctattttccctctttgccttaaaaaagtatatacagctataattactaattgctgcgctctaagtagagacagatgatacatatgtttgtgacaattttccagagggagagctaagtaaccaggctcatttttccataatgtgaatgttattcacaaactattaccataattgatgcaccaaaccactgtagagtaaataatgtgttgtgtgtgggaagcaagctagtagtcaatgaatattaaagaacaaaacctcattttaaaagagaaactgtaattaaaatcattctgaattcatgctgcacaaccagttaaaataacttggctgccatttatctgtgtaattctgtgtataaagggagtaggtatatgatttgttatatagaagtaagtatttacatgcacatttttatgaaaagacacaatatcgaacttcagaatcagtcgttttccaaaaacatttgttggagagatgaacatgcagagttaatcagtgaaatatatattgacaggaaagatcaccatttccgttatcttatcttttgcttttctaggtgttttatgtctacctggaatgtcgtgtccctttccgtggacctaatcagcttctgtattttctccaaagcttccttttcatcagaagttgttcttgtccacttttaatccctcttactgctttctaggtgctcatcaacttctgtgtgtggtatattgatttgcacttttgggatttgttgttttataagaggaggtcataagtcatttcttgtgtgtatcattagtcttctcaacgagactgcctaggatttcagtctcagattattctatgtgtgtgttgggcgtgtatgtatgtgtatcattccttccggtgtaccttgtggagaatggtttgctgtccatgtgttcgctaactcctcagtatgtattgttggttacctgttttcatgcaccagatactgcattatttttgtaaaatctttacattttgtgtttggctaccagtgtctccacagagtcttgaatgtaactggtaaggatcagatctgttggtgtagagtttttgatggaacactcaatcagcaatctgtagtatggcttatgtaaaatgtataactccctctatctctgataagttctgaagtctaaggggaaagtgcttccctgtctcttgaatttgagtgttttgggtgagtccattttatagatagacaaggtgattgtatcagagcttacttttatattttaaaatggatcatagtgtacctattcttaggaaccttttaggaaaatctctttaacattgatcctgttgttagttgtaatctcagtatattctgataatttcctttgaatatgtaactgttcctttcatactgtgggcatctgttgtcttctctttttatagcaatgaaagtatgaacagattccaatgtgggttcttagctcaaaattctctggctctaatgtcaggccaatttatttagctagtttatacaactggacatatttctataatagaaaaatgactaaatgtttcttaacatattgtttacagagatagagcccatgttgtaaggctatgtaactcttcctctcaaaagaagattattggttttagcatgttttcctccctttaatttaatcttaagcaggtgaacctttttgagggctttttggaaagctctgaggaaaaaaaataagaaaactcatacaacctcaaggaattctaagtatcaaggagcacctctgtgaaggtgattggttcaagcattgaacactattttctatccttccacacatggcagggcattattcatgtatccagctctgtgatagcttgtttttgcttgccctgatgatacgtatggcaagggaggaatattatccaggagtggacactgtagagaggggaaggaaccttggaactgacctttatagaggcggttctcatcctcaactcttcttccttacaagatggcttggtatcccttgagatcattctcccaccttcaaaatcctggatgggcctcttgcctggttcccttaaggactctaaaccacttagcttggagctggtgccatttaattctgttcttggcagtgggccctggcttctttcctgctaggccctgtacctcttaggagcagagaagaggtcagatgcagataatacaggcatgatttctgcctcctgaaatgctcagatgatatgcacttctccgtccccctaaagatttaaggaagtacacatttatcatgggatgtaatgagtaggaaagagcatggggctttctttttctgctgaatagcagattgtaagatagaaacagttttgtttacaattcagctctatctttgtactttgcattgcagttgaagttatttttagctttactgttaagctaaacgtctgagttgtttcatttgcaaattctttctttgagggtcaggggaggcttttgtaaaatgttcaggtctgagagaattttgagttaggtaaaggtgagtgtgtgcatgcatgcatgtatgtgtatgtgtgtgtgtgtgtgtgcacagctcgtgcataaatgcctgtgtgcttgcttgggtagggactaggagggctgaaaaagagagagaaagtcattcttagcagaagaaaagcacgtacaaagggtggaagacgtacggtttttgacagatgaatgaatccttctaaaggttttgtaagagctgtgaccagctctgtttgctgagaaaagggaaagtccttgagcacccatcatacctcttcagactctcttaaaaagcattcagatgttctgccagaggaaatgatgtgttccaactacagctgcagtggagggttctttttgtgcagctgaagcaattcctccacatagattgtcccattttaacagtaaactgtctgtttaaaacaaaacaaaaaaggtgggtgggaaatggaaggagaaggagtttatgccaggaaatgaaaataagttgctgcagaagcctgttttggttgtggtttcagagttaaggataagttattaataataataataagagcccacttgatagtttgttatatctctgtgtgtgtttttatgaacttttaattttccagaaaacattaaagataaattagagaacacactcctgttggaggaggtgaccatcttgcagctaccaaaccatagaatctttcaccacttaacaccttccaaggaaccgggtagacttctggtgtcctctctggtcctcttcccttccttataggatgtcaggctttggacttaatcagaggataattaaggctctatcatagcaggtgaagtttctgagtggaagtctaagaagtgatgtttctataagtgtctttagctgactgagctactaagcagaggttaggaggttgtgatgtaatttaaagtgacattgtggttaccttttatcaagctcaattgtgagcctggagctatgttaactgcttcacagctatgagcctatttaattcttacaggaatcctcattttaagataggtttgattaccctccgtttacagatggggaacttgaggtagagagataagtggttagtttgcaattacacccagcatttggcatggctgggattggaaccaggggccttcagtcttcaaagctcttacatgtaaccactgagtgatgcattgtactctctcctgtaaagtagccttttctccctgctgccactggttcatttccttttccttttttaagatgctttaaaaagaacaaaaaccaataacgtacctcctaaattgaggttgatctccctccttcctatccaataagtaatgttctagactcatgcaaatattagatatttgggagaaaaaatgaatagaacatgtccctcctctctttagctctaagaaaatttgtgtgttcttattaattcctactgttccactatcctaccatattacctgatacatataatacagttacagtcttctcagggagactcttctatgcagtggcatgctggagccaggaaagcttgtaaacccagctcagacatggaccagctgtgagaccttggtgaagtcactttaccctccgggctttacttcttttatcactgtagtgtttgatccaggtcagttcgcagcctggaaggcacagccttttccaggacactaaatagggcacatgtgctacccatttgcgtgcacactatccttaggcatttgttgaagagatggttaataaaatataaactcattaaaaagcattactaaattcttacattttgtgtttctttgatcagtgaatgactgctaaaatttagtacgttatcaatggggaatttgttatctctttttgcataaaaggggtcctcggttttcgtgaagtttaaagtccctccccaggtagaatatccataaagcctatgaatgagtcttaactacttgattacccagattctagctttttggaatctttcattaccttacttttttcccttctcggtgagcttttggacttaggacaaacggggaacgatcacaaggaaatggattgacatctctactctttcacaatctttcctgaagacatgatttttttttgctatcatgtctctaagtacagttggtcagttgtcactctgtcaccttaccttccaaccccataattcctgtgaaaccctggacacctcactctttttgcagaccatgagctcctctggcctcactcctttccttgtccagcttgcagtacttgagtaatcccctcacccctcaccaccttccttattagtacccccagttccctgaagctcttgtcctgcccatttcctcccagcagcatgtcactcatctgccctcatgagcctgtgttccccttacaagaatcacatctctatctgtactgttattatagatcagtgaacttcaacatctgatagctttttcagtgttgcccatcagtgcatttaccgagttgctttttctatccttttggtgatagttccaaatgctccccactgtccccacggctataatgataggaaacattaatacaaaacttggttgtgttggagaaagtgtgctaagaactttacatgcattgtctcatctccgttcttgctaaaggatctaacttttccttccaaccatccagcaactactagcgaggcatcaactgtgtctatgcatggtgccaagccacagactgtagctatgattgatgcagattgggtgcttgctctcaagagacctctaattcagagggagatgcacagaagtaaacaggcagcaataacattgtccgataagtgctaatgaggggagaagttcaatacgctatagatgcccccaacccagacttagggttgaggataaggaaaacttgcaggaagttacagctcagtgccaatctaaaggacgagagactatgagggaggaacataagggcattctggacaaaaagaatacctggctgctggaaagatttcagggaattgagaggggccagtaggaacagagccattcttctcagagaaattagaggtcttatttttggtgtgaattccatagactctcttttctacctcctctgtgatctgtatcctcacttggttactaactggaattagaatcccctgcaatccttcactgtatgcagatctcgtaagacacactttctgtcaatctcagtgtgaagttttactatgcacttgtatagctgctccactgaaatactattagactgttaaggtgagtgtagaggacaatgcttcttcaaaattattacagggaagtttataataatggtgactgacttgaggtaggggtagggtttttcaggagggtctttcagtggtaatcacgcctaaaattttgaatgcttaaatgaagctgctgcttagctcaatgataagtaatagcagcttctttttccatgaggacatttattaaatgatgttttaggtctcagcaaatgttacgccttcagacaccttggctcaggaaagcctgatgtgcctccagtgaaggatttgtaggtccacatcttcgatgcttctgcaacacagagttagggaaatgaaacagtgggtcatacatgctcctgatccattgccaacagcaaagggacttgagcccccacataccttttgacccttctggtcatgataaagccacccactagctataatgctatagtcagcagtagaaataagagggagcacaaagcaactgaatggtaaaatatttcagacctttttggaccactttggaagatggaagctgataacatcatacatccaaattcctctgcattgctgtctctctctttacaggtggggaatagtttacagcaatcagtagaatctacttttgattccaaatgggtcttaattattttgtatttgggaaatattttttacttggcaatagagatgtgccataatattatttaatattttggaaatcactgtttcccatgtgcctgaacatctcgagcacatttaccctgagcgtggcagtgcctgggtgtctcacatccatgtatgctcaaaccatgctccttgatttcacccctttctctctgtttctttcatctcgtaaactgagtgctgatgccatttcacactttttcttggaagtttaatgagttagtagtagtataacaaaaataaaaatattttctttacgtttctgaaaagaaatatgtctataaagcgtcaatcatttttccaagctgttagttcctgctgctgagtactaggagctgttctgtcagcaagaccacgtaagggggaatagtaagagaaagctgtcccaattttctttctctggtacaaaaggttagaagatgttgtttcagctggagaacttaagatggattcttattcactatttgctaaagagactggactgtttttagtgtgataattttctgtaggcgtggagaaaggtcacctcctgatcttgttttggagatcatggggttaaatctgtggcagtgtccttttcctagacacagcctcttgtcaaaataatgtttggccaggtgttaatctgtgtcctgaggggagtgctggaattcattattcatcccgtgggagtaggggtcagaggagaaggttgtccttctgggaggtaccaggggacatagcctgcctcctgcctttactgacatgtgccatttgtgaggagggcagttgaagtccatttgaggaattctcttgtcagccggccaacacagaaacacagagggagtgggagggagggagaggcaggcagcttggcaaggcagtcctggagtgcagtttccggagcaagatcacacacagtgttttaggagctcagggaaggtgtgcaggaacataaaggggaagggggccaggtttgaaagagtggatttttcctattttttccaccttttattcctcctgtctttgaatacttgtcatcctttggaaaactcagcatcggaaagaagcctttgctgacacactgctttttctccagcgctatattgtgggttttttgtttttgctcttttcatttttcttttcctctgagggcaggaggtgagacaatgatcaagtcaagctggttctatgttaagttcaagtatgcagagaaggtaagtcaatatggtttcttttcccaggggaaacctgccacctccctccagtcttgtcatgttgatgggctcctctggccacttggggaagtgaatgaagctgagaagttgtatttgtgaatgtatttcctttggcttaatgatccttggatgaagcacaagctctttgcttgcaatctgacgttgccgctgaccaagtggaagcaatcttcagactctgttccggaggcatgatttagagtttaaagaggggaaataatgaaactacaataacaggaaaggcaggatattctgctttagattgaatagagaattttcaaggtattatttgttacaaaggtagatatatttttggttctgaaacaaattgacagtcacttcctattacctgttggcttagaatttttttcctctttcagttaactaactgcttactcatttgtagtcttacttggttgtagaaagaatccccataaggttgtctgaccatatatgagatgatctctttactgtctgtcaggggattatattttatgaatgaattttggttgtacctaaaattttgatgttaaacagttccactgtattttaacataccatttctggacttttaggggaaaagtgtactttctaatacatcttcacttaccggggctgtttgacatctttttggttccacatccatatgtgtcacttactctgttgggaatttacaggattagaaatgaggtttccaggagaggatatagctcagaggtagagcattggactgcagatcaagaaatgagatttccaggaggatcctaacgtgtgcctcccttttgaaatcttccctccttgatttgattgttgaaaacgttggcatattgattgtagagttaagctgaggctctatagaatggaactgtgatgtggcaagatggaaaattgtgcgactgtctttatactccttatgattatatgcataagcacattaaatatgcctcttccattcacctagtttaaaaaaaaagttagaacattttcaactcctttttactgcattttttttttctgtgtggacttgtttctgctgtgtttttaagacagcaaaattactctttctttacccatgttgaaattacaggatttttatttaaaatatccattttttattttaaactcacttgcattgttaactattaaagctattataagtaaaatattatctattcatgcacaggattgggaaagattgtggtttgggatttttttttctcagtagattactttcctttgagaagccgaccatccattgtttgctgttatgaattttgataactgaaaactgtactctgccttcttatgctttcccttttatcttgaatgttctgtcatgggaacctgaaactcaagagttaaggcacgtaaataaactaatgtgaaaaggggaaaagcatttccagaaatgattgtcataaaaagaaaaagaaggagaacgttaagttaattgcttcatttgaattaccatgctgctattcctttagcaaccaaacaagcagagaatgcttccatatggcaaggcacaagtgtaatgtaaagctaagtaatgtaaggctctatacctaattgaaggatattcgtcttgattttatgaggatagaagaaaaagagaaatctcattcttgttcttggcatggttatggtgctcaagatctcagtgattctctgcagaacttttgttctttcacaatgattcaatttaaaaattttcattggagatttttgttttccaaaactcatcaagatggattgagttttaacctagagagataataagtcttagtgtaaacacagggacagcattgataacaaaacaaactaaaaccatcttttttgtattcctctaaaaagccattcttacaaaggctttttgatttggaatttccctcactatctttaaaaggacaaaaaaagaaattcctctcttgattgtcaactactgaccattttgatttgatataagcttgtaattgttggaaagatatttctgctgtgatgtttgtccaaaactataagaaaatacatcacacaatctcttcaatatccatctcctagtttatcatttaggaagatgatttaatcagtcttcagtagtgagaaagaaaaattaagaatggcaagtaacgcatgaccaaaaacattggcataagagaatactgttcacttgtgatcactggaatcatgatccctttcaaaaattaaaatatataataaaacaaacactgtttttttaaccaccaccacactaacacacatgttcctctgtaagaatttccatctaaattatttatgagttgtctctttcttgaattagattggtgcctagctatctttctttctaaaagagtgcttacttcaattaatttcatcctataccccctttctctttttattctacatattctccctgagcaatttcctttttggtgtgtttttctatgtcctataagtgatgattccaaaagctctatatctagcataatatctttcttgagtttctgaggtatatatttaattggttaggtagatatctgtcctgaagttcaacagattcctcaaatgcagcatttctaaagtatagttaatttcttcttccttaaccaaggattttcttcctcttacatctcctagcacagctaaggcatccctatccagccagtcatctttgttcccaaaggagctgttttagttctgttcttatcatctcccttctggcttattagaggagcctcctaatcgatctccctgccacattcatggtgcttccagtgctccaaaaccctgctagaggtatcttaaaaggtcagtctgagtctgttttgctgcttgttaatggttcccctctcccatctaagcattctcactacatctccctcaacagtgctagcccttgaccttgtatatacataatacaccttattgtaatttcttattcacctgcgtcttctatagtaacatatgatcctagagatacagaattacattgtgtttttgattttgatttttctatccagaatccctgcacgtaatagatatttattccctgttgggtgttgtggctcatccttataatcccagcactttgggaggccaaggcgggagaatcccttgatcccaggagttcaagacaaacctgagcaacatagcaagacctcattatctgcaaaattaaaaattaaaaaattagctggtgtggtagcgtgtgtctgtggtctcagctacttgggaggctgaggtgggaggttcacctgagcctgggaggtcgaggctgcagtgggctatgatcccaccactgcactttagcttgggcgacagagcaagaccctgtctcaaaaaaccatttttcccccctaaatgctactgagtaaatctgtgactttttcccaggagtctggccgacctgagtttgaattctgcttctgccatttactggtagtatatgaccttgggcaatatattgaaactcaattgaattgttttctcatctattaaatgaggagtattatcacctaatgtatttttcagttaaacttcttattttgagataatggtagtacgtaataatagtacaatatgcagttttaagaaataaaatgtaaagatcccatatgccctttacctagtttcctcaatggtaacatattgtaaaaccatagtaaaatatcacaacaaggatattgacatcagtacagtgaaaatacagaacaaccacatcaccaaaagtctctctcctgatggcctttgatagccatgcctctttccttctaccttcacaacccccatcattaactcctgatatgcaatcacttttctccatttttataattttgtcgtctcaagaatgttatataaatggaatcatacaggatgcagctttttggaattttctgtttttactcagcataatgttttagagattcgttcaagttgtatgctattagtttctgagtagtattctatggtatgggtgtaccatagtttatttaatcattcttctgttgatggacatctgagttgttttcctagaagtactatgaacatttgtttataggttttgttgtgaacataagttttcttttctctaggataattgtccaagagtgcagttgctgggtagtatgtatagtatttgcgtggttaatttttaagaagccaccaaactgtcttcctggctgactctactattgcatattctctttagtgcactgtattagcgattccgtttacttgcgcattcaccagcatgcaatgatgttggtggtgtttctggttttttattttagccattctattggtgtgtactgatggtgtccagtgatgggttttaatttgcgtttccctaatggctaataatgttgaacatcttttcatttgcttatttgtcatttgagtatcttcttttgttaaatgtctcttgctctttaaatgtcttttgcccattttctaattggatttaaaaatttttactgttgagtttttcacagttcctaatattttctagacagtaagtctttattgggtatgtggtttgcacatattttcttctaatttatagcttgtctattcatcctctttcagagtcttcctcagagtagaagttttaaactttgatgcagtccagtgtatggatcctttcctttatattcttgcttttattgtcaagtcttaaaactctttgcttatcctttgatcctgaagatttttcttttccttttttcctaaaagctttatatttcatatttaagtccatgatccattttgagataaattttttataagatatgaaacttaggtcaaagtttttctttgtgtgtgtgtgcgtgcatgtgtgtgtgtgtgtgtgtgtgtgtgtgtgcacgttcctgtatatgtccagttgttttagcaccacttatggaaaagactattctttctccattaaattgttcttgtacctttgtccaaaatcagtttactgtacttaaatgggtctgttttgggtttctctattcctcaattgatttaatgtctgttcctctaccaagatcaaaaagtcttgattactgtagctattctttttcaaaattgcttaagataaaatagtacctgtgttttttcatataaattttataataacctcatctgtgtttacagaaaatctttccggtgttttgataagaattgtgttaaaccaggatattggttttgggaattttttttttaagtactttgttgagtctttctcttcatgaagaggtttgtctctccgtttatttagatcttgtttgatctcttttatcattttgtagttttcagcatacaagtcctatatgaattagatttataactatcacttttggggggcacttgaaatggtattgtatttctaatttagattttacatgcatattgttagtatacagaatacaacttattttcaaatgttgttttttgtatcctgtaaccttgataaatggagttattagtttgaggaacttatttgtagttctttgaaattttctgtatagacaattatgtcatttgcaaatgaggacagatttatttcttcctatctgatatctatgctttttaaatttccttttcttggctaattgcactgagtagaacttctcatgcggtgtgaactaagagtggtgagagtgaatatccttgtcttgttcctgatatttggggaaaaatgcattcagtcttttgctgtttagtacaatgttagctgtaggatttttctctatgttctttatcaaattgaagtagttcctttctattcctagttttctgagattttttttatcatgaatggatgtagaattttgccaaatgctttttctgtgttaattgatataattattaggtttttcttttatagcctattaatacggtagagtacattgcttgattttcagatattgaaccattcttgcaagcctggaaaaagttctatttagtcaatgtgtataattctttgtatgtatcgctcaattttatttacttatattttgttaaggacttttgcatctgtacttacgagaaatactggtctgtaattttctttttgtaatggttttattatgaggatattactggctccataaaatgatttaaaagtgttcactccttatttgtttgctggaagagattatgtataattggttttcattcttctttaaacattgtgtggaattctgtagtggaaacccatctgggtctggaaacgtcttttttagatattgttaatttaagaaattaaattttcttaatttaagttattgggctacttaaattactgtttttcatatttggtgggttctggtagtttttctttgtaaggaagtggtccacttcatctaagttgtcaaatttaagtgtgcagaactgttgatagtattctttattgacttcttgatgtctgtatagttatattccttgtttcatccctgatattgataataatgtctgtgtcttttttctgtgtcagtcatactagatgtttgtcaattttattgatttttttcaaagaacaagttttgtgttccattgatttttctctcttgttttcctgttttcaacttatttttttctattctgttatcttaattatttcttccatctgcaagctagaaaaccaggaaagctggagagtgtagttcagtctgactctgaaggcctgagaatgaggggtccagtggcgtaaatctcttttcaagactgaaggcctgagaaccacaagggctgatgttccatctccaagggcaggagatttggatgtcccagctcaaacagagagtaaatttctccttcctctgcctttttgttctgtttgggtctcaatggattgaatgaggtccacgtgcccaaatagggcatcttctttaataagtctaccaattcaaatgctattctcttccagaaacatactcacagacataccaaaaaataatgttttaccagctctttaagttgacacataaatttaacaatcacatgtatctttttttaatttttgctgcctatattgttttatttaaagagagtttcttatggatagcatagagttgattcatttttacaagttactgtatcattgctctttcttctgtcctagtgacttaagatcctttcttttagctatttttttttaaaaatagaacttcctttagccattcttttagggtagttctcccagtaactatttatttatttatttatttttatatgaggttgtcttgattacctgttgcttactgaggaatgtttgcacttgatgtagaattttggttgacagtttcttttgtctttttctttctttcttttctttttctttcaagccattgaaaaatgttgttctctttcttctggccttcagggtttctcatgagacatccactatccttcttttgtctagatgtcatgacttctttctccctggctgcttccagatttttttgctatctttagcaaagtttaactatgatgtgtcttggtgtgggtatctttgagcttattctgttttgtattatcatagctttttgaatctgtaggtgttgtttttgccaaatttgagaattttcacccatcatttcttcatgtacttttaaagccctattttccttttcctctctctctgggactctgaagacacaattgttagatctttggttataatcccacagatacctgatactctgttttttgttgttgttttgtttgtttgttttgtttttcagtctctttttttctcttttgtttagatgagtaattttagttgttctttcagttcactgattctttactctcctccacctggtcttgagcccatccgttgaatttttttaattgttttttttttatttttatttttttgaggtggagtctgctcggtcccccaggctggagtacagtggcatgatctcggctcactgcaacctctgcctcctgggttcaagcaattctcgggtctcagcctcccaagtagctgggattacatgcgtgcgctaccatgcccagctaatttttgtatttttagtagagacagggtttcaccatgttggccaggctggtcttgaactcctgacctcaggtgatccgcccaccaaagtgctctgattacaggcttgaaccatctcgcccagctgatttttaaaaaaaatgcattttactctggtaaagatgtatttaatgaaatttaccatgttaacggttattaagtatacagttcaatactgttaaatatattcacattgctgtgaaacacatatccagaagttttccatcttgcaaatctgaaactctttacccattgaacaactccattttccttgctcctctcagcccctggtagccaccagtctactttctgtttctctgaatttgactactgtggataccttatgaatatggaatatacagtatttatctttttggcactggcttatttcacttcataatatcctcaagtttcatccatgttgtagcatgtgacaagattccttcctttctaaggctatataatattccattgtatgaatatacggcatactgtttgtccattcatccattggacatttgagttgcttccacctcttggctattgtgaatagtgatgctataagaccctgcttttagttctttttggtatgtatgtagaagtgggattgttggatcatatggtagttctgtgttaaattttttgaggaacctccatagtgttttctatagcagttgcaccattttacaatcccaccattagtgcacaagtgttctaatttctccacatcctcttcaatacttgttctctgtttttcttgatagtagcaatctcaatagatctgaggggataatgcatttctctaatgattagtgatgttgagaatctttgttggctacctgtgtattatctttggagaaatttctattcaaactttttttcattttttaatcagttatttgtttttcattgtttggttgcagaagttctttacatattctggattttaaccttttttcgggcatatggtttggaaacattttttcccattccataggtttctttttcactctgttgattgtgtcctttgatgaacaaaagtttttaagtttgatgtagttccatctgtctgtttttgcttttgttacctgtgcttttgttgtcacatccaagaaagattgtcaaatccaatgtcatgaagcttttcctcaatgttttcttctagcagttttgtgattttatacttttatgtcttacatttaggtctttatccatgttgagttaatttttgtatatggtgtaaagggtccagttttattcttttgcatgtgagcgtccagttttcccacaccatttgttgaataaactatctttctccattgaacggctttgacacctttgtcaaagattgtttaaccatgtatgtgaaggtttatttctgggcttgatattatattccattggtctgtttatctgtcttcgtgccagtaccacactgttttggttaccacagttttgtaatatattttgaaatcagaaagtttaagtcctttaactttgttctttttctaaattgtttggtgatttggagtcctttgagattacatatgaattttaggatgcatttttctatttctgctaaaattgccattgggattttgatagagattgtatttatggatcatttgtggtactatggacattttaacaacagtaggtataacaatattaaagcccatggtcaaccacaaacatggaatgcctttccatttatttgtagctcttttatttcagcagtgttttgtattttgggagcagtgttggaagtctggactccagtacttgtctttacagtttccctcttttctgattctttggctaaagacaacaaacttttctaggggcttgttttggtatgtgtcattgacattactgggtttctgttttttcaactccaaatctgatgacatcatatatcatatcggatatatgagacctataaaatgaaaactcctggagaactcaccaccatgtcatttttgggggcccccaggttttaagccagtacgtcatcttcttttcacttttcagagtctgtttatatttattttatgtataatgttgagggattttagttgtacttagtgtggataatagggaaaagtatgtctactccattttcttggaagcagaagttccctaagatgcttttaaaacagtggttaaataacataatgttgagagtatttgcatggtgcaaggcctgagtgctcaatagagggtgataattgccttttattatcttcatctttctcctatttgaagtatcagtcacactttgctatagaggcagctccagtttaagtttaccttgctttagataaattgtattatcactaacacatacatttgcatcttcataccctttattgcaattccatcaagatgtagattccagaaacaacattgtcttttcagtatttttctttttccaggcaattttgacaatgcatttttgtaataagactggaattactaattctggttttattgaaaaactgttagccatttcagccagaagaagatcatggaggaaacaataaattttcttcatgagctattcaatccaacgagatactgaattaagtgcaggaaatcagtacactttttgtttgataagaagtgttcctctgaaaaaccattcttagatcattataaatattattggttggatgcagtggctcatgcctgtaatcccagcactttgggaggccaaggcaggatgattgcttgagctcaggagtttgacaccagcctaggcaacatggtgaaaccctgtctttataaaaaataaaaaaataaaaatttagctgggtgtagtggtatgtgtctatggtcccagctaattgggaggctaaagtgggaggatctcatgagctcaggagattgaggctgcaatgagccatgattgcacctctgtattccagcctggacggacagggcaagaccctgtctgtctcaaagaaacaacacacacacacacacacacacacacacacacacacacacacgcacacacgcacacacacacgcacacacacccattaccagtcttcctgggaattttattctatatctgtctataagtttaaagttatgtactctagcttagcctttaacttcagagttaatttgaaatttatttaaaaactatttttggaaatttacataatcatgatgactgcatgtaaactgttagtaatattttatagagtttccttgggttttctgttagaatgaagtaataaatttgtgtcagaaaactatttgggaaatttagaagaaatttaagctaaggaacataagctgtggagcatggccctaagaatccttttattctcatttgataaacagtagaatccagacagggaagaaccttattttctctgcctttgctagttggtggaggaaaacttgctgtttgagacaagtaggacttgatctttctatcctgtacttttttcatcatcctcaaagagggcttatttcagtggatagaccattcatagttttgacagctcaaataacccttaaggatgagcaacaactgaaaagttccaagggctttatttccaatggaaggatttcaattacagtcattttttcaagttagtacaaggaggtaaatggaatcacagtttcaaatgttaaatttgaagactacaccattaccagtgtattttggaaataaaagatgcagccaatctaaatcaaagacatgattccagattacctcataagagtatgaggaagactacaggcagcaattgagccacttgatatggaagagtatgcagtgcatcaaatgtgactttcattaagccgtgttacccttgtttgctactgagggcaggaggcatccttttcaacagcctgtaatagcttcttgttgaaaggctgcctgctatacagatgcagcagcagagagagaaaagagggatacagattcacatattcgccttgttttttaaatgccatttttgccatttttggagttggtttccagtgcttagaatagctgtaagtatatagtagttatttactgtatgtttttgtgtgagtaagtaagagaaggaattaatgaattaggctttataaactggaagtttttgttgtgcacacattaagctaagcttctatcccttctcttctccacatggtaccaccagacttttccccacttcaccccctcatctaccattttttgttttgtgtttttgtttgtttgttttttgagatggagtctctcactctgtcgcccaggctggaatgcagtgatgccactgggttccagtgatcctccagcctcagcctcctgagcagctgggattacaggcacctgccaccatgcccagctaattacatcaaccttttaaaacttatttttctctctagaatttgtttgtgtgcacttaaagagtaagtgggaggatctcaagacagtacagaaagagttggacatctagttcagttttgcagagggagtgcagagaaacttccttggagttatataattgatttttggaacctcatttgtaggatagttgtgtggagaaaggcattcaaattgcattcactgtacttcttaggccaaggtagatctggttatgtacatacttgttatttggtagaatactgcttatgttggcattatcttttccatactacatttatgaactggaaacagttaaagcttgaaactgttaaaaaaaaaaagtgtacgcttacattgtatgtattagaagtcatatgattacacatcctcatcctctcaccagtcctttcatgtagagcagcggtttgcatctttggctatacattggaactaccttgggaattaaaaaaaaaattgatgtccaagtatcaactctggagattctgattcagttgatctgggatgaagccttggcgtcaatttttttaaaaagatccccaggagtttacaatgtgcagtgagggctcgttttagaatggtatattgatttgtgttccaattgttctttcttgcataaatcacatctgtaattcattgaccacagttgtctatgaggcttattaaaaatggtataacaacttacacatacatgaataattggaatgcagaatcattttaacttccctttcccagtctttctatagtcagtttgtatttaattcaacaattgttttttgagaggcccacatttattaaatgtttatcttgtccagcttaatttctctagaaacaaaatctcaccttcattttgtacttatcactggtttacatgtggtaaataaaattagcagaaacaggtttgggtatggtccactgtggtacacgggtgtcttatagagatgagtattcattggctatgaaatgttcagtaagttttacaaaggaaacgaagatcatcagttgatctagctggtcagttggggtcagttaaaagagcattattgtaaaagatttgtggtttgcctgattttagatcagttaacattcacccatgagaaggtaggatgtatgtcatttttattttataagtgaatatgtaactgtatttttttattttgtatttaaatttttattcaatatttcaaattaattaatttctaatgttaatacctaatatacatagatataatcaatatgatcactgttatctctagagtgaagacagtttcttgccaacaatttttatatcccattataaccatccagatgagttcattatgggctttcagtacacactatcagcgcttaagagtcttgagttcattctggtctttgattatcacatgtcttgaaatacacaccacattagatttgtaaataaattgtagaaaaatcttaagactgaaatttagatattaacaaacattatttcctcttgagatatgctaacagacatcagagcattagtaggtcactaaagagtgaagatgagtcagacccatcaaaatacatatactcgttctaccacttgatatgtacacacttcgagttggtaatttattcccagttgtttgtgacggttgcatttgtgcttatcttctcttagtttcacaagggtagctaatcatgagtttttgtctgtttttgctgaactttacctactgtcttattaatcttgtttatatcagtgtgagtttcttaaggacaaggactcgtaggcaccaacacagaaagcaattttaggaatatactgtctgaattaaatgtattaaatcagtcaacaaataggaaccttttgagaaatggtcctgaaaacatttttgtttgctttttttcctagagaggaaataaacgggtttataagctgctgagtgcaagtatcatggtctgtgccttttcttcttgactgctctgctatattctctttcagaaagctgagtagctcagcacagtgaatactaaagggaatgcattccttctctctcaggggactgaagcagtgtttaacaccactgtaaaatcctcagctgtggctttctctggtgtagaatttgtctaagaaagattaaaagaacaaggaaagctttgtgtgctgtttctctttcttttcttcacccctcctgctccaggctatcctgaggggggaaaaaaaacgtggagtattttccttggacctctggagtatgcatgttatgtatgtgtgagtcttagagaaaaataaaggcaaatgcaaggcatgcctgctagtgggagtcatcacccatgggtgaaatgaagaaaactacatgagtgcgtttgcgtttatacggccactttttccattgaatgacccaaacaagatgccagtgacaaagcattggtcctacatgtgataaaacagcggcctggccatttgcttaattggtggagaactcaggtgtgttactcttggcagaggtgaaagccttcatagagaattagaaggggtataatttgggcactgtactcagaatctttcttggtatattgtttaagagcttcattgcagtgactgccattcagcaagaaataagagatgacttttaaatatttggccagattttatagtggcaaggacagagttttagagctgaagagccatttagttcaatcccatcaatctgcaaatgtgaacagtaagcccagaatcacatttagtgttagtggccagaagggagaccttggctatgaacatttaccctaccggaaactaatggcgtaaccagatttgaaccttttcttccattctgtactaggttgtcttttctttgttaggaaaagcctattataaacggaacattgacatgaattttaatttttgcatattttcttacaacatttgcccttactgcattttataactaattgtatatacttttatattttcctttttgtactcatgattctaatgtttctatgtggcatttctcacaatctctgtggggttttattataatttgctaaattattcccttgtttgggggcatttatataaactttttttttttttgccatgaaagagaaagccacagcaaacaatgtatatatgtagctctttattctctcaagttattgtttttgttctcatcatctgagttattgggggtgacttcattacagcagtggaaaacacatggtaacctgccagcatcagaaggtgtcgctttgtactgtgtgtgtgtgtgtgtgtgaaggttatgtgggtatgactgtgtaggaaagaaaaaaagtgctactctttgtagatcaaacaattgatgagtcttaatgtaggattacgtgttgcctgttaaattgctatttctgctgagaaagataaaggcatttttattagtgtagttgattagctttattaatgttggacaaaatcaatgttatgaaaatgaaatctatagttttggggtaaaataaaatttaataggtaggtgacccattcatacacttatgtgaagtaatttttgaaatgataacatgcatgaaaatttactatctatactaaatgtatattcaaagatattcttcctctagggttctagttataaacccttataaacccttataaaatactatgattcacatatacaacttataaaatactgtgattcatcagacagctctagtttcattttatctattgactctgatttaaattatcactcttttttatgcaggaatatgtggtaacaagttatatggtaagaaatttaaatgtaaagattttgacctaacgttgattcagattgtagagctgtcagttgaaaagggaaacttcatgtttagaaatttgagttctgctgggcgcagtggctcacgcttgtaatcccagcactttgggaggccaaggcgggcggatcacgaggtcaggagatcgagaccacggtgaaaccccgtctctactaaaaatacaaaaaaaattagccgggcatggtggcaggcgcctgtagtcccagctacttgggaggctgaggcaggagaatggcgtgaactcaggaggtggagcttgcagtgagccaagatcacgccactgcactccagcctgggcgacagagtgagactctgtctcaaaaaaaaaaaaaaaaaaaaattgagttctaaaatgtttgtgaaaaatttgataggttctttaataaatgtttatttccaacaaaaattttcctggtggaggagttattaggaccagtgagcatgcatttttttttaccgtcttgattgtattatcatattagcttcaagaaatgtttgtttcacgttacttatctttgtttgtcaatgaggtcagacactttcccccacgctgagaacagtatccactgcctctgaggtggatagtctctagaaatcctttccctgtcctggagcagtttgcctgaaagtgccatagttggtagcaaattcccttccactcctcttcctgcctgttaacactttctggaaacccaggtccccatgtgctttagcactctctgtaatcatttgtgggcctctgcagatgagcagtctgggagctgtggatgaggggctgggcaacttctgtcatgtgccattgctgtgagatcttttcttcaccagaatctgggggtgatttagaataatggttagttagtgacatgaagttttggaaagttttttgttgacatttttaagaagaagaaaaactgatgatgaactaaaataaagctgttctttcagccatgtctctgaaaccattgagaaggtttccaggtacattttgggcagtaaagaagatgtggactgggcattcctgtaatcccagcgctgtgggagcctgaggcaggaggatcacttgaacccaggaggtctaggccacagtgagctatggtcatgccactgcactctagcctgagcaacagaggaagactctctaaaaaaaaaaaaaaaaaaaagaaaggaaaagaaaacgtgccctgtttttctgttgttgagccttatttattttccttgctctcagcagctctgtggttccatcacttggctgccttcacggtgcctctgactagttttggaaatagaagtggtggtacaaacaacggggtggagttgcaggatacattgtggtgatatagtcttttcattctctatatttcagccaatatgatcttttcaaaacacaggttacattatagcattctcctgcttaagatcctctagggcttcttattacgctaagaataaaatccaaatacttggtcatggcctatgaagccgtatgtggctccctgcccacttccattcccactgtccatctaggtcctcaggattcccttatcaaactttcttcagttgctctaccacacatccccatgtggtgggttccattctgtactgtagctcttaactcaaacattagctctttagtgtggtcttatcttaccaaccatctaagtttgccccctttacttttttttttttttgagacagggtcttgctctgtggcccaggctgaagtacaatgaagaatatgattcactgcagcctcgagctcctcggttcaagtgatcctccagcctcggcttcccgagtagctaagactacaggcacgtgccaccatgcttagctaattcttaaaaaaagttttttttgtagagtcagggtcttactatgttgcccaggctggtcctgaacttctgggcttaagcgatcctcccgcctcgacctctcaaagtgctgggattttaggcatgagccaccgtgcccagccgctttacttatgtcttactctgttattgtttcctctgtatcttcttaataccacttataaacatctgaaattacccctttgtaaatgtatttgcttatttattattattttcttctgacttctttcattgaatgaaagtaagttccatgagagcaggaccttagggatgttattaactgttacatccccagcacctagtgctatgcctagcagtgagtaagaacattaatatttgttgaatgaatgcttgaatggccaaaacaagcccctgttatgtggcaggagctgtgctagcagtaaaaaatttagataagttgaattcagtctctgcaaacaatgttttccataatctggaattgttgtttggaattctttacagaaattcacatccaggctcacttggaaaaataatcttgctgattgtaatttttctcgttatggttgttcttggcagtaaagtcagtttccaggtgagaatgttactgctcttggccaaaggccactgtaaactttccagtattcctgagggtcttcaggccttactccttgaataagacagtgctccttgcttgaagaactaagttttctgagagtagaagggaacaatagaaagtgtacacatcagcattaccagtttattgttttctggacagttatccaaatttgcttaaggacttaattattaccagatcaaataatgttcccctcactttttagtctagtatatgctgtatgctaccctgtctgtgattctgatttcaaagtgagaaacaaattagcaagcagttgtttggtgaattttaaatgcagtggtgacccttgcccaatctttcataaaaattattttatatttaatgagttatatcttggggttccacaaatagtaggttcgatatttaggattaggtgcataatacctggagttaagctttgcagagctggaatttggactgtgtgtcttggccagaccctggaagcacaaggacaatgttgagatgaaaagattgagaatttaaaatctgtaagaatttaaagccattttacatcacaccataatttctcttcgctggattaagacatttcacagctatttataaaggagtgatttgctactataatttaattcacttgacaatcgtaggacattggatccatagttatgtcaagctagattagatgcaaaattggtaggaagacttttgtagattaaagacatatgacagtgaaatgcagaatttgagcttctattgaatcctagttcgagggaaatgctgtgaaggtcatttggggacaactggggaaatctgaaagttggactgcattagatagtattgaataaatattaaataacctcttgagtgtgttaatgatattgtaattatggaggacaatatgttccctttcttgttctttttgctttctgatagggtcttgctatatttcccaggcttttatagagcagtggtgtcatcatagctcactgcattcttgaactcctgggctcaagggtcctcctgcctcagtgtctctgtagccgggactacaggtgtgcgccactatgccctgtaaatttttttaaaatattttaatagagaccaggtcttgtgatgttgcccatgctggtctcaaatttctgtcctcaagtgatacccctgccttggcttcccaaagtgctaggattacagggatgagccaccatgtccggactttaaaaacattgttttccaatacgtcatgactattttgactatttgattggttttaaaatatctagttcattttcatgttgttccagatgaattcacttttatattgtatcagttgatgccatttcaaacttgaaaggtaaaagtagtcactgttcttcaaaccaaaatgactactaagaggtgtgcgtgtgtatgtcaggggaggtggagggaaattgtggatatgaatgaaaataatgagtgtaactttgatcacacagataatacatctacagcctttactaaagctgcctttacagtttctggcttcagagatgtggtaagtgcctcttgaaaggttgatatattacttttaacaacataaaaatgatatttgccttttttagagtctcttttttgttcactcagatttaaatgtatcatctaacagtcttctctttgtgcccatgttcttccatgagacacttagaatgtctaaaaagatgagtttggtattgttctagccttccctttgtttttaagggggactttgagtctatcaagagtgtgtgtgtcagctaagattgtatagctggctggtgcaggagctggaatttaatgttgtttttttctggcctctcagtacatcacattgtcacttaagtgagatggcaagcatttcaggtgctcttacatatatctgcaagcatggataacatttaatgccagctctcataattatgcatcacttgttgaattatttattgtacataccctactataaattgtaaactcctcaagggcaggatttttgtctgttttatgcattgcttttttttgtggtatgtagaactctgtctggaaggtgataggcactcaacaaatatttattgaatgaatgagtgaatcaaaatagaatgaactaggaatagattaatggctgctcactttgcaggatttcagggaaataattggtcagctttaacaacacatccccctctaactagctgatctaaactgaaaaattagacactggcttcctgtttaatttcccgtactcgtgggagtgataatacattaagctcacttaggtcagtgatttgacaacttagagtgaatgatttcaacaacccctttcctaggagcactttttgttgggggcagggaggacgggtggagtgctactaagttgaagaaaagtacagatggaaaggggcaggaaaaaagaaagacaaggagatgcaaagacaaactttgagcgtatcatgattttgagcaggacaactttgctggtatgtgggttaagaaatactttggaataaatggcatggtctgatctgtcaaacttgttcatggtcctgtggtcccaagaatctgtaccatgtaatttgtaactccagatagtcaagacttgaatttggtaactcttgtaattcttggtattgtgtatggatgctcatgtacagtttcaggagagtaagctgttgttcccatcttatgtgtggcttattatatcatgagttattactgtttgtcagttattcctgggtaacgctgttaagaaaatgctggcacttcaaggggtttgaggaaatgttgaggatcagatttatttaatatgtgcaaaattctagattaggtagaaagttgttgaaatcatggatctaaagtgaaaaattgagctttttagagcacctattagagatcagacaatttctagtgtagagcctgacacataagagttacgtaataaatatttggtgtgtgggatgagagggaaggagagaggaggaatgttgtgagcagctactcattgaagttgtgaatgcagccaagctgatggttccatagattgtttttctctatgttgaggctttaaatggtatccttaatttactgctacctttcagatgaatgcaactggacatcaagtagactaggggaagaagagtacatctgttttccctagagaacagggaccccccgccccgggccatggaactggtacctgtccatagcccattgggaactgggccacagagcaggaggtgagcagcaggctaacaaacattaaggcctgagctcctgtcagatcagcggcggcattagactctcataggagtgctaactctattgtgaactgtgcgtttgagggatctaggttgcctgcttccatgagaatctaatgcctgatgatctgaggtggaacaggtgcatcccaacaccatcgccctcccatccccaggtctgtgggaaaaattgtgttccatgaaaccggtgcctgatgccaaaatggttggggaccgctgacatacaagaagagtaattcaaaaaacagaaatagcaatacaaagttgcagtctgaatttgtgcatgctattttacctcttggtgcctcaatttccttatctgtaaaatagggttactaatgtatatttcattgggttttttgggtaggagtaaatgaggtaattggtaaaaaggagtttagatacagcatctactgaaatatcagccagtagaagtattttgcggtcaatttgttttgtatgtgcccagagggaagggaaatatgcttaccaattttgttcattgttaccgtctgtatagaattttgactatttgattggttttaaaatatctagttcattttcatgttgttccagatgaattcgcttttatattgtatcaggtgaggccatttcacacttgaaaggtaaaagtagtcactgttcttcaaaccaaaatgactactaagaggtgtgcgtgtgtgtttgtgtgtgtgtatgtcaggggaggtggagggaaaatgtggatacaaatgaaaatatgagtgtaactttgatcatacagataatatatctacagcctttactaaagctgcctttacatagtttctggcttcagagatgtagtaaatatccactggaatgttagctcttaaagctggtggtcatatttatataggttgggtatcccttatctgaagtgcttttgacagaagtgttttgggtttgggataattttggattttggaatatctgcattatacttataagttgagcatcccaaatatgaaatgctgcagtgagcatttctttggagtgtcatgttggtgttcaaaaactgtttggattttggagcattttggattttcgattttcagatttgtgttcctcaatctctgtggtttaaggctgagagaatagatctaatcagcagtcagtagagctcattagtagaggagagaggagagttttcttttaagaaggctatggggtcttgtgaagagacgagatagcttgtatttaattcacctgacagtcattagctagtaaaaatgaaagagagtctgggaactggaacagagagctggaaattcagctccttccaggcagatctgccttgaaattccggggaaatcagaacaggaacctcttcatttcttcatttcccttcactgcgtagtagtttattttgtgcttttggtaaaatgattcaaggtccaggagacatcctgaggtgatgcagtgtaggaaagcatttcagaaaggtaagatggaagacagatctgggcacagcaatgtgaattggacatttcgttcatcctttgggcttcctagaattagctgtgatccataggactgtcctgtccatcctggtgttctctcagaatcaggagcagctcactgtgcgaaaacccatctgaggaaaacaagaatgagctgatggtcactgtatcccaaattgacacactagttaggtagcccttgggtgtgaacttccttaaaatatttaaggaaagagactgctgttaacatactcagggaacaattatatgttgtttaccacatgacaagagaagaaataaacgttagacatatttctgggagcttagataagttgaaatatggaggaattaaatgctatatggtatgataatataaatcatttgaaagttgaaagttttgttagagctaagaaaggccttgaaaccatccgatctcaatcctgtaccttaaaaattgggaaactgaagctgaaagatgggcagtgatttctcccaaagttttgttgcaaaatacagggcttgtcttgatatcggaatactttctattctaagacattttttttgtctttaagataaccagatatgtatctgagggtagaacatacctcctctgtactatacctttgaagtttttgtttatatatatggtttgtgcatacttatgtaagtgttgccctcaaaatggaaaagattcaattaggcaagaatatcaggtgttgaagtcattttatccaagagctatgaagtctcatattagtcagttgggcatatcgtcttcatgacctttttgctagtgttcccatctgttgtatcattgctgattgtgtccatgtgagacggaaaaggagcattggactcttagcctaggaaccatataacaactataatttaaagcagatgttattaacctagcataaaagatgtgagaagtctgaagtgttagagccagagaaaaggtgagattaaactcaaatcttctgaatctaaaagccttgttccttccaaaataaagataagcatatccttctactggaaactttacagactggcaagagtaagaataaaaagagcaggtgatatatgattgattgtgccattattgatagttactgatctgttgcatagtaatggagagcttgattggatggtgatcctccctgtgtgcctcctgagtgtatttggaacatcatccaggaaggccttttaaagaagacaatacttggagaaggttttgaatgtttgaaaagaagcatgggccaggtgtagtggctcatgtccataatcccagcactttgggaagccgaggattataggagtttaccagtcctccagtgggaggatcccttgaggccaggagtttgagaccagcctgggcaacgtagcaagacttcgtctctacagaaaaatgaaaacataagccagacatggtggtgtgcgcctgtagtcccagctacttaggaggctgtggcgagaggatcgcttgagcccaggagttgaaggctgcagtaagctgtgatcgcaccactgcactccagcctgggttacaaagtgagacccatctcagaaggagaagaaaagaaatgtggtttcactagagttatggaatcaggttaaaagacagtattacctttaatgtaaattggtggcacatctctgcatcttagcctcaactcagaatattattggtttaagagtcagagagcttaggggtaaaaggctctaaaagcctctgaatttcaggaggttggtactttcagcggtctgtctccatctctcagcactacttcctctatgggcttcttgtggttcagagacaaagacgatgactgttctgcctgctcagcagtcctgggagagagcaaggctcatcgtttctgtgtccaacaacaatcttgcagcttccactttacagtcctcctttggttatgtggctattcttgactgattgactggatatatgtatagtcatcccactataccctttagtggggcgactctcatggccctctcagcattcccgaaactgctgggaccctgaggcaggtggggttaattcttcaaaagagacttcagctactgttaccaaagagtgaataaaagggctgaggtggcaaaaacaataatgggtttttgaatatatgttactaggctaggcacagtggctcataattccagcactttgggaggccaaggaggaaggattacttgagcccaggactttgaggccagcctgggcaacacagtaagaccttttaaacaaaaattagccaggtatagtggtgtgtacctgtggtaccagctacttaggaggctgaggtaggaggatcgcttgagcctgtgatgtacagtctacagtgagccgtgatcatattactgcactttagcctgggcaatagtgagaccctgtcttcctgtctctctgtctctgtctctgtctgtctgtctctctccctctctctctctgtatatatataatcccagtatgtttttatttctttctacagataggggaaggtgatctatttgaaagtctaatgcagaataaagtagtagtagttatcccctggcagagtaaaaagataagcaaaacttgggacgtcaacttacagcaagagctgtatggaagagaacagtgtggtgtgtagagagaaatcataaagctggctgctttgggccccaagaaagtctcgcttgtgatggttgtatacatggccgtgtggagcttcagatataagaaaagaattaagagatatgtattaataaggctgggcatggtgcatgtgcctgttgtcccagctacttgggaggctgagtcaggaggatcgcttgagcccagaagtttgaggttacgatgagctatgattgtaccattgcaccccagcctgggcaatagagtgagacattttttccatcagctcagtgtattaaattggttttctaagttaaaggttcacaacttcattatcgttactatgcagaattgcacttggtcctgaaatctgtctgaatttctgaataatagtttcttgtcctcaacttgtgtggtctcaggttttaaaacaaactaaggttgttactgccaatttctaaccactgttgcatttgtagtaattgagtgccagtggttggaggtttagagaaggtttaagattaactgattccaaaaatatctgtgtgtgtgtttgtgtgtgtttccatgttgtctgtgtgaatatgttagaataggaatagcatatgttttgattaggcatttttctttgttcaacatacactttggaaaacctagagaatttcagtgggattatagtatataatgactatattctgataaaatcgtggagtcttaacatttcgggtaacagattatctgctatttactggtatgttgattcgtggacagatgcttctctgtcttcaggtaggctccccaggtacactttcttgcagtcccttctaccaggtagacatgcaagaattaacaataaatgccacacatgtgtgttttctcttttttctgcttgtgagaggtgtttaaactttgtggaaatttattagaaaagatccattgtttggtagttctgatagcatcaactcgccctttatctttcatgatgcattgagacttccattactttgtagcgcctgactgctagaattgttcccagagttcaggggcttccaaatgacaatgggctgtaccgggctttgtggccttaataagccctctgttactggaattttaaatattggcatacctatcagagtctggccgtgtgtcaggagaatgttggctttagagccaccactgatggatcacatgtttttttctcaagagagcaaacaagcactttttgtttaggcttactaatgtttggcaaagaaatatagctgtaattatatatcctcgttcttgttactctctccccatctaaattttactctccctacccctaactttatataaaagcaactagggttggatctgaaataaatgtcatgaatgaataataatttctttcatttacacagtaattcaacctgttgaatgctgacttaatgctttactacactctaatttgactggaagatttggccttcgtgaatgcaaagaagaggtaaaaaatagaaattaaataccgactgactatgaaggaggacatttttcagaagggttctccctccttctatttctcatcttcttgtgtttgccccctgctttctgtgatacttaatacttaggagttgttccacaaatcattctttactttgtgtacccagcagtatcccagcagcaggattctccagggacaaggcctaggtctgccactgagggtagtctgcttccttcatcagaattgccgctgctggccttctggaccattagagttctttctggttgttatccacttttcattccttctcaacccatagaattccaggtggtgagtcagtttttctgtatgatcatgcttgacaccccaaaatctacctgaaagtttgacagatgcatggaagccaggagcattttaggaagctgtactgctcttctgagattttctgcctacttactgtctgagcattcaacctgtctctctcaaattttctctttctctaaggtgggtccagtaatgcgagtcggcagcccactttgctgttcttggaagcgaagtactttccaatagaagtcagttttaatcttctttcaccgtgaggaatgaatgaccattttaataaataattcattcctacagttcactccgtaaggagcttctaagctccctccatgatggtttctgatcctgccagggtactgctattttatctgtcaaatgtgggttgttagaggtactgtgtcataagaggcagtgcagttcggaaccctggaacccccttcataaatttgcaaaacacagtgcatggggcctgctatggcaaggtatgctacatggagcctcagctgtctgctccctctcttctgtcagcacagctagcagtcagagacaaatggctaaccctctttgagtctcttggagtaaagcctggttgtgttctgcgtggattgcatcctgtgcagattgtggatagcaagggcttccttgcaggcctgttgggagcattgattgagatcatgggtgtagaaagcctggactatagccagagtcaataattattagttctttatcttgagacaaagggaagtgttaaaatatttttatatcaaggaatctcctacaaacactgtcctccccactgcccactgccagtatttacatgaattaattttctccttatcttcttactctcgcccacccgcttccctttccttccgttccaaagttatactacacttattcaggatagaaatttcctttataaaaagttgtaaaaacttcaaagtgcctgttgtagtatatatctttaataaatactcccctgctatatttgttaaactataattatgagcatacatttcataaaaataaagcccatttactcataaactgtatgtttacatgaaaaaatacacattttataacccactccagacctactaaatctgggcgttagaatctcaatcttgggttttccaacctggctcctttttcgaaataacctggaacacttaaaaaaaaaaaaaaaaaagcaaactccaggctcaatcccagatgatttacatcagcatattttcagggttggccctgggcatcatttgtttaagcttctctggtgattataaatgtgcagccagggttgagatttaacggtctatcctaagtgcttcttaaggtctgaaactataactattaagtgagctggcttaatttatttaatctttgcagcaaccttatgaggcacagctggcattatccctattttcagatgagaaattatagaggcttggagaagtgtgaggtaataataccaagaatgagagttacttgttctcctatgtcttataatcaaatagtatatatagtattaacatctacttggggatgcaataccttttcacgtgatggtcacaatctatgtattacacattggttttggcatgaaattaaactgaccatctcaatatgccttggaaccaagtgtttgtgtgctgaatccttttgaaatatagacacctggtgtgttagtccatttgtgttcctataaacgaatacctgagactgggtaatttataaagaaaggaagtttatttggctcacagttctgcatgctatacaagcatagcaccagcatctgcttgccttctcgtgaaggcctcaggaagtgtttactaatggcagaagggaagggggatccaatgtgtcagaaggagcaagagagatgccaggctcttttaaacaaccagctctcacgtgtgaactcacagagggataactcactcattccccctggagaacaccaagccattcatgaagggcccacccccatggcccaaacacctccctatgcccagcttcaacattggttgtcatatttcaacatgagatttggagaggacaaaacatccaaatcgtattacctgcaggttgacattataaattcattttgttaaactcagtggaaatgagaatcaggttgaaactcggggtttattactgacttataaacccaggtgtgctttgaatgcattggaaagcaggagcaatttaacattctgtgatttttagaggtttggcagtgaaaccctttggtatttatttaataaatcctgccttcacagtcatggattctttttgaatacacccaatttctcctgcttcccaactcttttttcaagtgactttgttaccaggtaccgttgttgcagaggagtgatttgattattctttctctgtagaaatggtgatgatgtggggcaaatctacctcaaactgtaaactatactcactttttccacagatggggtcttgttatgttgcctaggctagacttgaattcctggacccgggtgaccctcctgcctcagcctcccaagtagctgggactacaggcacatgccaccacacacccagctatattcacattaaaaaaaaaaaatcatctgtaattctaagagctccctgtgtggagccttccaagtggcccacctgtgtgggaaagctgccctgcaatatgggcccaaaaattttccttggttttcatgtatctgagcaagttgcttaaaggtgcctggttctgtgtgtttgagattatttattccatttttactaatagtttagagaaccatgattgtgcatacatgcacctgtttgtttagtaaatatttattgagctcctaacatatgtcatgcattgttgtaagtagtattgaagttacagcatccaaaccaaatagacaaaatctctgcattcgtgaagctttatttaatggggaatatagaaaaaagtataaacacataaatcttaaaagtattttggaaggtgagggatactatttagaaaaagaaaacatgtaaagaagaaatcccccttaccatatttggggaatggtaaaatttttaataaggtggttagggtagacctcactgagaagatgacgttaagcaaatggttgctggaggtaagggtgtaagctatgtggatgtctaggaagaacactgcagacagaaagcactgccagtgtcaagttcctggagtgtttgaggctttagcgaggaggtctgagtgctatgtgatatgtttactacctacctataagagttttatggatttggagaagttttctctgcaatatgaatatatagtctcacaaatgaggataaagtttatagcaaattatcatggatttgattatgtcatggcacttgaaggaaagagagggtgggctgtgaaactcccttaaaaataacccatttttgaactcgacataaattttcagggtcctataattttcttatcaggagtgtctcacactgattgctaggtgtagaaaaatgtatgttgcctgaatctgaaggcatggattgtaggcctggttataccacagttacttgtgggactttaggaaacatgcttcatctggtcctgcttctgtttctgctatcttacaatgaagataattttccccctactttttaaacttatttgcagtgaagactagataaaaaaggatatgactaacacattaaattctgaagtaccacataaatatgacttatttttgcaaaatttaagagcacagaatgttggttatcaaagagtgtttaaaatgacctttctctgttttttgtaagtgttgtttgagagcacagtgatgaccacttaattcctttcctggagcaagacatgtttcttgtgggtttgatttgtacattatcactgaaaaacttcatcagtgacaacaacaaaaaagcccaaaaggaacctaatgaaaatagtagtgaagttttacacattacatagttacccccctgccacacacacacacaaagaacgaaaaaaagaaaagaacttggtgaaatatggtactttatattttaaaaggcctaaatcttgcttgtggaagtgggctttagaaagtttgcagcttttgagttatggagaggtggtggaagatggattatctggaactggatggaaagttgttctaccaggagtggctcataatgcacttggcaaaccgaagtagctgtggtggatgtttgaggtgtgtgcacatgtgcattttgtgtatccctacacagcttaattcgactggatgcagttttctgaattcacctgtttcttgcaggtgaaagtgcacacaaacatgcaagattcacattgtgctcaaagtgttcctgctatgtcaagcacattgaaacaaatttatgttttcaaagtaagctttataacagagctgtctgtacaggggatgattcagtccgatacagtcagggaaccgtacatagaatagaatgactagagtataatctgcaaaggatggaatggcagaagtagtcagaagaggtatgcaatggttggatcaaaaagagctttgtatccagcgtcacagggcctcaaattgtactgtaatcatatgtcttttacctgttctctggcatttaaatattcttgtaaagagctaagccattactgataaaatgtctgttgtgtacagttgtacaaattaaattcagtcacaaaactgaaagaacagcagtgggacatctatcctagtgaaagttagaatacacttttgtggtctttaataacagagttgattgtttaccttctcctttggttagaagactggtatggggattgtttggaatgaagaggtaggagagagaaataattcaattctgtattctcccatcatctttatatttgaactgagaaatgtgtgtttctatcattcattcaaattattaaacaaaaacagagatcaaaataataagaacagatgattaaagagagtcccatctgccccatatccaacctttctctcttcaacctcatttctactcagattagcagatggcaccagttttgggccatggtctctcattttctgattacaaggggttgttcttttgcccgcctcctttaaaacaacaacagaaaaattggtaatgactgactgtatgcccattggccggggcaccaattcctgaggactagacagaagcttggcattcaacccagccttctgccaggatggttctgcctggcagcaaaaagcctggttgaattaagcttgggcttttagatcctagaagtcttgtctattggtggctggaaaaatagctagtactagcagagcctaaaaatatcagagaaaaaaaagcagaggctcttagaagttgcttttcctttttgtttctttctcagacagagtctcattctgttacccaggctggagtgcagaggtgtgatctcagctcactgcagccttgacctctagggcttaagtgatctttccactttagtctctcgagtacctgggactacaggtgtgtgccaccacgcctatctaatttttgtagttttagtagagatggggaatcatcatgttgtccaggctggtctcgaacacgtgagctcaagcgattctccctccttggcctcccaaaatgctgggattacaggtgcgagacaccacacggccaagtttttttctgataaagactataaagggaaggtagggaaaggtgattattgccaatggtggttggtatagtgctgagtgatacagaatgcaggattcatgaattctaattttgcatgtgacctctctgtaaaggaaaatgaccctctaactaaatgggaaagtaaggtttcacagatgagatagaagttcaaggtgaaagaacagtctataaggtaatacctgcctgtctgcagagaatggattcaaggctcctgatgcaattgaattatagcctcattgtcatatttttttttttttttttttgagactgagtttcactctgccaccaggctggaatgcagtggcctgatctctgttcactgcaacctctgccttccaggctgaagtgattctcctgcctcagcctcctgagtagctgggattacaagcacgcaccaccacgcctggctaatttttgtatttcaagtacagatgaggtttcaccgtattggtcaggctggtctcaaactcctgacctcaggtgatctgcctaccttggcctcccaaagtgctgagattacaggcgtgagccaccacacccggccttcattgtcatctttgagttaaatgcattttggctttaataaaaacaatatgagtaaattctgaacctataatttgagtcccaatagtatttcctaacaagtgatataagtaaacactgagaaaagagtatagtgcttacagaatgacagcatgaattcagcaattcctgtttagcaagaggtctgggccaataacttggggatgtcatagacagaatgcatttggctttcagcaaaatttttggtctgctctcccataatctctttgtgaacaagtagaaaaatataggcggggtggcattatgattatcagtattcataattaattttataactttttccagtggtgattaaattttatttcactctagagatgactttctaagattatcataaataatctatccttggctctatcttatccagatttttgtcttagactaggatgaagatacaattttaaatggtaccaaaacttcttgggtcataaatatggtagatgggaggaacaggacacatatagattttaactcttttggcagtggcgaaaataagatttgctaggactaaaagtgtgattatgtttgaaaatccaactgtgaaaatagagaattgatagagatgagacttacgatttttagacgacacttacagtgagtcagcagcatgtagttagctggcaataaagctaatggtattttcaagtaccttataaaatatgttttatgtaccggactgtactttgtatttggggaagaggggatagaaacattgaaggtaagatttgcccagagtcacagatactgttaatgttcacattcttcacattttatttgtacatcactcttagtctttaaaatcaaaatacctaaatagctgtgaaaattcagtggattaaaagctactttgggaaagacagtaaaactttattcaaatagggattttcatataatgttaattttttgaaaaatcaacaattttaagaaaaaaataggatatatgaaaaactagatagttaagttgaagtttgagcatctttcaaagagtagggaagtttacatattgcatattatacatttaaaaatcagttccagacatatttttgttcattcatatatatgaatatattatatatgactatattatatatattcatatatattatatgaatatattatatatgaatatattatatatgaatatattatatatgaatatattatatatgaatatattatatatgaatatataatatattatatatgtgaatatatatattatatatgaatatattatatatgaatatatataacatatgaatatataatatgtatgaatatgttatatatgaatatattatatatgtgaatatatataacatatgaatatatataatatatatgaatatgttatatatgaatatgttatatatgaatatatataatatatatgaatatgttatatatgaatatatataatatatatgaatatgttatatatgtatatataatatatatgaatatgttatatatgtatatataatatatatgaatatgttatatatgtatatataatatatatgaatatgttatatatgaatgtgttatatatgagtatctataatatatatgaatgtgttatatatgaatatatataatatatatgaatgtgttatatatgaatatatataatatatatgaatgtgttatatatgaatatatataatatatatgaatgtgttatatatgaatatatataatatatatgaatgtgttatatatgaatatatataatatatgaatgtgttatatatgaatatataatatatgaatgtgttatatatgaatatatatataatatatgaatgtgttatatatgaatatatatattatatatgaatgtgttatatatgaatatatatattatatatgaatgtgttatatatgaatatatatattatatatgaatgtgttatatatgaatatatatattatatatgaatgtgttatatatgaatatatatattatatatgaatgtgttatatgtgaatatatatattatatatgaatgtgttatatgtgaatatatataatatatatgaatgtgttatatgtgaatatatataatatatatgaatgtgttatatgtgaatatatataatatgaatgtgttatatgtgaatatatattatatatatgaatgtgttatatgtgaatatatattatatatatgaatgtgttatatgtgaatatattatatatatgaatgtgttatatatgaatatattatatgtgactatatattatatatataatatatatatgaatatatattcatatatatattatgtatgaatatatattcatatatatattatatatatgaatatatatgtgaatatataatatattatatatatatatatataaaatgccataagccatagagattcagaactaataaaaggcaagttgcttgctcattaaaagctaataaactagaaggaactacaaaaagttttaaggttaagggatgcaaaattgattagcaaaggcagatcagaaagagtttctgactcatgcttcattggtgagaacagcaaggaagaactgggaatgagaatcattgagttttggccgacttagaggcagagtgttttaaaactgctttttggggccgggtgcagtagttcatgagctgggggaaaaaaaattacttcattttcccacctcagtttcagtttcctcatctataaaatgagataacaacagcgtggagtctacacatgaattaatgactttatttatttatttatttatttatttatttagagaccgagtttcgctctcgttgcccaggctggagtgcaatgacatggtctcggttcactgcaacttctgcctcccgggtttgagtaattctcctgcctcagcctcccaagtagctgggattacaggcacctaccaccatgcctggctaatttttgtatttttagtagagatgggatttcaccatgttggccaggctggtctcgaactcctgacctcgggtgattcactcgcctcagcttcccaaagtgccaggattagaggtgcgagccaccgcgtctgactttgaaatattttttttttaagattacacagctaaatggaattctctaggaagcacatccagctgctgaacctgtgatatttttttcttatggaacgttgattgaacagcttccatgggtgacctggtttggatttccgtagggccttgcttataatgctgaatacactgttagtttttacttttgtgtcacaaaagtaaaggttcatagttagatctaagccccttgggggacaggaactgtgttctattcatactttgaattgctagtgtctggcatgtagtagtgattaatatattttttaaaatgaatgtcaagtattatgacaggcactggtacagaaagatcaagaagaaatgacctcttcccttgtgagaggctcactattgtgatagaccaacctctgaacagaggaattaccatctagggggctgttataacaggcatgtgctgttcgagttcaggggaaagatgcacttgctcaaagagggaagtttgggaggtgtacgggaaggaggaacccacctggatcttaaaggctgagctggctgctgaagaagagaggggcacttgggcctggtcaccagctgtgcaaaatcaacaagggcaaggaagtggctgatgaagcctgaaacagggagattcccaaatgtgatctgtgacctcaaaattgaaaattttagttagtgtaattttagtatattttatgtgcatgttccaaagttttttgaaaattggttttatatgtttagcatatggggcaattctaaattagtatatttgattaacgttgtatgctagtcctttgaaattctgcagttggattgtgtatatattgtgtataatgttacctcttttccgacttcatgaacctaacatttaaagtggaaacaaatgcacgcatgtgttagtgtttagtgcagcaagaaagcacggcccaccacttccaagaagtgagtcgttgcatagggtgccccgtcctcagaacattgctcattgttcattttttattcctcagctccttagttctactcaaagtctaatattagtttaactaccaaatggcagaaaccagagtacgttgtacatttttcttgaaggatacaactggaaaaaattttgcagaggctcatgtgatgctattttccttccgtggtgacacttagaattcgtttcacattgcctttgagagaaacgaggaggggggagaagcctgtatttgatagttttgtatgttcctctaaagaaagagagtgcttgaaaaaagaaaggcaggctttcagatgttgtctgaacaaagctacggaaatgtgagacgagagcagcatctggagattttcaaacactggaacatgggctgcacgtttcttttgctgttggaggagtgaaaagctgtttcctgtcatttcccatcttgtcacttccagaaccaacatcttgctacttcttgcaccagctgctgctgctgttgttttttttaccccctccacagacagatggtaaaagagctttgataatcctcgcccaacttccccagttctaaagaagtttgcggtgtggtacctttatacaatgatcacatgccctgatacctactgtagcctgttaatagagttgggaacagagcagaaggatgtgctgcagacttttaatgtctatggcattctttgtcatgtctcatgggaaatgctgtgcacaagccccatctctgtggatgcttcgatttagcttctgaggttatatttagaaaagaggaagttgtggggagtacctttgcttccataagaatttgagatttctgatcaagatttctctgtacattgaatccaggatgggagttgctcttgatattcttgttcgtatccctaggttttcgcaaagcagaattaggcatattggatataccatcttttcacagggctgtttatccttaattactttttttacacctatttcttccaatatttttcttgcattacctagtgcaaacaggaacttagaagttaatgcagaaaatgccgtatgcataggaaagatatttgatgcagacaaccttggttttgttttaagttttattacctttattattacaaactaaaaatgataacctcaatgagggagcttagcctttctgtccccccctaaatcatggttgctttcctaagtataaaagtaacatactcattgtagaaaactttgaaagtagaaaatctattacagaaaatacaaagtcatccataattccttaataaccactcttacatttggtatatttccttgtagcttttttttagagttatgtgtgcctgtatttctcttgtatacttataaacttacattaatattgtggccattttccagaatggatctggtggtagtagtagtggtgatgataatggcataacctaaaatttattgaacatttattatgtgatagtcactatggtacgtgctttacatatattacacatttcatttctcacatcagttctataaagtaaggattatttatttttattttagacatgagaaaagtgaggctgagaaacatcaagtaattttcccaaggtcacacagtgcgcaataggtgaagctgggatttgaacccagatagtctgtcttcaaagctcatgctgtttgtcatttgctcatctatgtttaaaaggtctgaatattttttaaattattgatacatatagcctaagattttctatttattcagacttttcagtcatgagagtacttactgcgctctcaccatcttcacatatcatcaaatatgttttacctttataggtgtttggggtgaatgattgctcagtttttacattggcctttcttgattactagattgattgggcattttccatgtgttattgatcatttttatttaatctataaattgtttatgttctgtgtggctgcttttgttcaacagttaatttttttgtatacaaaatcatcatgtgttaagtatattaactctatgttgtgtttgtttaaaacatgtctccttctgttaacttgcttccttatatttgaagaaaattgtatgaatgttttaaatatgtacatattcatattttttctttataattctctcccacaaatcagttatttagcctatgttttcctttattttatggtttttactatttataacaatttttaaaatcaaatctgaaatttattttaatatatagcatgctatgagactttgaatttattttattgatgggtaatactttttgtttttgttttgctacttcctttaaaaaatattatgcattatatattccactcttctgtggtggcattctttattatatatttgtttattttgtctaccagcgtctcttcaagcaatctttctgtgtcagtggcctgtgtatgggtatgcctacagacattttatggatagtaaatttgtaaaatgtgcaagaagttttttgtcttaaaagcacccagactcagcatcagaaggcccatatccaaacctcagtataacctcatgattgacttgtgacatgaccgcatgtaggcttaaatgctgtcaggaaaattaaaggaagtaaaacgtgaattgagaaatttggagatttctgaaaattttgaaaattgagattttgctgttaatatcacagccgtatcactaaaatttccacaatcctttgaatttgtgaaatctatataaacatgatttaaagtacttatgatattgtcctttttttcatattacccaaagtatggaatttgtggcaaataaataaccaggtatatatggcccatatagatatggtttttatcctgcacttcttttgagatagctgggggctttactagagagaagaaataaaacaagataactttggcaagtatagatgaagtttgagaggtgtcttatttcattttgtgttgctataaaagaatacctgagagtggctcatggttttggaggctggaaattataagagtatggtgctggcatctggtgggggcttttttgctgcttcattccatgggagaaggtggaaaagcaagagagcatgagagcaagaggaagcagaactcactttaataacaacccactctcgcaataaccaacccaactccagtgtgaatgacgttaattcactcatgaaggcagtgaccccacgatctaatcacctcctgtttggccctacttcccaatagtgttgcattggggattcagtttccaacacacaaactttggggacatggttaaaccatagtaagagggaagtttaacatttgtttaacgttggtatcgaaaggaactatttacgttgcagccccgaaaagactacaaataatattggttaaaatagaagtgggctgtattcttttgccattgcagcaagccttagtagtgacctagattcaaaatgttactttgattttatttaaagcactgaagtattgcatttttcctcgtggttttatgcacctactaagtgcagctaccaatgacaaagatcttctataataaaaatgatgtttccttatttttgggtcttttttcaatctgaaaaatgtttctttaatcggattctcataataaccctatgcagccatataatctatggtattattatctccactttgtatatcaggaaaatgagactcatgctaaaatacttgcccaaggtcatatgacttgaaatggtgggactagcctctggcttagctctagtgagacctaaaataatactcttttggtttggtgagttccatcctttctttttttaaagaatttgcatatctaccttatccacttttaaaatgtttaaagaatttatttcaggtgcctgtccagagtgacacatgtcaaaatgttttttaaacagataagtactattcaaatacaaggctttatctttcttactgcctggggtaagatacctgtcttccctgtcccaagttatatgatgcttatttaaaaagttacctgtgagccttgcttattaaagtatgcctcagctatgtcatgaggatatttttttttaattaattttttttgagacagggtctcattctgttgcccaaactggagtgcagtagtgtggtcacagctcactgcagccctgacctcctgggctcaagtgatcctcccacctcagcctcccaagtggctagtactacagtcgtgtgccaccacatccagataactttctatttttggtagagactggggtctcactcttttgtccaagttgatctcaaactcctggtcttaagcaatcctcctgcttcggcctcccaaagtgctgggattgtcagcataaggcactacgcctggctgaggacatttttaaaggtgtatacttcaccatattctcttttcctctacatgaagtttagcaatgttcaagatggtggccactccatcccccttgatgactgagtgactgtgatgagccgagcacctgctgactcacaacagccatagagacataagagtgtgaacaagaaataagcctttgttatttttagccatggagattttgcagttgatactacagcattatgtagcctatcctgaatgaggtaggatcataataatatgtttgttatgcatcacacaagtttttgggttgtttcaatctaaagatctgaaattatacccaaactagatattctccagtatcaccaaacaggatctatccattctacagtgctcaccagattgcttctgtcatacttcacctggacatctgtggattctggatattagaaattggaaggaaaagcttgtaaggggatctcagtgcccagggtcaaagcttcattgttgggcagccaaggaagagatttgcttgacttacttgagtaatttttgacacatacttgatttggtcatcaggcataaaggatggccagattactagtaacttattggagatacacttttaaaataggagttaaggctacttatgtgttgatctgaaattaagaaaagggcaagatttctccctgtggcctgattttcaaccatgactaaataaagcctgaggggagccactgaggatggaaaaggtcactcagtcttttttgctgatgaaaaaatcgagttgtctagctctggattgacatccagcactgacatgctttaggaaacaaatcttttgatggcaaaactctcactagcctcacctctcctctcctttcctctctcctctcctctcctctcctctcctctcctctcctctcctctcctctccctcatttttcccttttctactctcccacttctaccctcatttacttatttctcaatttagctcatcagggctttttgttacaaaaaaatggtgtgtaagttacttagctgtaacttggaaactgttttcccatgaatagatgacagaattactacatgccaaattatcccagaataggtggcttaaccaattgtataattaagttactttaataattaccaagagggtcctgagccccatggaaaccttcactgcttggaggatgtataaatggaaggtgggcagcatgagtcttttggactggtggccggaacaagcagttcttagctttttttaaaatcatctttcatatttcagagcaattctttgcataatccagattgcttctgtcatccttcacttgatcatctgtggattctgagcttcagggtggccatgcgacctttcagcccttgctgtggaaggtggagctcctaccatctctgcctgtgttggggctagacgaagtttccctctgactgcctcaatcttttcactgtcatgtgtcctgggagcctcctacacagtggagaggagggagtatgagtctcaggaaccattgagttttttcactgtgaggtgggacaggcctaaatttctccccttaggcctgccattcactgagggtgtgcagtcatcatgctaagttctctttcttgctccattttcatcttcactcaccccttactttctgcaaagcgttgatggtgttgggttctgacagttaccagttggggcatttgtgatctgtggagaaggcagagatagttaatgagtaggcacatttgctaacctccttggacaggaataagttcaaaggggtggacaagcaggattggctggaggaggcaggtctccacattgttctctcttgcccctgggccctggcgtccagggtaatttttgtctgcctttgtggttcatatttttagctctctgtaagaggcccccttggtaaatatgtcagttcattgttaaacctagacatgagtttgacatctattttgtgaaacaaaccatgtaaaaatatgggtctttatggtgttcagtgttccaaagtcaggaattttttagtttcttttgtcttcacttcttgttattctctcacttgctttacttcttccagccttttccttttccacctcatctcctgcttcttatttcctcatctctttttccttaccattttttcctcttccatttctcccttgatcttttcattatattcaattcatttcattcattgaatggtgttagaagaggctttgtctttgcagtcagaaggctcaggtgaagcttcatatttcaaagcacactatgctgacactaagaaaacatcttgcccgggcacttcagttgaagaaaactatatgatgtgatcagtatgtgatgatggcttttcagatcagatagctgggttgtatttataatttatttctcttatcagtgaaaaagataaatgataatgtagtaacaggattttctagagtttgggttgtagagaaataagtgctcatgaataggaccgcatatgtgtgcatgtatgtgtgttttgggggtatggagaaagaggaggaaaagaatattttatagagaaaatttccatatggttaccttttataggatctagcacatttcaatgaaaacacactttgctggaagaattcaattctctgtaaagtttggtgcagcaaggggtgaaaatgtggggacacagctggaaacttatttgtgctgcaggcttgcagctgtacctacctgtgatgcgatgaatactatttgattgttaatgtctttctgttactgaaagcttgcttcctttcctaaagctgatggtaacaatttactgactgtctaaaccttgaggactaacttgggctgggaaaaataaatcctgtctcctgaaatttacatcttattaaaactcaaagcagccagcagagatgagaaggatctccagcctgggagctggaggtgggaattctgctcaagtcaagatcgcttttagctttcctacattctcctgtgaagaaccattggattgaatgatggtggcaaaactggtgtgacttcattcagtttatctctatcccatttcccctctccacatttgactgtcagtctactaatgagacccagttatggtccttggaaggggaaatggaaggtggacatagctgtgggggatgaaatggaggagtttttaatatcttagcttgcaaatttactgtctgccatagctgaagaccatctagtaccctctttaacttttgccactttggagtttcctctctaccgttacttattcagcaggtttttgtttttgttttttgagacggagtctctctctgtcaccaggctggagtgcagtggcgcgaactcggctcactgcaacctccgcctcccgggttcaagcgattcccctgcctcagcctcccaagtagctgggactacaggcacgtatcaccacgcccggctaatgttttgtattttagtaatgatggattttcaccatgttggccaggatggtctcgatctcctgacctcgtgatccacccacctcggcctcccaaagtgctgggattacaggcgtgagccaccgcgcccggcctcatcagttattttttaattggctgtgttttctttccctgtaaacacacttgttcagaaggaaatataatatcactataatgagcagaaggcaagtatcacatgccataagaaagtaactataaaaatgagtgtaatacaattaaaatattatgaggctctagttagatactgttccctatggaagattccgaacttgaggcctgcactcacttctgtctcaagtagaaagggagcttaaagaggcatacactttacatctaaggaagcactaagtgaggcattgttcttaactaattagacagattaaaaaggaaaggccaaaccatgccattgtcttagctcttgttttctttgattttgaagatggaaaaagagataacacttaaaaataaagcttgcctactcagacataattaaggtattgtcattcttttttgtctgtcctggttctcattgcaatattttgttcactgctcaatgagtatttattaaattaatgaagatttcaatgttaatgtctagtttcatttgcccttcctctaaaggctgtattctttttttgctcttgctctctgtgattttttggtagttctcttttatgtgcttactcacacatgagtgctttctctaacacactggtcctgtgttttgcttctttgtgtgcattcacgtagacatgcacacctcttcaaatgacacatgcctgtaggcaggataacaggttgagttgtcttgttaattaggcattctttttctggggctggtacaggatgtttgagaatactgtcccccagaatactcatctggtacactggaactgccatggactagttttccagggcttatacatacaagtggcttccaaaaaagcattttcagacaagctgcttgttatgtgaatgtgtttttctttttagtcaaccacaatatatgcagcacaaagctgttgccattttcttggaatgagaaaattatgagcataatgtttcttttacatctctgaaaaacgctaatatccagctgttgtggtggttgcagttgtcagttgctttttgtaacccgacaacactgtctcaaggatgaagagaggaaatttggtgactagtctttcctgctcactctcctgaaagtcctattaatttgcttttttaaaaacaacagccaagtatctcagttggagaaggcaaagtcttattggtccttatattctgtgcttggattagtatccacagtaaaccacacacattttgttccttgcttaacgtgagccaggtgttatactttaaagacataatctcacttagtcctcacaaaaactcagtgaatacatactatcattagcaccatttttacagatgccaaaacaaaaaattgaggttaaataattgcacaaaatctggcagccattaaatgactgagctggaatttaaaagcagatgtgtctaaattctgagcttacatttgtaaccactgtatataatgtagtataataacttccccaataattgacagagtactttactcagaggctttacaaggacaataaaagaattagttgagataacacaacccatgttgtgagaagattgtctttttgattcacagttcatgcaaagaaataatatacagcagactgtgaataatacacaaacgaaatgaaatttcattcttgaatgaattatctgtatctccttttaagaaaaattggtaaagcatttaactggtcatggctcagggaaatgtctctattctgtttctgtctgaattttattctttaaatattcactttttttttttttttagcatccagtggccacctagttgttgttgttgttgttgttgttttttccccctgtgcttatgcttgtgccttgcagggctgcatttctgcttgctgtgaattctcagttcacagctgcagttgttcaaactttaaatttaaaattcagtctatgtttctagtaattgctgctgggaaactgaaacaggactacttggtttcagagtgaggctgttgcttcatattggaagaaaggtttcattagcttggaaagcaaatctcgggatatcaagaaaacaacaaaggctgtaaattaatgcagaactcaccctaaaaagggtcaatgatgaaagaagggagaaagaagagacaggagtttcagtggtcaagggaatattttcttcatgataacagtgacctgaattggacagaaagcagaagggagtgtgtcattttaagaaggtcagtttgacagaccgcaatattccaggtttctattattatatataattgacattgttagctaagggatggattttcactatttccttctgtagtacctcagtcccttttaagtaattttttttttcctgacttcaccaccaggatcgtgtgatggtttaggaggagatttgggggatagagaggtgattctgaagataaacccactttggctgcctctgtggtctaaagccagtttggagagcgcactacagaaacagggaattcacaggggatgagtcagagagagggactggagcagtttgtcttgtttcacttgctcttatcacacagttcactcctttctgctcatacattgtgtagtccaccatggagagaaagggagaaggttgcacaatgccttgacagatttttttttttttttttgaaacggagtcttactctgtttcctgggctggagtgcagtagctcgatctcagcttactgcaacctccacctccccagctcaagcagttctcctgtctcagcctccctagtagctgggattacaggcatgtgccaccacgcctggctaatttttgtatttttagtagagacagggtttcaccatgttggccaggctggtctcgaactcctgacctcaagtgatccacctgccttggccttccaaggtgctgggattacaggcgtgagccactgtgcctggcctccttgacagactttttaatgattgtagggatagagaatggtatacaagtaaatatactactactgtttttgaactggcacagtgatgaagactaagccagtaatgctatgaaacttcaagtattaaatttctaaatatttggcattaggcaccaatctaagttacagtttaatgcttttcatcacttgtaacattaccaaatcagaggaatgaaataatatttatccaaataaaagatgtgttaacttcgccaaagtgaatgcacatttttctttgatttccccataatacatctttctttttcggggaagacagaggttgggaatgggagggagggagattattgtgaatctcagattatattgatcagaaccaagtttagcttgttctggtatgtaaattagagatttgtagttaagtgaaattgattttgctgagactaaattaatcacagtccttaatcactgtaacctttaaacattgcagtcttggccacagctgcagggcagagcagtgctcctccgagctttatgctgtcatttcatgaaaggctgaatgcccgtgacttgtgcaaacaagaattcccatgtacaggcttcagagctggttccctgccctgcaggggatcagctggagcatctcccacagggccaagaggctgctgtggcctcttcaacccaagaagatgttctgctcagacacaaatattttcagtcttcctccagacatcatcaaactagccatcactgcgaaatgctcacaggaaagtagttgttagaattaaaatcagaaacaaccagttatattgtgatagttttttctttaattgtatatgtttatgtatatttataaatatatttatatttatagatttcttttatatatttatattatatttatatatatatgttttactgatcacattttgaactatttggaagggtgatgttgacaattttgaaagatagtgaggcatggagaggttaattgactcttcagaactaatcctgagagcctagaaggagggtcaagaatagaaactgggtttggtttggttttgatggtcatttcagttctttggtttccgtttcatgaagcatcccagaatcaaaccatcattaagcctgccatagaaatgcaaattactttcccactttagttggcatatttgaaaatagttttgtgtgattttttttagccccttttgtagtctattcatgaagtttatacatgtaggactcttttttttttaacgcctttaactaccaatcctccatttttcctttaacttttctatattcgctgacttttatgttcagttgaaggaattcatacacattcagtataataaagtgcagctggatcaatcatttaaaaaaatcagtgaacatctgtatttcacaaaatcacactttatcaggactgaagggtataccaggatctaacgatcaacttcaaccactcagttttgtaaatgaagaaaccaagagtagttaggtgaaatagctttctcaaggtaatttactatagccattctgaggctgcaccctagctaatttgattcctgtttaacactcttctctatgacattgactgttttctctgtaaaagagatcccggttatacaactatttcacaatccgattccttataaaaaagcaagtagtgctcaataaatttgacttaagttgtactttataagctaatgtaaaaggagatttaccataatctgccgtggtgagttgcttatagtaggagaaagaatatcttaaaacttactttacaaaaaataacagatgctggtgaggttgctgagaaaaaggaatgcttatacaatgttggtaggaatgtaaattaattcaaccattgtgaaagacagtatgtcaatttttcaaagacctaaaaacagaaataacagtcaactcagcagttccattactgggtatatacccaaaggaatataaattgttctatcataaagatacatgtctgtgtatgttcattgcagtactactcacagtatcaaaggcatggaatcaacctaaatgcccatcaatggtagactggataaataaaatgtcatacatatataccatggaatactctgcagccacaaaaaagaatgaggtcatgtcctttgcaggaacatggataggagctgtaggctattatccttagccaattaatgcaggaacagaaaaccaaatactgcatgttcccacttttaagtggaaactaaatgatgagaacacatggttacatagaggggaacaatacacactggggccttttggagggtggaaggtgggaggatgaagaggttctggaaaaataactaatgggtactaggcttaatacctgggtgatgaaataatctatacaacaaacccccatgacacaagtttacctatgtaagagacctccacatagacccctgaacttaaaagctaaattaaaaaacaaaaacaaaaaaccaaaatacttactttaaaaacaatttctgtggttgtccttctcttttttattgtatattggtttgtgtaggtccatttaatttgtttacttttcgtagtaggaatacaattgtcagtgacatctagtagattgaacataggctctgaagctgaagcctcaggtccatctttggccctgacactagccctgttacctttgtcattttacttaacagctctctgccctaaaccataacacctaccccatagagttgttgagacagttaaataagttaatgaaaagtcaggctcttagaatagtgctgggcatatatgaatgttcattggatattatctaatattgtggtcattatcagttgatttcttcttaatttaaaaaattttcgtatgtgatttcatgtggttttagggaatgataaatgtaatttagactttttattccattgggtctgttacagcttttttctcaatgaaactgatttggttacctcagttctaatgctggctttgcctctgctttttgatcacatttagaatacagcactcagttctgggtatgtccaagatagataggggagaaaggtaaaagagaatattaatgcaacttgattgtgcagctgttctttccacaaatatttattgaatgactgctgtttgtcacatgttgatgcatagggacacggtgcacacctgagattccattcctgtagacaggacatttgcctgcttcctggcacttatacctctccccaaattgacaccaagcattattttagaaaggcatttagtagaatgcaatatcagcaaatgaaaattgtagagttgtatcttgaagaaacttgaccccaccccccactctcacctgcatccccacatagagccaggacatctcttaagacccaccttcctgggtttgctcatagttggcacttaaaacattctattgcagttacctatttttgatggactctgcaagagagagactgtcagttcacaagggcactgatgtttggttcttcattttatttacagtatgctatacaaagggataggtttttgttgttttgaatatatcttgagtactcctttggaaggatagagtccaaaggcatcttacctgagccagaattcataggggtggttccctaccgtttcttctttcctgtacacactcaccaccctcaaatttccgctcagtagaggatgctttaggaccttttttcttctttctttctttcttccttttctttttttcctttttctttttgaggtagggcctcactctgttgcccatgtagtggcacaatcatagctcactgcagccttgatctcccaggctcaagtgattctcccaccttagcctcccaagtagctaggattactggctaattttttcagttttatttttggcagagacaaggtcttgccattctgcctaggctagtcttgaactcctgagctcaagtgattctcccaccttgatctcccaaagtgttgggattataggcatgagccaccatgcccagcctagaaacttttcttttcttttcttttctttttttttgagatagagttttgagcccaggctggagtgcaatggcgtgatctcagctcaccgcaacctccgcctcctggattcaagcgattctcctgcctcagcctcccgagtagctgggattacaggcatgcgccaccacacctggctaattttgtatttttagtagagacggggtttctgtatgttggtcaggctggtctcgaactcctgacctcaggtgatccgcccgccttggcctcccaaagtgctgggattacaggcgtgagccaccatgcctggtcagaaccttttcttgactccacttaagctcttccatttgaactttcttttaattatctggattttaactttatcagaattagtctgccggtaatcctgtttttagctagaaggttaggctttgagaagtgtgaagctggatgggagggaaggaggccagcaaagggaaagggactagctgggttgaagaggccccatctgctattccagatggggcatcctgaattcatcactcctaaaactttgctctatgtgttttctaggctgcagcatccagacagcagcacacccttcacatgttcactgtagtaaaataacgtggaaagggtagaggtatctggcagataagagaggttatttcgtaaggctgtgatgcccagcacataggtctgtacatcacctccttcctgctgctcctcaatctgcctttctttggtcactgccccctgctagtatttaattctgttgaatttgttcaaattgacttgtttaagaaggttacccaaatctgcatacagccttcagcattgctttgaatctcctttaggaaaggaaatgtagattcaaatacacaggtttatctctctgacctttagctaattattagattgagataaatgtgtgtaagtgacaaattgcctttaatgacatttaatctgcatcctgacattaatgtctggtttagtgtcccagttccatagaggcaaagagcatggacttttgtcttaatttgacctatttaaaaggtgtttgtggtgagagtcaacctgtgattaacttaatagcatgttttacatgaaaagcaatcaaatattgatgtaagaagaggctactagatgacatattttccagtctgtcataattggcaaaaacatcagagaaaggagagagttgttagtaactaaaactgaatgaaagcctcatagctgccccaaatccaatactggtgagcacattgatagtatctgaagaaaggaggctcttcttgttgtttattgtcacagaggccattcactgaactttggtgggtgttagactaatagatttttttttttttttgagacagagtcttgctctgttgcccaagctggagtgctgtggtgcgatcttgcctcactgcaacctgtccctcttgggttcaagccattctcctgccttagcccccaagtagctgggattaacaggtgcacaccaccatgccaggctaatttttgtatttttagtagagaaagggttttaccatgttggccaggctggtctcaaactcctggtttcaagcagtctgcccccattggccttccagagtgcagggattacagacatgagccactgcacctggcctaaactaatagattttcacacctttttgattcactaaaggacatcataggggcttattaaataagtgagctatttttagggagtgagaggtctgggaagtggcattcttggtggatttgttgtgtgctagtcaggtgctaggtgctttgctttttgcattctcatttaactcctaactacaaaaacatttgtacaggcaaccctctaactcgtgataccatctttttgaattaaattaatttttttttttaaataaggtcttgctttctcgcccaggccggagtgcagtggcatgatcacagctcactgtaacctcaaacttctggggtcaggcagtcttcttgctttagtctctagaatagctggaactacaggcacacgccaccatacctggctaaattttttgtagagacggggtcttgctgtgttgcctaggcttgtctcaaactcctggcctcaagtgatctttctgcctcagcctcccaaagtgttggaattacatgtgtgagccactgtgcccagcctctaattggtgacttctcaattaactttgacataagtgtgtgttttataagatcattatcaccgataataaatgcagcttaatttctaatcaattggccaaacagggaaatttgagttgagtgagatcattaacaactttctttagcgctttaagagctaagtgatagcttttccagttctttaaacattacaaactgccgttcctggtgaatgtcattttctcaaattcattttcagagactggaatgggtctgtgctactctatataattttgtgctgagcggatggtatattgatgggaggaagtaggagagtagtgatggaagggcacaggcattggagtctgtctcccaggtgactctgtaagtttttcaactttcctatgccttgatttcctcatctgtaaagtgaggataatgagttaatgaatgtaaagcacttagaagggtgcctgtagtaaggacttacaactgttttatttattgtttttggagtttggttggaggattcaaagcaacattcattaaactaaacactcactaaattcactaaaatggtttccaagtgaaataataaatatagcaaaggagtctctcctctgctatggagtagctgagttgagtgcatctgggtgtccattctgctgcaaatccaggccaagcaaatacagtttctgtgcaattaaatggttgttgactggcaaagaaaaaaaatgtaaaccatagtttttccttctaccctgtaatctgtggtgtctttatgcattaccttaagagcaacttcagtgacttgattagagggaggtttataaactgcttggaggcaaagcaccgaactcttgactggcacacagcaggtccacaaggaaagccacttcccagggtaagaaagcacacacaaattattcagggacaaatgtaatggttacaagggtgtcatagaaacagatcagaatacttttatactactgcctggcttcttgttcccccattccccattataattctggattcttaagtttattttaatgacaaacatttttgcctgtctttaagtaaaagaacagaaaagaagttacttaaaatgcagtcctaattatgtcctaatgcaattttgatgcagcaatatgctttcaaacaagcaggtactgggtggcagattgacacaagtatttagtgaattgagaacaacatgtgttacatgaaattataatcaaattacaaacaatggaatggattgttgcttttaaaatcctctgaatgttggttaacttcatagggcagtgctgtgactatttccattaattacggagtagttatactgggacttgaccaagctcttttaatagttccatctgatttatgtttttctcttctctatttttcttttctgtctctttatttctttttgtcactatttttgttgacctgtatgtgtgtttttttctctttctgtatcagttcaagttctccagagaaataaaaccaataggaggagtgtgtgtgtataaatctaaagagatttattttaaggaattggcttacttgattgtggggggctggcgagtctgaaatctgtagggcaagcagtaggttggaaatttggcaagagttattgcagtcttgaggcaaaatctcttctttgtgataccttatttttgctctgaaggccttcagttgaatggataagacccacccacattatagaggataacctcctttacttgaagttaactgattgtagaagttaaccacatctagaaaatacctttatggaaacatctaaattcatgtttgattaattaactggctgcctgctattgccttgccaagttgatgcataaaattaatcataacattgtctcattcctttttccctcactgtgtgtttctgtctctcatctcacatgcacacaaatgaggttatgggacagcattagtgttaatgaatttcaggtaacaggataatgatcattatagcatctaccagtaattggatacctattatgtgctgagtcttgtatttgatgctttgtatttctgatctcatgtaatcctcttgacaattccatggattggacagaattaattttattttatgggtgaggaaactgaggcttaaagagctgctagcttttatttagccatgtagagctcaaggttcaaactctaatctgcctttcctgcagatatactctcttctgtatctgcttgtttctctaatattcccccatcactgtcatcactggctatttttcagtgtttcacttggatgaaaaacatatctacatactttttttgtttccttttttttttttttttttaaagacaaggtctcgctctgtcaccaaggctggaacgcagtggctggatcttggctcactgcaacctctgcctcccaggttcaagtgattctcctgcctcagcctctcaagtagctgggattacaggcatgcactaccatgcctggctaagtttgttttgtatttttagtagggacagagtttcactttgttggacaggctggtcttgaactcctgatctctggtgatcagcccgccttggcctcccaaagtgctgggattacaggcgtgagctgccatgcctggcctgcatacttttttttactaagcttttttttttttttttttaataggatgctgaaggagctgaggcagtgctgaaggatgttaaaagcacacacagtggagagcttattgttgttccaaggcctaattggagatctaggttggcatttcctacagctttcaaagtgtacaactaaaagactatcctaagaagatgagatagtttctgaactaggcacgaaaagctgtaaggagtgtcacctcccagtgccctctggcctatttttctcactgatggattgctttgttatctgctgccagaccccttaatgtgctggctcagccttcacagggattagtcacagaagatgggcgctgcagctgcaggtctggctccagaggctttgggtggtacctactactacttacttagcccttagccagatattccctagaagggaaaacgctccttagtttcactgaggatctggcctcatgagcagacactagttctaataatactctttaccttctttgtagctcccagccattgtcttctaccttcccttgcctagctttagtcactgccagcagctatttctaggctgttggcactttgaagtggaattgggcagacagaggtgagagcaggctgtgagttccctctctggaggttggctccttacagcacacatgggaggcagtgctgaaggatgttaaaaagcacacacagaggaagagcttacttgttgttccaaggcctaattggagatctaggttggcatttcctatagcttggcatggaacgatttgaatgtttgtggatggtgcttgcctcataccttgccaactcaaattttgggcagatcagcttctgtgagttttgtctcgacaagttgggaaagtttcctaactttagatgactgtgtgaatctttgaggagcttgatagttagcaggtgagggctgctattttgaaggaaatagacattaatatattcttctttaatatatctgaatgggtatacatatgtgctcctttgtttcttgtaaatgggcagtacaggagggagaaactgaaggagaggacttggtcaggagataaacccccacagatgccaagatgttggcttgttgaagcttattcgtggttagttttactgtgatactatgtgcagatggttcctaagttataatggtttgacttatgattttttagttttatgatagttttggtgcaaaatcatttttttttttacgtttagtacagtatccaataaagtgtgacatattcagtactttattataaaataggctttatgttagattattttgcccatctgtaggctaatgtaagtgttctgagcccatttaaggtatgctcggctaaggtcaggtgtatcagatgcttttttgacttttgatattttcaactaacaatgggcttattgggatataaccccatgataagtctaggagcatctgtatttgtctgtgaattacttagggactcttttgatgtcttcgttttggaaactctctgttgttggtttttgttattttagccttgtcgggttttcctcatactggtctaactgctagtatcttttattggcccctctttcttggatatcctttacatgtttatatttgttagtgtttcttccttgacttgtctcacttctcgtgtttccttgggtttgcctccattactaagtcttcatccagcccctatgtcattggttctcaaagtgtggtccccagaccagcagcagcagcatcacctgggaacttgctggaaatgcctgaactaaacttaagacactatataaaacaggaaaaggcattttacattttgatacacattgtcaaaaacattgtactggtttcatggtatgcattataaggcataaagtagatcaagcctatgttcctaatgcatacatttctattgacctcagagagtgaactatcatataatagaaataggattatcattagtttaatgaatgagaaagactcttcatgtttgttctttacctaatctatgcagtttaaacctagatcgacctcagggaaatatgggaaattgtgttctcttctggcttgtttaagtacaaggaactcagacccactctaatttgctttaagtgtttttttttgtttgttttgaacagtaagaaactatttagggtggagaactttatttcagtaaggcctcatgtgaagtggaattaagacagtcataatgtccttttgtggcttgatcttgatgaggtgataggcttctgcacacattcatcaactgttcatattctttcccgctctgtccgccccccccaccctcatcttgcttgcacacacgtgcatacttttgcatgctctctgactctctctcttcttccctctccttcctgccaacacagctgtattcatcttcatttctttttcacctggcttcctccctctctgctctgtgtcttttcaggtccctcccaagtttagttcacgcattactcattctatgaacctcttaaacttcgtgcattctatcttttatccctattactatgtcaccctggcagtttcataatgcagatttctgagtaggagtcccagtgggacagaacctggccacttgatggcaggtccagtgtcctggtcgattcccttagaaagtgctgtgcagaggactgttactttttcttatagatcattctatgttttaagtattaaatgaagcctcagctccagcatagcgtttctgacaggctgactcacttcacatttaatgattgtatccagcatcttgtctctactctccagcaatgcagctccttcttctggtgtcgtcacttctatggacatatcctgtggatgttcccatccacctgagcccaaaacctctgtgcttgtttgttcctcctcctccttagccctcacatctcttcaatatttttctctctctttactattacttaatgctactgccatattgcttcttgactagattttaataatcttctgatttcaatctgttactttgtctcagtcagaataacctacttcccctttcacatgaaatacttatctaccctgaggaatatccctcaaggctctctattgcctgcgaattgagaatagactcctctgctgaagattcacggtcttcagcagtatgccccctacttggttcttttactccaaacactgtactctagctacataggactactgagtaatactcctcaaaggctccctctcttgggtacttgtaaagtgccctttagctgtgtagcagagaataggacaggagtgcacactctggggctagactgacgggctggaatctcagcccagcttgaaaactttgagcatttgttattttatctttctgtgcctcatttttctcaactgtaaaatggaaacagtgatagtatctgccttgtgggttgttttaagagttaaatatggagcactcagagcagtgccagacacacagcaaatcctcaggtctttccagggatacttttttttttttttttttttaatattctccattagacgtgatgtttctgtctctgcgatgtggtaattttttctgttttttatttttaagggtacctatcacagtctgcttcccccttttcagattatttgtggatttcagatgttcacctgtttttctttgagctccttgagtatggagatggtattttattgaaacttatattatgacatacggagctcaataaacatttgttgaattggattatatccaaaagatgcttctgctaaaatactgtagtaacttccatctgtcccatgaatgttcgtgttctgagacaataatgtaattcttaaaactaggttttaaaccttaaaagtgaaagaaagtgaatactttgcggttgtcatatagatgtactgctactcaagtatagtaagtatattggtgaaatatttagaaaaaaacaactagttgtgaatctgaatcagagatcagcaaactttttgctacagagggaaaaatattaaatatgttcaactttgctggtcatattatctgtgttggatctgtttaccacagcaatcgtaatatgaaaaatatgtaaatggttgagttccagtaaaactttatttacaaaaacaggtggactataatttaccaacctctggcctgtgtcattactgtgcaaaccacacatcattttagaagctgtttgttgcaaaagctccaggtgctgccacatccaaagatacacacctgcatgtcttctcattaggtataaggaaacctttccagaaaatctcagcagattactcacaagttcagtggcccaaagttgtatcacattctcacacttcaaaccagttactgatgatggaatgagactaccatgattggcccaaatacaccaggaatcacaggtgttgttgtggataaggcctccctatctgcatcacgtgaccatgttgatgagggcatttccttgtgaagtgaaaaccattgaattgtacaatgaatgtgatacagcatgggctgccacagtccagttgtcacctactcttctgttgttcttctgaacatcatcataatgtcacatttgacaggtgtgaggtttctttgttaaagctcagacttattttaaattaatattcttatcacatgaatagacccgtggtaatgatgtaatgaccttggaggggcaggccagttttccgctgtgaagcataaagtttcccatatgacatccttgggctactcattttggtattctcagatatgcaaaacagagaaaacaacaggcttcccacttcagaattcaccatatacccttctccttcttgaaagggagaaaccaattagacaaggactagccttctcttatacttaataaaggcaggtgagttgagcctcttagtatttgtcatacactatggattaaaccagtttatggcccatgtcattgtacccaaaactctggtgtataatagtaaaacgttcatagttttcaaattagacttagagcttcttggtctcactttagaatattttgacagccctttggctttcacagaaagacctagtccctcaggggtcttgaactgagctaattatcctagtcatatcctgtagaacgggatcccactatggcttgtctgagactgcattgttgtcttgggttgtatgggaccatgagacaaacggctgtactgtttttccacttggcttttctgtggtgtaaaactatcttttaggagccacaaaatgctattcttttacttgttgaaagattttaagaaagaaagaaagggagggagggaggactgtaagggaaaagagaccattaacatgacatgtttcctgtcgctctccaatctgagtctaaccccagatgactgtattcccattgttttattgtgagggcatttgtgagggccttccccttggttgtgtcttggtttacagtctatagaattggattagacaatgttaattcaattaatgactgtactgaaagtttgtcttagtgtgcagtgaaaacaggagagcagcctctaataatctatggatttaatgactgcaactttgaagagtgttaagctaaagtgaagttcagaatggcttgttaactgggtttattagctgttgaccttccctttcagcataatagtggcagtcagaccgaagagagcactaacgtcctgattagcatttatctaaagataggctgctgcctgttacacagtaaattagttcaatcagccataaagagcttgagaaacattttctgctttataaaaagaattagatgttagaacagttcatctggcatagctcagtgaagatggattgagcccctgaacgtgctcatttgaggaaggcgctttgaggatattgagtaattgaacagattttcctacaagattgatcaggggccctagatttcctgcacaattgagtgatgctctaatttttgccttctaataagagcagtacatctgctcctgtttctgtgtattcatcgagtgaaactgaaaatcaatttatttagcacctactatgcactctatgtcccttacgaaataaaagcaataggatctactgatcacagtctatttgattgaagagatgaaaactacactaaaacttgaaattcaccacttccactaccactgcttcttttcttctgaaaagaagaaactgtagaatgaaagctgctacttttggtatatttcttgagatcatcttatgaagtgaagcacattttcccacagaaacagtatagtagtcggggttaacgtttctgactaaagtcttggcaccaactaagttcttctcatagtgggtcataaaagcaaaaaggcaaaaattataaacctttctaaatcatttaaaaacttaaattatgatccaggtccttaaaaaaaggacataaatgtactgtacaattgaattttatgaggtgccccaatgtactataaagtatacatagagcatataaaattctaactccgctgtatcataaatttgacctcactgaaatgaataggctcactgtatggcaagcattaatgaaacgtttaattaacattcccttcacttgcatttttagaattttaaagggcttcctggggactatttcaatggctgaggtttttgcaaaacaaaagaacaaaaccttctcataaaaactgatctcttttgctcaataactcctccaatagagacatttaatttaattagactgatgaacctgaatttgaattttatacccaaacctatgatcatccttaaaaaaaataaaacaaaaaatatggtattgagacagttaagcacttgatgacttcatgaaggcttcctgtggaccctttaagccactgtgtatacacatatcatttatgtccttgcagttttcccaagctaaaagccacagggatatgagtactttgtgagggacagtggtgcagtgttagaatggatgagctgtagggctgtgggcttcagaccctttcatagctccctgtaaggtatcctcctcctctaaccttccctgtaattatgctatgttggtttactttattgcctggtcactccaggagaagtccccagggagtcatacttgaatgaacagatagaggcagagtaaaaaaaaaaaaagacattatgctaagtgaaagaaaagtcattcacaaatgactgcatatggtgtgactatatttgtattaaatatccagaataggcaaatctgtagagatggaaagttggaaagtagattagtagttgtctaggggtgaaacatgagagggatagggagtaactgctgataggtacagagtttctttctggggtggtaaaaatataaaattagattgtggtaatagttgcacaactatctgaatataataaaaaccattgagttgtgtattttaaatggttgagttgtatgtatgcaaattacatcttaataaagctattatttttttaaaaaggtattaagtttcctcaagttaaatgaaatgaccaaaaggggaaaggttttaagcagtgagcactccttgtaatgtatgtgtatagtgagtatgcatatgtttgtaaaagtataatgtgtgtgatccaactatgagccatatggtgctagtcatgatgtgtatacatgaattctagaaaaagaggaagaacctttaagtgagagaatgccatgcattgggaagcagtgtggggcaagatctgtgtggctctagggtggcaaatttagtttgagcttgtgaatccttgcagagattggcaaatatcagatactccttggcagagaaagcagtagagtcaaaattgagaagatttaaggaagcagagactaataaggagagaatgttgaaacctgttatttgtagttagaagtgtagatgtatacaaaatagaaaaaaacaaaaagaatcttctgcattatatcaggaggaacttattggtgttttaggaccattaagatggagaacacagctcactcatatgtgggagctacaaagttgagctcatagaagtagaatataactgtggttattcaaagttgggagacgtggaggggcggggaggatagggagaattggtaagggatacaaaattgcagctagataggaggaataagttctgttggtctgtagcatattagggtgaacaccgttaatcttttattgtatattttttaaaagctagaagagaggattttgaatattcccagcataaggaaatgataaatgttagaggtgatgggtatgctaattatcctgatttgatcattatacattatgtacatgtatcagaatatcatgccatagcccataaatatggttgctacatgtcaactaaaaagaaaatttttaaaagatggaagacaaaagtaaaagataaatgtagatattcttttaactgtttggtgcttacctggtgtcctctgaaaaatcagagtcgtgggagatgaataacatttccagagagcactagatgaggagttagaaaagctggtttatcattcctactctgtctcttcccatgttacattaaataagtaactctgtgatgctttcttcctcccttgagttgtccttcttaccctgagaggatggcacaaggatcaaatgagctgacatatacctattgcattgcacctactagaatgtaacaaatgtttgtcagactgagggaggaaggaaggaaggaaggaaggagtagagtgatatcacatgcaaggaattggatttactgacttattcctctggccaagtgtgtcaacattatgattgcaataagaacttttgcattaatactatttatacttatgggtattattgctgcatttggtaattctacggtaaatttggaggtgcttctagtatcactgtcttgttctaccaatagtcttgtatttattgacagtttggtggttgttacaaatgacaggattgcaaatagaaatcaagctccaaagatggatggattagcttccttgttatgaccgtgttaaggttaccactcagaacaaacattggtagttgagcacgtcttgagtgtgagtgtcatactcagaacaattctaattttttaaaaattacttttttagaggctgtctcactctatcatcaggctggagtgcagtggcataattacagctcagtacagcctggaatttttgggcccaagcgatcctctcaccttagctttccatgtagctgggactatagtcacgtgccattacgcctggctcaattctacttttgatgaagtttttgacatattgacattgggtttgacatgtcattccaatataatatgatactgtagcattcaacaattctcttcccagaggagactatagaaaacagaacatttgcatttcccattttgtactttatgccacccactaaagaattccaaagtcatgcagaatgcctttgatgatgtgagctgcatgtgaatttcttattgcttgacttttaaatcccctttgttatctaggtccattacttataagctgtgtcacattaggcaagtgacatgcctctctaagtttccacttcctaatctggaaaggggggaaataatgagattggccctgtggcatcaggattaggcaaagtacttggcataacaccagtctcacagaatgcagtttttcttgagctgttgggtcagtgatgcctgaaagaggaggagtggaggttctgaggcattgctgtttttatcacgtttgatttgttttctttttgtctagacttgccatattatagcttcatcaggattttaaagacgattgtgaattatattttcaaaagttgtatggactcttgtactttagtataagcagcacaaaattaggcttaagaaacttagattttaatgttagctatgagaccttaggtcactggtgcgtgttcctctcatgaaataagagaatggaaccagctggttctttattcttcccggttccaagatgatgtggtcatagagtcttcattgcataatttcttgttcctcctcatttcttcttaccacactcttgtctttaatctctgacacctttctacccatctccttcaatgctccttctattcatcctttcatacgtcctaaaaattgttatgtcaactatgaggcaagcagtatattaggagctagatatgtaatgttgaaaaatatagacatggttcctgcagtaacagaatttacagtttaatggaagaagtacagataacacaagtaatacttacaaaatgtggtaagtgctatgaaagagcaggacagactgctttgaatgggggaaggggggatccctggcagtttaaatgacttttctcaaagcaggctgccaaaaggtagcggcgccggccagaggtggtttgagaggcaaagcagcaccacagacaggggtccaaggcaagaaaacgctgagctgctctcaggtgctggaaagccagtgtggcttgaagcgtgctaagagtgagactggaaatgcatgccaagtttgaggccgagttcaggattttgtattccatgataagtgtaatgggaaatctatgagaacttttaagtaacaacaatatgggaatcatacttgacttggctagaacaattaaaagctgatctcttttagaaagtacagttttgttttacattaatcttaacacagaatagtgtattacacctaaagtgaatactcttttaggctgggtaggggctgtcccgtggtttaatattgtttctatcataggagaagccttggtttcctagtttcccaccttgtttctcctctctctgccccactgggattctagctgcttcttcactgcatttgctcacctcttcttctccacagtcctttggtccttgaaatgctgtaagagcagaaataacagctatccagagaccttcagatagcagatgtgccttgggcctgtgggtctgtggctctggagggctaggaattacagaagagttaaaagagaaggcctctgccagcaggaattccgaagacaccaaaactgatgtcactggctgtgcaggcactgagctaattcttttgccaatcagttaaatcacctaccaagagtgttcattgtaagtaacactttcttgccatttggtggggatgtagagggacaaaggatgcaaaaggcaacaggttctttccttgtaaaactgtaatctaattctgtaaacaagccatgtacctttggaaggtcattttgaactcagtcctggtaaatatttgacaggtgttttaaaaaaataattatatttatacaatctataatggaatattatgcagcttttcacaaggaggaactcctgccatctgccacaacgtgggtgagcctggaggacattatgctaagtaaaataagtcagacatgaaaaaaaaattgcatgatttcacatatgtagaatctaaaaaataggataaaaatacagagagagaataaaacagtggttactaggattgggtttggaggaaggaaatgtggagatttgagtcaatggatacaaagtagcagatatataggatgaagaagtctgaatatctgtacaacatgaggactatagtgaatcacaatgtactgtattcaggatttttgctgagtgagtaggttatagctgctcttgccacaggcaggaaaagtaagtaactgtgagatcatggatatgttcacttgttttcctatagtaaccttttactatatatatgtacctgataacaacatcatgttgtacaccttaaatatccacaataaaatgtattaataattttatttaaaaatattttaaaatgtggacaattaaaaattttttatataattttttggtagttataatgctctgttcttttacaaattgtgagctggatactcactactcttcttttagcccaaattgagaacatctggaggcatttttatgtgatgactaaaaatacggtaattgagttagactgtatgggtctgtaccctgctctgccacttcctggacatgtctcagttttctcatctgtgtaatgatgatagtagcgtccacttcttgttgttattataggattaaataatatattacatgtaaaatgttgagtataaaacctggcagatattaagcacctaataaatgttaggtattaaaaatatataaagtatgacttctgctttcgagaacttaacctataaatatcctttgataccccgccccccgccctttccaccttgatttcatttacacaagagccaagtgaaagagtagtgagagatgaaactaggaaagcaggaatgaggcagtgggtagagaaggatatgtcctgaccaatggcattgacagagtggttttgacaggtgagtgtggaaatggactgcggtgagggagagtggaggtagtgttgagaacccgtaggctctggcagcaatgtggagcttacttgcagcatagcctcccttcaacttggaaaccaagcatttcaaagtacctgggaactttcttcatcacatccttccagcatttacattgtttacaaatgaaggagggaatagagtatattttattttctgataactttctgggtttccaaagagagaactgtaaaactttgataaacacatccataagagttgctgcccacacggtttcaaaactggatctcttgagctgggcataactggtcataggcagagaaacgttgactggtgatttataccttataccctctcattaaacactcttacctaactacgcaaattaggcttttaaaaatagattatttttattgtttaaatgtagaagaatatatctcagagttataggaaatttgcatgggtacatgtttataataaaaatcctgccaccatttatcataaatggccttggtttaggagtttacacagtagagagctcaaaccactggctttgctatgaaatagacccaattcaagctccatctcttaaaaagccatgtgagtttgggaaagtggcatcactttcctgagccctgggtttctaattattattattattatttttgaaacggagtctcaccctgtcgcgctggagtgcgatctcagctcacggtaacctctgcctcccgggttcaaacaattctcctgtctcagcctcccaggtaactgggactacaggtgcccaccatcatgcccggctagtttttgtatttttagtagagacggagtttcactgtgttggtcaggctggtctcgagcttgtggcctcaggtgatccacctgccttggcctcccaaaatgctgggattacaggtgtgagtcaccacacctggccaggtttcttatttttcaagaggagttataagacccacaaaccttacaattattgtaaaaattggtaataatatatatgaaaagtccccagcacagtgactcctgcctggtaagcaacccacgaattttacctattgtcagcattgtttagatcacctttatttaacttagttataatggggcttaattacaaaggggatccatattctaaaagcaaatactgaaacaaatttttacaattcactaccggttcttcagattaaggtcttctgatcatggttcagtttgggtttttgttgttgttgttgttgttttttctccccaagatgcagtcttgctctgttgcccaggctcaagtgcagtggcgcgatcttggctcactgcaacctctgccccctgggttccagcagttctcctgcctcagcctccctagtagctgggattacaggcgcctgactaatttttgtatttttagtagagatggggttttgccatgttggccaggctggtctccaactcctgacctcaggtgatccctgccttggccttccaaattgctgggattacaggtgtgaatcattgcacccggcctgagctactgcgcttgggccatggttcttaatagtaaaattatttaacgagatttttcccagttcttactggtaaaaatgtcctgtggtttaaaaacgttcaaattaatttgttgtatatttcacatgacagtgatacgagggataattgattatttgaggtattgatttgacctaattcagcataataatttactgattttcattcagtgcatgctaagtactaaatccagtcttgctgggtacagagaaacatacattcattcaaacatcatctcttctctcaaggagctcacagtagaacctatttaaatttaggcagtggggagcatgaggctgcagagaaacaaacatccaactttatgaaaagacaaaattatggagacagaaaaaatgatcagtggttgctaggagttggggagagggaggaatggataggcagagtggagaggatttttagggcagtgactctgtattacagtgggtacatataattttacgtacgaccaaacccatagaatgtacagcaccaagagtaaaccctaatgtaaactatgaaagttgtgataatgatgtgtcagtctagactcatccattgtaactatgtaccagtcctgtggggaatgctgatagggagattgtccatgtgtagggacaggaagtacatgggaactctgtactttctgcccagtttttctatgaacctaaaactgctctgaaaaaagtattaattttaaaaagtggtcttactgctttggagcacaagtaaatcatactaagaagacgatgtttaaattaatatactacagatacagtttgctttactgaaatgcagtatatgatgttcaaaacatatatctttaagtaatagccattttacaaaggaattgcatgtttttacagggaggtttcactggcctattagggcatgttggcttggtggtacagctaagatctaattccttctgccaccaaggagctttgtgaccgtgggaccacccaggaacctctctggctgtattctctgcagaaagacttaggacaacaacatggcatgctgtgtggacatgatttgctttgttgggcaaactggtgggattggtggggtggatactctctaatggaggttaaaggtcctgaagccactgcaggttaccctggggcgccatttctgtgctctggattaattctttgctcagctgttaaatgtctgtgtctggaagtggagatacacaagatgggttggtccccatggctttttatacctcaacaattatttcatccagtagatatctatactaacttgattgtaaacattaagtttacatgggatttctttaacacatccattttctaagaaagtgatccatgtgtaagtatagagtgaccaatgagaaaatagggtaattcccacacacccttccaaactttacaaggagtgaaataatataaattagcttcctctagtgataaaactgcaagaattttcaggcaaaagaaaaacagtttagtagcaccatctacaggctactgaagaggaaaacttcctatgtggcttttaaatgcaaggagtttgtggaaaagggaatacaaaaacttcatactctcttaaaaaaatattatccataaaatatactaattttagtatttttgttcttctttaccatgcattcaattcattttacaatatgtctctagttatcctgaactagtggaatatagacttgattatgtgttttcattaggatccctgtttcatccccatgcttacaaatttctctccctctctgtactaatgataagaatgaactgtgaaattcacatgaattccagtagtttcattgatagtaattcacagtataagacttgaagcacaaagcctgccagcaagggatgtttcatcttagcttatctgtatactcaaaggatttattgcatcatttacttccattatgggaggaaaaataaaagcagacactcttgggtatgtatgtatatgtgtttgccttttttaaaacaatgaagttgatttattaccttctgggtttaaaatcttatctgagccttttctgcccctaagattctgtgattctataatcagaaatagcttggggaatggataattattttgtaaaggaatctagaaaacttgtctttgaatatgataacagtgaaggtaatattttcattcccagataccccagttttattatctttttttgctagttttattttgttttcttataaactattatcaattttggtaacctggaaaattttattggattctccaaataactggattataaagtatttatggaattatcagagttgtaattttctgttagaaatggcttattaaaattaacttaatggcctccttgtaagttgttggtggagttgctgtttcattcattcattcatttcattgtgtgtgttattggaaagtgggtaagagttactggaatgcctagataataagttttcagtaaagcattacacattgcaagaagccaatctgcacccccacccaccccccaaaaaaaaattgagcataaattataattattagaacaatcttacttgaacagcattatttcttggaggaaaagaggaatagaggagatacatattgaaatagtttgctaaactaaagaggaattcaaaggataaaaaaattgataatgagattttcaaggttcctgttgaaacagatgaggcagagcctatcaaaactggagccaggagtgataatggtttttaagtttgtgtagcttaattgctgatggtttaggttgatggaaaacttagtaatactgtttccaattttttcctcattattttaaatgtgtaaaaaaattgtgcattaaatactggaacctttctctgaaaaaaagtaaagcaagttctagtatgaatagaggtttaaagtaaggcactgcctcgtcgtcctatagctaatatttttccctgtttttcttgcaccagatggcactgtttagttctatttcacaatcttattctggaactttcttcgggagaatctgttttagcccagggtcaccagtgacacctctctattctgcatgaagtctttatgaatgcttgtaaaaggtcactgactcagacatgaagctgtttatttgaggtcttgtggttctttccagttgcacatttgctgtgaggtgagcctaataaaccagctgatagaaacctacatgcttcttatagagttcagccagtattttgcttggagacatattgcaacaatatgatttcagcattctcacggcccagtctaattatctgacacattttggaattattttatatgtaaaagtagagctataagcagaagggcacactcactaaaaaaaaaaaaaaaaccttgcagagcttaaaatgtttcatgacagtctgttgaactatagatttatcaaattaacttgcaaaaataaaatttaaagaacctttcctgactattcccaaggctgacttggaaggaaattatcaatgacctctgatgtcattatgcataaatggggcaggtccatagccaagctcgcctctttgctgcacataacaataaaacatccttttggaagatagaattagctttatttaataaaaatgccagggtcatattgtaagacttatctctgtgagctttgccctcccctcccctcctctcccttgaataatacagaaacgttggacataattatgacacagatttcataaggctgcttctccttttacaattatattttatgaagaacagacaatgttttctttgcaaattttgaagctccttcattttctgaatgcattggatttggtactaaatgctctctcccgtttgcatttccttctctccctccctccttgcctccttccctcccttccttccttccttccttccttccttccttccttccttccttccttccttccttccttttttttttttttttatttttggtcagtgtttcactcttgttgcccaggctggagtgcaatggcgcaatcttggcttaccacaacctccacctcctgagttcaagcaattctcctgcctcagcctcccgagtagctgggattacagacatgcgccaccacgtgcgtctaattttgtattttcagtagagacagggtttctctatgttggtcaggctgctctcggactcccgatctcaggtgatccgcccatctcagcctcccaaagtgctgggattacaggcgtgagccactgggcccggcctcccctttgcatttcactgctctatgtattctcttggtggtgatatgagttgaagggtgggagtaggggtggagagccctctctagactggagctatgagtgcataagtgaaatctcattatttccatctttaaaagaaggagtattggcgtgtggtgtttttagccagccctccctcctttcctctcatgcccatccacaggccattgactggaaggcacaacagctcccagcacagcccctcctcctgccgctggagaggtgttgggactggtgtgctggtttccaggtgcaggtcctccaggctgagccacagctctctgtagaagtaagcatgagacaggctgcttccataaatcaagccctgaattttattacagtgtttatgtaacctcagtttatgtgctataattctttgctgtgttgcctagagtaattcccaaagaggatgtttgttctttttccctggaaattttctagcataggccttttgttttgacattctccttccccccaccctctgccttttttgggatggcctggggatgggtatcactaacagtcaattgctttttactgagtaaataatataatccagcgtgtgttagattctgtttgtactagatgttattcctactcttaagtgggagaaaaaatctcaaattaatttttacattttcaagattatagggtggtagggttaatgtgtacttaattgatgagtaaatgaaatataagtgaaaacaaatgcctttgctatccatgggagacccgttccttttcatagcctccgccaccatcacagatctcatgttgatagagtcagattgaccgctgagagagaaaatacagactggaaattttgggtgatttagacttttaactgaagaaaatgtcagggtaagatgaccagattcaactgtattccatgtagacaactatgtcaagagagaaatgttttctggttggaaatgaagacaatttgacttaaccggagcatgtttttaaagaaacccatagcatgttttttttttttttaacttagctctttttttcgaaccttatgtttggccctacagagaaattaggtgatgagactggacctactgaaagtgttaccggacctattctgcttggacacgctagacttgtgaactgctgactggtatatttcagttagtacagttaatgttttatcatcactgccattagaaggtattacatagatgtgatctttttcattgtagtttaaagaagatagttaatcctggggcaaagtttatgaaggaagtgtgtgaacagagcaatctttttagatttactttaactacaaaactggatatttgttttaaagctgtgctgtttaggattgtagacactagccacatgcaactgttgcgcatttgaaatatgaccagttctaattgaggtgtgctgtaagtctagaatacacacttgattttggagcttgagtatgaaagcaagaatttataggtcctctttaatcatttaaattaattacacattgtaataattatattttagatacattgggttacataaactgtatcatcaaaattaattttatacctatttttaccttgcttttactttttaaaatgtgactcctagaaaaaccttaaaattgcaaatgtgactcacatttgcaactcacattattttattatattatattttattttattttatttattttcaagatggagtcttgctctgtcacccaggctagagtgcagtggtgcaatctcggctcactgcaacctctgcctcccaggttcaaacagttctcctgccccagcctcccgagtagctgggattacaggcgcatgccaccatgctcagctaattttctaccttttttttttttttttttttttaagtagagatagggtttcaccatgtttgccaggctggtatcaaactcctgacctcatgatccgcctgcctcggcctcccaaagagctggattacaggcatgagccactgcgcctggccttgcaactcacattattattggccagtgctgttttaaagttctgttgtccaatgaagggaataacagatgagtacactcagtaaaaccttcaaagttatacgtttaaaggaatattctatgcttcctgataaaatattaataaccaaaattagcaacaatatatagatgaaattattgcctcaagatttatgaggaaatattgactggaatactgtctattaaaatattcctctttacttgtcaagtctacctctcagtatcttaaaggaaagttctcatctaatagggtgtagaggttaagagcatgaactctaggttggaatcccagcttggttgtttactgtctgtataataggaagtaagttatttagcttccctgtgcatcagcttccctacatgtaaaatggatacaccttaatatcttcttcatattaaataaaacaaagtgtataaagcacatgctaggattcgcacatactacataagtactatgtaagtgctagctattatagtgatagatgttattgttcttatcttgttaaaatacgtacaactttttgatagattattcgaacctggactctattctcaagcaaatggaagctgttggctttcagtaattagtctgaattttgttgaaactcagaaacaactggcagtaattaaaaatgggaaagtaaatgagcaaagaagggagctcatttattggaacatatgatgagaacattccataaagtaaaacttgtagtaattgtcgattaaaccaattttctacctgatataaattcagtagtactatatttctttttatcatgtttctttgtcaccaggtatattggtctgcaattttgagtctttggaagttatttttgtgtttattatgctctgataaagagatgatgacctcttaatcttgtgtccaagagtggtggtgctatattgtcctagaattgtttgaattttagagcaatgtgtatgtgtgcatttaaacccaagtttaataagtcattccattgtgttcttaatagggctagataacctgagaaccagttggttttttattgtgccgaataaaatttgtaatctggtttagactctgtacagcactgtaggtataacaagtcttttatgcagttcgggggtgatctgtgatataagtttgttatggtggaattgatgtttgtgatgggatgtctagatgaaattaccccatggaatataatcttttttgagtagaggatggtatttaagaaatatgtcttcaaaactcttatacaggccagtactgcctctttagatgtaaaagtttataattttaattgcaggaccttcttttacttggcttttaaaagttattcacttagtcaaaatttattgaacacctatagtattccaggcagaatgctaaccctcacggagctcacaggggatacacactaagggatatatattgtagtacagcacagtgctgtattaaatagcaattgcagagacactttccctattttttatgtttttactgccactttgcctttataacatgaggtgattttagcatagagctgaaccaaatgttgggatattaaaaagctgaagcaaagttcataaagagcatgacttgggcttggactttgcattttacaaggtgtgcagtgtgagcttacagaggctttgacagcagggagtgagtggagcgttgggctttgttatttggagagatcactcttagtattggtattgggacatagatggtataataacaaggagagactgtaagaaactttgcagtatctaatcaagatatggggagaaacttacactaaagagtgtgtgctaggtgaagaagaggtaggattttaaggaaattctccaagttttaagtgcagaagtgtgggaggaaaaaatgtaagatgatgatggttctggcttgattttccagagtagagtagagtagccttcaagatttgatacaacgcttgacataggacatcttaaaggggagctcttagacttcaaggagaatatggtaaatattaagtacactattgggagcatgggtctgctgtatgggagagtgtcttggctagaggcttacttgaggtagtcatgatctaaaggtgatagctgaaggcatgggaggtagatggtataaaataataagcctctccactgtgcttctgggggatttccaaacaccttagcatgccttacaaggccctttagggtttttttctgtactttgttagtctcctttacaaaagttaatgctgttctctctcatgcaacatgcattcctcgtgtctccagctgtttgctgttctcctcacttcccgggctcttctgtatctccattacatcacacatgctgtttcctgtgtttgcaaggcatggctcctctttgtccccttaacaagctctggatttttctttaacacccagttcctgaacctccatggcccagctaatagctccatccttgaacccataagattttgtacatatttctattagtacttatatctcacttagagtaattatcacttgcctttcactcattctgtatagactgtgaactcctaaaggaaagagaagtaactttagtcatttttacatccccaacctcaaaatggcacttggcaaatagatgctcagagaatgtgttttgattgaattaattcatttgtgtgtgagctgcaggtgtcacattagtggcttttggatgtgtccagaagtatacctattatacgttgaaattttgcaaatcatcatatttgcaaaggttaaatgtaaacaggagaaaggtgagacctgaggtccttgtcaaaactgtttttcttactgtaatatcaatgtgtattgtttgtggaaaagttgattgataaataaaagaagaaaatttaaaatatccatagtctgaccacccagtgatatcttggcttaaattgtacgtacccaaaatagcaaaaataggatctatctgtgtatattgtccttgacttttttaaaaaacttactatctgtgcatcattaaatattagtaagtagtcatgttttgtggggttttcttttagtttgagatgaggctggtcttgaactcctgggttcaagcagtgttcctgtctcagcctccaggtagctgggactataggtacacaccaccaccatcctcagtagtcatttttgagtgggctagttaaatagacgacactcccatcatgcattatttaaccagttccttgctgttggacttataggctgacttataggctgtttcaaatttttaatttatatagtcacatttcaatgaacaatccagtagtgttgtcatattcatttttatttagaatacttcggtgaaaggaagtatatatcttactttttccaactctattagcaaatcatctcttggacatttttttttttggagacagaatctcactcttgcccaggctggagtgcagtggcatgatctcggctcactgcaacctccacttcccaggttcaagtgattctcctgcctcagcttcctaagtagctgagattacaggtacctgccaccacgcctggctaatttttgtgtttttagtagggacagagtttcactatgttggtcaggctggtctcaaactcctgacctgaagtgatcctcttgccttggcctcccaaagtgctgggattacaggcgcccagccagtctcttggaaaagtcttaacaatttttattatcaccaactgaattcttctcatcatatttttaggttttaaattgtctggaacttaaaaatatatgaagataggccagccacagtggttcatatctgtaatcccagcactttgagaggctgaggcaggaggatcacttgaagccaggaggttgagactagcctgggcagcatagcaagaccctgtgtctacaaaacccaacaaacgtgtgtgtttgtgtgtgtgtatgtgtgtaaaacatatatatgaagatatgatatatgaagatacattacgaagataattcaaatatatatatgaagatacataggaagataatttagcttgctgcaacagaaattccaaatttagggctaaagaaattatcaaactgaagcctttttgtaaatttaagtagttttgttgattttagaagtagacttttctggccaggcgcggtggctcatgcctctaatctcagcactttggaaggctgaggcaggcagatcacctaaggtcaggagttcaagaccatcctggccaacatggtgaaaccatgtctctactaaaaatacaaaaattagccaggagtggtggtgcgcacctgtagtcccagctactcaggaggctgaggcaggagaatcgcttgaatccatgaggtggaggttgcagtgagccgagatcgagccactgcaatccagcctggcgacagagcaagactctgtctcaaaaaaaaaaaaaaaaaaaaaaaattagacttttccaaataatggtcaaggtttttaagtatgagaaaggagtttcatggtcttggggatcagggtcctcttggcatggagtgggtggtgacgtgaaggtgagccctccagttccagctctgttattagccttcttgtgcctcttgtgtggctgtttcccagctccaacccaaagttttattaggataaagtcttggatttaggcatatggatattaaatatcagtagctgaatttggggtttgaaataattgctgcttacttctaacttccccatcccactccagattctttttgccatccctatctacattaaatagctaattgaagccaggcgcggtggctcatgcctgtaattccagcactttaggaggccaagacgaatggatcacctgaggccaggagtttgagaccagcctggccaatatggcgaaaccccacctctactaaaaatacaaaaattggctgggtgtggtggtgtgctcctgtagtcccagctacttgggaggctgagacaggagaatcacttgaacctgggaggcagaggtcgcagtgagctgagatcatgctactgcactccagcctgggcgacagagcgagactctgtctccatcaatcaatcaatcaattattattcataaaatgagaagaagctcctccgccttcccctgccaaggggatgagcaaatgtgtgttacagctcactttgaagagctgtccaggcttttgagtgaaatgcagaatttttacctcttgcttagtaatttgctcatttttcagactactttgcacagatttaatgattaaggaaacaggataggcaaaggtgccagcgtttgatattatcttaaggcctaaactgaccttacggtgatgaaatgaactttttgagtgcgtttgtctcctgaataaatctgtaacagttttcttaactgactccctctgtctctcagcatcagaaagaaatgagagaacattaagccacagaaagcaaataatggtcaaaataaagatactcttttgctggcaaacttaaaaattcacttgtggggctgagcgtgttggctcacacctgtaatccctgcagtttgggaggccgaggcaggtggatcacctgagttcaggagttccagaccaacctggccaacatgatgaaaccccttctctactaaaaataccaaaaaattacccaggcgtggtggtgggcacctgtaatcccagctactcaggaggctgaggcaggagaatcacttgaacccggaaggtgaaggttgcagtgagctgagatcacaccactgcacttcatcctgggcaacaagaacaaaactccatctaaaaaaaacagattcacttgtggaatctaatagctgtaggcaagggatatttattgaaaccaagatttaagtgtggtttatgatgtttatggagtagtttaatactacttttcttcaaaatgagtttttaatttaggaaaaagaattcagatatgttcccagagtagagatgactgaccatcatgggagtggttagggtttggggtttgtgtgggtaagattctgtttacccactacagccattgtgtggatttaaaagctttcctggatggaatttatggagtgaaatttgaaactagtgtcctgtgtactacaatatatggtcacaacaagcaatcaatttagaaagaaatggaacggagaagatacaggttaaatgatgagtattgtgcagtgcagcaagacatagagtgatcttaacagtaatgtggtatgtcaccatctgagttctgttataaagctcctaggcaatgactaaatcctagaaatcattgcctactttcagtggcagacagagtataatccattcatgatagggggttccaggtacattgatatagaagactggccaagggggaatgacaggggttacagctaacatttcctaggtaattggttctaatttccaggctccaagcaagatactgtatctcttttaccctgtttaatcctccccagcacccagtgaggtacagatggtattgtatccattttagaattgagatgactgaagcttagagagattttcccagtcatatatattcacggttcctggatacagctgtacaggttgttcactgcatgaaggtggctggctgaggtagcaggcaaaggatttgtttgctcagcagaggcagcattttctaatttgcactaaaacctgtgtaggccaactgtagccctactcataaagttggttaatgcctgaactgggagtagaggtgaggcagtgttgaagtggataggtagattctgagaagcttatactatacctactgaagtcctaatctgtaggctgtctgcaaactggtttgttttgctaccatcctatcccagcatttcctcaaagatcccacagtgacttctttattgtggatctgatggtctttggcagctatacagacattcttagagtcacagccaggattaaagtctaggatgcttgtcttcaagtcatgcatgctttctgtatgagataatatacaaaaagatggtcaagaaaagtgattttgagataaatagtggcctagaatagctagactgagattgttcaagcacagctattaatttgcttacttgctcagcactcaggctgtgctatttgcttcaagggatataaagattgctgctttctagaaaattataactcaattagggaaaccaaatcaatatatatttcataatataaaataagagaaattacagataacaataaataatagccaaaatacctttcttaactaggcatgtctatgtttctttaccttgctttagtgctcttagatgtcccattccagcctttgagttggagtggggaaggtgttccttattaaagaagcatctactacaaaaaatctaaaaccagatctgaggcccatactagacccttctattagtggtaattttaaaaaagaattttccatctaaatttaatagctttcttctgtagctaccctaccctatccctgggccaggcaccaaagtgaataataatgtgctataaaatccaaaccaaaatagtacatcttctttggcatttgaaatttcagtgttttttgcgtgtagctacaaatgtcttccattgtggcaaccactgttttgggtggttttttttttttggagacaggatctcactctgtttcccaggctggagtgaagtgatgagatcatggctcactgaagccttgccctccagggctaaagtaatccttccacctcatcctcttgaacaacttggactacaggcatgcaccaccacagtcagctagtttattatttttatttttgtaaagacagggtctctactatgttgcccaggctggtctcgaactgggctcaagaggtcctcctgtcttggcctcccaaagtgctgtgggattactggtgtgagtgaaccaccacagtcagttttggggttcttttgaataatcagaagctgaaatcagaagccaaaaatagcaaaatgggaattctgtgtgcttttgtgatatgattatatttgtgttcccagcctccaaagaaagcaaatgtaatttatatggtactcaataaactatggcagtcaagaaaaccaaaagaaaaacctttttccacttggcactgtccaatagagctttctgtgctgatgaaaatgtcttctatgtgcactattcaattcggtagctactagccacatatgcatttgatatgtggctagtgtgatcctaaggaactgaattttgagttttactttcataaatttaaatttgcatagccatgtgtagccagtggctaccatactgggtagcacaggcatgccacatgctgtttctctcttaagttggcacctttaatttctgttttaaaattcatgtctcctttacttgtccccttctatcttctctttctcactcactcccttcctttttctctttgctttttatttctccttgcttctttgctttcctgttttttctcaaccttctgtgatactactaggctgaccgtaaccccattaattataattatttattatggtctttcacctagttagacttgcctgcctgtgttctccttctgtccccaaagatgggggcattcgcggatatgcagtgtttaccaaaagctcctgatatactggttacttaataaaaacaaacaaaaaaataaatgggatttttctgacaagatggttttggtgaacctatgctgattcctgagatcacggcttctttttctaaatacacaaaaaaactgctttggtaaatcattctagaattttgcacagaatgaatcaaaatcagtggtattacataatcctaggctccatagttctgatttccagaactattgactaatagtaatcaaaacactggaatacttcactggaagacttctctgtccttacttttcagtagggggtttaatctaactcctctccagtctttcttctagaggaactctgtaattccaatctcactattttggtcttcccttctcctcctccttatctcttccccctttctgcttttccttctcctccttctcctgatataacttacttcctttctgagaatgccacttgtctctttctaactttaggtacttttgcctacttctttccttctactttaattcacatagaagtaccgtgagactatgtaaacacatctactttaagttaaacatttcctctattcagagtcatgcctttttatatttaaaaaaaaattctaggctgggcacggtggctcacttctgtaatgccagcactttgggaggccgaggcgggtggatcacctgaggttgggagtgcaacaccagcctgacaaacatggagaaacctcatctctactaaaaatacaaaattagctggacgtggtggcacatgcctgtaatcccagctacgtgggaggctgaggcaggagaagcgcttgaacccaggaggcggaggttgtggtgagccaagattgtgtcattgcattccagcctggacaacaagagcaaaactccatctcaaaaaaaaaaattctatatttgatttcaagcctcaaataacttaagtaataatgactacccatctgtaagagtccttgctttgtgatactgttacactctgttgtattgagaatgctctaagtcatatgttaccaacatgctgtggacctttagcttttcccagtttccagacagaagcagtggtcagtcacttaactgcactagacagaaaagcagtttttcccttctgaaggttaaacaggtttttacaccactggagatttttaaggtgggtatgggtattaaggtgggtattgttagtcttttccctctaagtttccccaatgtccaaagaattaacaaaattttaagggttctgatttatatggtaacacagtctgttagtcagatgtaccaagtttcttcctatctaattttttttatttttattttttttgaaatggagtcttgctcttggtcaggcaggtctcgaactcctgacctcgtgatccacccacctcagcctgccaaactgctgagattataggcgtgagccaccatgcccggccttttttattgttatttttttcagagacagtgtcttgctctgtcgcccaggctggagtgcagtggcgtcatcttggctcactgcaacctccacctcccgggttctagcgattctcctgcctcagcctcccgagtagctgggattacaggcgtgcaccaccgtgcccggctaatttttgtatttttagtagagacggggtttcatgttagccaggctggtctcgaactccggacctcaggcaatccatcctcctcatcttcccaaagtgctcaggatacaggcgcccagctcttgccatcttagagtctttgcaatttttacttttatagcctaaagtggcgctttgcatgcctagatgtatcttcagcctttatactttaatcattctgaggggggttttctgtgtccctccttcatcaccttcaccctgtttactccctccatatcattcattcctcaatacttatttccatgtttccctgtctccaccactgggatgtaaggatttcttatcacttgttctgtgcagttaatctcagtgctcgggctcacagctgggagctgataagtgctcaatgaattcaagtgtttagaagaatgttagtgcagagtagagattgggcaggcagtgttagtaggttagtaattattactagaaccaggtagagtttctacaacctgcattgaggccctgagcatgaagaatggagtgttaaaatgagcctttcaaaggcaggattggcaactgtgtgaggtgacaccactagagacatggtttggacagcgcttccgaagatggaataccagataaagatcagtgtggatggtggagtccttaactgattcagtttaagatatttgattttgatgcatttgggaatagggtgctcttgctgagaataggggttagggctcaatttacaaacctttctgttcctacattctaggttcctatgattataatgattcttgctgataatattttctcccagcattatttcttatatataatacgtgactataaaggctcgttcctgtttcaaatgcctttgcacatgcatgatttggatttttttccagccaggtctcaggggccatgtttttaaagtctgctgctctttgggctgatattgtggcttcttgaatcgcatacaaagcaggtttcttgaaatctgctcatctaccatagtttaccagttatctgtatccttgcggctctgcttgaactgaagcttaatcttgttctttgtagggcccagctatttttgcttgtcattctatcacatgccgtttaccaggaaacattcaaataatgattaatgatgccaaaactttaaacatggaggaagctggtaataccagctccgctgtggagattttcaggagcatcaatgccggctgaccggactggtatttgagtctcggataatggagtagtaggtctcaaaaagttacacttttctgggtaattgtcagcttcccagagtactgttaaattctgtccctcaaaaatgatgaaattgcaaaggaatggtcactgttacaggtattctatcttcattatctgatttaatcctcaaaaaaataattgatgtggaataagttttttcattcccattttaatgctagaaaattgaagcacaaaatctacccaccaaattgtggactgtgttttctgtatctcttatcaaagctctccagggtccctagaccctctgttgtccctctgttctagcctttcagattggcttctttcacttagttattatacataaaatgccatgttataaaatgcctcagtcaggataatggggaaagtgttcttgggagacagtgcacataaagaccttacagtgctgggtgctcaaaatgttaccatcacttttattgttagcctcttccctcttaagtttccccagtgtttaggaaattagcaaaactttaagggttctcatggtaagacagtgatacgactattatgtatatggtaagggggtgatatatctatcatggtaagtaacaggacattgaaaagacagtcatgggaataaagctaagtaaacacatgtttcattggaatagcttctattagtgacaatacctcctatattttggactaattcccagatgaaagattttgctgaaactaggcattaatgaaactaagccattcagtacagtgtgattttctttttttatcttgtgatttgagaagtatattctaaaaacccagtaattcagccaggctggacattcagttaaatatcagtggagccagctgtgtaaggacttattggctttgtcctatacatgtggtatgtctggagttttggaaacaattcatggcctccttttatcggttgagtagcattgaggcctcataaaaaatagtaacttgattctaaggtaaatttccctggaaagtatgaaatgggaaagttaggtttccatgtacccccccgctacgcatagcattatttcaattccaagaggcatttgtagtcaatttctatgatgattggaaaggagcttaaaaaattcttacaatctctttaaaaacttttgaagcagaggagaaaaaattggtaatttgtttttcaggaagaaacatacctggatttatctattgctacatgtaggttttttttttttttaactaactagaatcacagcatctttttctttttaaactaacttgaatcacaaaatcttatgtcatacttcatgtctttccttattaaggataattagtttatggaggattcagttatgatggtgatattattagagacttatctgaatgaaatcagaaaagtgtatcccgttttatgtagaagatttttacataaaatatttacacacacacatacacttcattttttagagcagttttaggtttaacagcaaaactgagcaaaaagtgcagaatcctccctacccccaccatacccctcaccctagcatccctgactataagcttcaagactgcaccagtatggtacagttgctacagttgattaactggtattggcaaaacataatcacccatcttacatagtttacattagagttaacttttggatttgtacattctgtgagctttcacaaatataaaacggcatgtactcaccattatggtatcacacaaaatagtttcattgccctaaaaatcctttgtgctctacctattcatccccctaccaaaaccctgatctttttactttttccatagtttcgccttcgcaagaatgtcatacagttggaatcatactatatatatgtagcctttcagattggcttctttcacttagttattatacatttaaggtcctccgtgtcttttaatggcttaatagctcatttcttcttagcactgagtagtacattgcctggatgttccacagtttatttttccattcacctaatcttggttgcttccaagttttgtcaattatgggaaaaagctactgtaaacatttatgcgcagatttctgtgtggagatcttaacattcacattggttactttttttaaatttcagatttatcaatattacagagctattgcaagagtcatatgagaatcgaggatctggaaattctgtatgaaagaggtgccatctgagtagggccttaaaggatgcgctgatttggacacatagattggaggaggtacatcgtactgtggctggcacagtatgtgattttctgtttgattggagttcatggtaaatgtaggaacacggtgttatgttttcgatgccttcgatgctaggctaaagaagataggcttccttagtgaggccataggaacccatggcagatttttgaggtaggaagtgataagtaatgtcactcatttatttaagcagctagtcaagctcgcttagttccaaatagctgcttgaccttgcctagttccaaataattgacttaaaattaacaagttgacatttattaaacagtactttttacagtttaattgttcaccactttagactaaattttttctacaggtggtgcaagttaattagattttcttataatgagaaagaaaagcatttcagtacagtgtcttctgttctgatattcaaggtcatttcctatataaaagtaaaattctacacagcataaaaccatcctttttgacatttagggaccataggttttaataacattgaacaaagggttaaattttttaaaaagtttttgtacactctttctttggtatgcttcatctctttcatttgagctgaacagctttaaatttcacttaaagaaatgctagataaagagaagaacattgtataagggcaactaagtgaacaggaagctgtgcttctcagaatggggagattttaaaatagaggagaaagctgtcaaagcaaaagtatagcagcctcagctttacttgggaatttattagaaatgcagattgttagactctaccccagaagtcctgtgggcggggctggcaatctgtgttgtaagcgagaaagactaatctaaaccactgatcaagggagggggatgttaagacttactgcagaaaagaggtgagaaattgtactaacagttactgttaattcaacacttactttgtaatgcacattttacagatacagcttatgtaatcttttatgtcaaccctaggaagtataatattacaatatcttactatatagatgagcagaaaagaatggtttaagaagtagcattgcaaaacttccggcatggaaggtgtctttgactctatactctgacctctttaaatcgtgctaggccatgcaggtatgttgtttgtctcccagaaggcagcggtggggctaaggcagcacccacctctctgctccctctgctgcattccccagcctccctgactgaggtaggtatttcttccttcctgcatccaggtggagcctgcctggtccagtgaaggaagcagaacaggaatggcaggaaaccagctttttctgtttctctggagttctcttaacaaaccctgtgaccctaggcctgtctcttggtatctctatgccttatttattttcagcggtaaaatgaggactgggataaatctgtaggttctttctgaattttatctggctctagcacttaattagagacagatggtcaaactaggtgacctctcaagggttcattctggttcgtgttgagaggagtttgatattggaaataatagattcttgtttatgtgcgaaatggagacagtactttctggaaatggtgtgatgcaaagtgaaatcatgtctgtgaagtccctagtagcctgcctggcatacatggaaggtgctcagtaaatggtagttcctcagtccccaagaggaaaacagccgcattcctgattctggtgttttctttccttaagttttaacaggttagtattttaattttcctctcaaggagggaataagaggtgctaggtttgtattaaaatattaagttaattaaagcttcctattaaaattttaagagagaggaagagaatggggcaacatgaccacaataaataaagcaaataggtcattatgtttccaaatggcattatcccttgactgttggtagctttcctaataataataggttgaaaaaatgttactgtaacataaataataaaagatacttatggtagtactctgctaagtactatatagacatgagatacttaataacttttaatatcatggtttggcaaaagaaacttcacaatggattaactatttatttggtgaacttaacttggggcaggcttgtgggtggaatttaagggttatttcttcttttttttttttttgctcccccggagacggagtttcactcttgttgcccaggctggactgcaatggcgtgatctcaggtcactggaacctctgcctcccgggttcaagcaattctcccacctcagcctcccgagtagctgagattacaggctcccgccaccatgcccagctaatttttcttattttagtagagatgggattttgccatgttagccaggctggtctcaaactcctgacctcaggtgatccacccacctcggcctcccaaagcgctgggattacaggcgtgagccactgtgcccagccgagttgtttcttccctaatttctctcacaaaccttccttttatatagagaaaacatttttacttttcatttgaaatattcttattgttgtttttttctgatcattactgatgtaccttctatagaaataagacacatatttggcagggcacagtggctcatgcctgtaatcccagcactttgggaggccaaggagggcggatcacgaggtcaagagatcaagaacatcctggccaaccaacgtgatgaaaccctgtctctactaaaaatacaaaaattatctggacatcgtggcacacgcctgtagtcccagctactcaggaggctgaggcaggagaatcgcttgaacccaggaggcagaggttgcagtgagccaagatcacgccactgcactccagcccaggtgacagagcgagactccgtctcaaaaaaaaaaaaaaaggaagaaataagacacatatttatcccaacgtacattgtttttcacaagttgcaatttgatatccttagctagtttcatcattctaccgtgacatttatccccattatgacatttctaaattatagtgcttctctctcatgttacgcatgtttctaagctcttggttggaatctgtaaaatagctagttgttaacatttaataaaatttagacttacctcaccttactctgttagcaaagagttacatgaactctgttgttttgaattaagaggtcagttgtggcagtaaacctgggtagaatttggaaaggaactaggctacttcctttttgattcttccttattaggtcatttgtcaagtggatacattatcttctttccctgagggcaggagaccatcttagttcccttctgttaaagagatctatgattcattacttccagtgtgaaggccaggtgcttttgcatgagttgtaaactgctaagcgagcccttttgtgccttgtttgtgtatgagagtctttctcttcagagtgtagggcaacctgtccccaaccagtcccctttcccaacatccccacccacagtgtgatggatgctggcagtcataccacattcaacatttccaagtgggacttgtttttattggatatgatcaccaaaaaaatttgaatttagatgagaaacaaatcaaggggtggttattcacattgccgatgggttttgggttttgtttttttttttttccttcaaaatggttcagcctaggggttctttaaatagcaagttgctctgctagatttaaatgggatttgatatataaaaatccatttacacatttaacaggatgttatgttggtataccagaatgatgaagagcaaaattctggagtcttaaacccaagcaagtttagaatcccagctttctcgtatcctggcttgtgtgatcatgggcgagttatttaacttctctcagcctcggttttctcactggtaaaccagagatcatagcacctcatagatagcacttctggagtgttttgaatggcagaaacagaaagtgtcgtgtaagacaacacatgcattgtgtaaggaaagtcttagatgtctaacacagcagtggcagtgttcattttcagggccattttgcctgagtttttgttaggcccttctctcttttcttctttgaatgtatttgtaaacttgaaaagaacaccgcgaaaagagctcaggatcctgctcagccacacttcacctgctctccagcttggcatgattgattgtcaggaaggcataaagaactcaaaccatgaattaccctactcggggtaatcacaatggtttggatggcatctccttaatttttgctttgacttttctttcctccgggcaagagagagtagaaggagtggcaagagtatgccttttagttactgagttctaaattcttggaatgagcatagtctgttttctcaggatcagactagaaggcgtcattctattacagaagagccaagacttgtcccaaatggatgtgggtttcagcaaagcatctttagcttaaggagcgaaggatttggactgtgttcagcatctgtgcttcgcaggccactctttatccttttagtgagtcccgcttgtctgtcctctgtcaagggctcgtgtacaccatgctgatttagtgctaactggggagattacaaatgccttgcctggcactgtcagctaaacctgaatcattgtctgtgtactgtgacccgactagtcagaggtttaccctttgctttgctgctcactcttataggcagaaaagcccagctcaccccagcttttataacggggtcagctccagaaatagcacctttaactgggaatagaagcaacacaaatccagcaagtagatagtatacaatggctgctttttggccttggaacaaacaaaagtggtttatgtttactacataccacttccaaaactgctgtctgtcatttactagagagtttatcattcctgagggccaaggtctaggttttcttcacacaaatgccctccaagtgggagctgcttggtgttggtcattgtttgcacccagatttataatttggggttaattagacataaagacttaaaggcaaatgtggtacctgatggaccatgggtagataagacacctcccaaaatggatggtgaaattctttttaagagtcatagtatggagaaagtccccttgtgaagctttgtgttggagcctagaattgtaatgtatggcactattagacttccaaaaccaatgtgaacttcagtcgtttgtatcatgatttgctttatcctatgttcctatctttcccggtagtaggtattactttgtctgtgggttacatgtctttctcctctaagatttaacctggggattattacatgcatatttatatgcccagagacaatagtaggcgctcatcaattgttgaataaatgaatgaatgaatgaccaaatgattgaacaaacaaaggagcaagtgaacaaacagagatgtgaagtggtggggggcatttctatatgattgtgtgtaaagagcaccctaacacagcatctgaacaaatcactcttggaaatctgttcaatcccaccaccttcactagctattcctgtgaaccccaaccctcccctagatacattttggtgatatattagattattttttctttgcctccctcctaccatgataaaaaggatattgaatggccaaaccagtgcattacagtaacatgaaagaaatgtttatctttcatctaccagaattcaaggaaaaaaaccacaaaactttgtcagctagatactttcctgaattgttttttaaaattgtttaaaaaattattattattgccaggcacggtggctaacacctgtaatcccagcactttgggaggctgaggcaggtggatcacctgaggtcaggagttcaagaccagcccgagtaacatggtgaaaccccatccctactgaaaatacaaaaaatttagctgggtgtggtggcaccatgcctgtaataccagctactcaggaggctgaggcaggagaattgcttgaacccgagaggcggaggttatggtgagccgagatggtgccactgcactccagtctgagcaaccagagtgaaactccatctcaaaaaaatatatatatattattatttttaatagggtcccaccctgtcacccagtctagaatgcagtggcacaattatagcctacagcagcctgaaattcttggtctcagggaatcctcccacctcagcctcttgggtagctaggactgcaggtgtatgctaccatgcacagctatttaataacagttttttttagagagggagcgttgctttgttgttcagactggtctcaaattcccggcttcatgcgattcccctgcctcagcctccttctcaggtagctggtattgtatgaattgtgttttgaataagaagaaattaaggcttataagatcagttgtgtgttagcagcgatgttgctgactgatctttgcaatctgtaggactatttggtgctacaataataagaaattaatcagtttgataattttgccatcatttttaaaaaattttgtaaaataattgaaaatcatatgtgcaatatcttataaatttttattttcaaagcacattcctatatggcaattgaagtacagtttgaacttacttttgactaccttcttaatagtgattgatcataaattataaaattttcacttaccaaattatgtttaaaaagctaaatttaacattttctttttaattttggagttgaatggtcctttattccagtctttgtttttgtttttttccaagggaagacaaatatttaagttcaaagtcatgtttaatagaggaaatgaatgaaaagtggatgtctgttatctgtttgcaacaatcatctttatgtcctagtaaaagtttaattttaaaatctaactttacagatctatacccagtaaatttttttttttttttttttcaaacagagtcttgctctgtcacccaggctggagtgcaatggcgctgtgtcggctcactgcactccgtctcccgggttcaagcgattcttctgcttcagccctcctgaatagctggtactacaggtgcatgccaccacacccagctaatttttgtatttttagtagagacagggtttcactatgttggccaggctggtcttgaactcctgacctcaggtgatctgcctacctcagcctcccaaagtgctggggttacaggcatgagccgccactcctggcccccagtaaataattttaagaatcttaaagttactcatttttacttagactttatgagattaagctattttcaaactcacttctatttgtcctcccctgagagctatttacaaatttgtatagcactctggagtgtgataatatcgaagtcaatgcacagtcaggaggcttgttaacttatgtgatgatgtcagttttgataaacatctttctcatttaggcatttaatgataatcatttcttcaagaaaaagttcttagtggggaaaaagaggcgaaaagtacagtgtgattaacttatgatgcattttggattacagccttttaaccaaaagagaatcatcattaaaacaataattcctcagaaggcttgaggcatttaacttctcttaattaaattagctcagtttactgccagtcaataaagtctggtttggaatgatgatagaaattaaatatctaagaatgcagtatacataatagttaaagaaatgcaattaaaagtaataaggaggtactacttttcacttaggaaattaataatgatttatagaagtgagactactaacttctgggaaaaatatagtgagactgtcacttttatacaccactagaaagcccttttataatgtttgtcaagattcttcaaaatactaatagcttttgatccattaattctttgtctaggacatgctgagttggtgatcagatgtgaagaaaacttcaggccaggcttggtggctcacgcctgtaatcccagcactttggtagttcaaggtgggagcatcgcttgagcaaaggagttcaagaccagtctgggcaacatagagagatcccatctctacaaataatttaagaaatgaaattagctgggagtggtggcacatgcctgtggtcccagcttacttgcaggactaaggcaggaggatcacctgagcctgggagattgaggctaaagtgagcccgtgatcacaccactgctccccagcccaggtgacagagtgagcacctgtctaaaaaaaaaaaaaacctggaaaaagaaaaacttcatacagccaaaatacccaacatcatgcaaatgcatggttgatttatgttattttctattttggaatattatgcagaggttaaataataagtgcacataatatttactacaaggcagaatatttgctatatcttaattttactaaaaagtgtaacatataataatatttgaattatgtatggaaaaagagagtgagaacaagaatgaattgaaaacagaaagaaaatgcacccagatgtttacagtcagtgattatgttctgactggcaaaacataagtagattttttttttcttttttttttttttgagagagatggagtcttgcttgtggcccaggctggagtgcagtggcgccatctcagctgactgcaagctccccatcccaggttcacaccattctcctgcctcagcctcctgagtagctgagactacaggcacctgccaccccacccggctaatttttttttttttgtatttttagtggaaacggagtttaaccgtgttagccaggatggtcttgatctcctgacttcgtgatctgcccgccttggcctcccaaagtgctgagattacaggcgtgagccactgtgcccggccataagtagatttattttctaaaataagtgcatattacacttatgataaaaattatcatcatgaaagattttatgttcaaggatttcatatagctgctttgtatttcttctggcacattacagtcatagtggcagtgacttgtagggacattgtcctgatacttcgagtgcaattgatgatatttgtttaatagtgaatgtagcttaagaaaagaaaagcaatcaaacaacaaggtgattaatgtagccacttcaactcctcagatctttggctgacatgttttcctagcaaagcagaggtacttaactaaccacagagaaatgctcacacatgtcagaaggaaatccaagtgatcacttgttttgccttgggcatctgcactttttatataagtatgactttcagtctgtgagacctttcgataagtagtgataatccagaaggattgatgtagtgattctggacttgagatttcttttcaccactaagacatttgactgtcacttgcatcttaatgcgtccatataattttctaaagcattgggggactgactaggtaaagtcactgtggccttttaagtatgtggccagctgatctcatggcctaccagggcttccaagtgattagtggggattggcaagaattgacctctttggagcctggggaggcagaagtacctcagtaatagggttcagggagaccatacatggagcatagctctctctgactttcaagtggatagagctagtaggcctctactcattgtggtgtttgtgatcagacaacccttgctttggaatcactcttcgttgagagatactgagtccaggatgtgccaagcaagattgtagatactctcacagatgaattcacccattcatttattgagcacttgattttttaggagtacaacttcatcattaatttcctagctgtgtcatacaggatcagttaggttagattctccctttgtaattaatcctaattgctgggactttcatgtttctaataaatgtctattcccataatcctgtcctacattagctttcttcatgttgttctgtgagatctatagtaagcagatgacactgcttattatagattagctacttcctgtgtaataaatcaattattcctctcaatagggacaatcttgaattaaaatcacatttttttcttagagaattctctgtcaaattctatcaaaggccatggttttttttgtttttttttttttcctgtccagagacaccttattaatgacttgattttatccttatttcaaattctaattcatgaatatcagggtataaaatattaaatatgctggttcagctaccagcttttcaagcatcattggggaacatcctgttatataataggaaaacatttggtatggcttttgggatgtagatcatttttataattattatagggagtaaaaaatgcagaataaaaaataatttaaatataattagaagtgagagcaggtcagtatgaccaagaatataaatcataaatctctctatttttgtgttcctttatttcatgcagagaaataccaaacctttgtttctaaaagggcaccaggtctttcagaaagctgtggttctcagcagcaattttagttaggtttcgtttcatgttttctggtattctgggcctcccaatagccatttgtgcctaaaagagagagaggatgaggagatttgggttgcttgtactgccagcctggtggcactctggggatattagatgtgttctgaggatatatgtgtttatttaaatttaaacagaaagtatttcaatggatgctgggcgcagtggcctgtagtcccagcactttgggaggctgagttgggtagatgacctgaggtcaagagtttgagaccaacctggccaacatggcaaaaccccgtctcttaaaaaaaaaaaaaaaaaaaaattagccaggtgtggtggtgcatgcctgtaattccagctgctctggaggctgaggcaggagaatcgcttgaacccgggaggcggagtttgcagtgagcagagattgcgccactgcacttcagcctgggcgataagcaagactgtgtctcaaaagaggctaggcgcagtggcttacgcctataatcccagcactttgggaggctgaggagggtggatcatgaggtcaagagatcgagaccatccatggctaacacggtgaaaccccgtctctactaaaaatacaaaaaattagccgagcatggttgtggtggcacacacctgtagtcccagctactcgggaggctgaggcaggagaatcgcttgaacctgggaggtggaggttgcggtgagccgcgatcaagatcatgccactgcgctctagcccgggcgacacagggagactccatctgaaaaaaaaaaaaaaaagaaagggagagagggagggagggaggatttcaatgggacagaaattcaccaggtacattagaaagccttaacacttgagaatgtgaagtcttaaaaaaaatttttttaatagtttgggttacttaaaatgaaatactgtactgaagcagatagaaggactcttaggacctttctgtgtttcttctgtacctaatggcatataataaattcactgttttgtttaaatgatcagttgacttgagctttctgtcatctgctcagaaacactactttaggaatcttattccatttgggaattctgactagaagctctcccagggtcatcatatgaatgagtaacttacttcgcagctctcctcttcctcagtagctgcttctctgtagggctggagggaaagagagtcttccatgcagtctcatcagccaagaggaaggagatgctggtacctggtctgcatcccaacagacagcacaccctcatgccttccccttgaatgtacctttttggctcttcctcattcctggggaaatgtaatagttcttgattgttcacagtgttgactgctccctacaatgtgaggttccccctctcctctcccacagatggcacagagaaagtgcttatcatcgacacagtagtggggaaaaaaatggattctcattttagcaggtgacttgagggtggttggttgtcagtgtgctttttttcatattggcttgttgctacagggtctgatgctggcagattacaactttgtagctagtcattttcgatttatttgaacctatttctccagtctactgagctttcactggctagcatcaattcagacacattgcaattcttcagaatctctatccccatcagatggttcgatctatgagaaatttagctagaggcgtttagacaaaaaagaaatattgtggctggggaagcatttaagttagaggaggcagccagggctgttttattacttagtcctgtgtcacctgtgatgacccatgagagtggagaatattgatcgcttgtcactcaaggcattcagcagattgcattgacaaagcttggcaggtctctaatagcagggttactggccttgctgcggcccaagggaaaactctgcaggccctattacttggcggcctttaactcttatagaattgggagagaacactgacaaaagcgaggacatgattttacggttacaaatgatttttcttgcttgctttcttctcaccctttttaatttttcttttcttcttttcctgtctatcttaccttccctccgtgatccctgccagcccctcctttcttattatagctgatcatggcagtattgtttttttctgggtaaaaatcagagtggattagagaaagcttagcaggcctagcatgaggcctgagttattctctccttttaggacagcttgtgcctgaccacattgtttggaatgtgcctgtggatatatatacagtacttgaacttgatgtgtaggccattcacagctgttgtcctctagtagaataagaactgccacttcatgacagatgggtttctctcgttttccatttcctggtagccaggcttggttcaagcctttgaccttacatagtcccgaggttcagctgaaagtaatgtgctgacatcagagagataatggcactagtgcaaaacaggaatgattctaaaaaaacagtagagaggattctatctttcctagacactgcctgatttatgcacaggttcgaatcaccaccattaatgacattttcattcctaacataggttggcctcctgttggacactgttgtgtaatgagcgtttctgcatggctgtcatttgctttatgaagcattctttttatttctattttctgtgtacctttcatttaaaaaaatatcgtgtttgttatctccattgtctctttgaggatgagaaagacaaatatcattacccccatttcaaagaagagtaagttctaatcacaagtgatttaaatgttagagtttcattcaatattttcactaaaatttctagtcctctagtaaatcagatataagcaaagatcatatgtctatttcagcctctaggtaggctggccagctttcttgctttctccctctcccctcccctcccctcccttcccctcccctctcctcccctcccttcccctcccctctcctcccctcctttctcctctccttttttttttctgtagtcttgtactggtcaccccttcacttcctcttcctttgcaatgctttaggctgcccaaaaggttctagccagatgaacagaaacagaggagaggagagcttcttaagaggctggtaggccaggtgcaatggctcatgcctgtaatcccagcactttgggaagccgaggtgggcagatcacctgaggtcaggagttcgagaccagcctgaccaacatggtgaaaccccgtctctactaaaaatacaggaattagctgggcatgatggcgcacacctgtaatcccagctactcggggggctgtggcaggagaattacttgaacccaggaggtggaggctgcagtgagctgagatcacaccactgcactccagcctgggtgacaaagtgagacctcatctcaaaaaaaaaaaaaaaaaaatgggatgggtcagccttgagtagtggacatggcctttgcatttatattccaacattttgccacagatgagttatgtattattggcagattacttaatctctctgagcctttgtttctccatttatcgaatggaaggtaatattgtttaccaaaaaaagtgaattatgtggtatatggattatttctcaataaaaaatatgagttgtgtaaagtttctaacatagaaatgccctcctttgcttccttcctccttatacaactaagggcccacaaaggcagaatgagaattaccatctaggccaatactggggaaatatgtgctactactggagacagaaatgtggaagtattgcaaacgaatgtggacctattaatattctatagcactttgagccactttgaattaaaatacttatctgtgaaaggttttataatttatatgacctgaaataatttacacctaattagattttgtcaactgaataattctgtctcatgttgcttccacagaataatttaagcaactgcattttattctcaaaatagctgtaaatgtcaaattaattttgttgacatgatcaacatgtagaagagctacttggcagaattgtttgtcaactgaatgtattatgcatctttacaaaatatgtagattgattatggtttagctgacttttgcagtttgttggtctcctggaaagaagtaacgggtggtggttacaaaaaccgttatggcatttctgttcatctggctagaaacttttcgatatctgtaagttttccttcacttttcattatatagaccatgtctttcccttgggtgttatcttttttgtctgggtgagactggatcccacgtaactgctttggtgtttgttatactcctcattaattttatggggctcttagttgacactggccacataaaaatgattgttgagtctcactctttttattttggaccatttctttcatgtgggagcctctttatccctctccttaaaaaccctgtttaaggattagtgtccttgcagtttagttgtagcttactcaagttatcccatttattccaaaatcccttttccactccattataccctgtctagtccggtcttctagctactaagattgaagtcctgtcatcttcaggtttggttgaatccagtgcttcccaaccctgtctcatcatggcacatgtagaaaatgatattattgtacagcacacggaagtaaatcaagaccttttgctgtggaggtacctggctcagaggccatgacctgccttaagtaggagggaatacatgcatactatcctgtatgttttggtgtaaccaatccccaaatttgaaccaatcttggcaggtattagaaatttgcttatttggtgacatctggaatttacctcctcttttgagctcagtatttcatgtactttaaggtcattactgagctttctaccaaatcattcccatttgtgtctagtcattagataattcagatttctaccttggatgccttgaagtgatgacaccttacccttgctcatctctctcccaagggaataaacctgtattttgctttcagcttctgcttagaggagctggctccatccagaacaattcccctcccactggacatcaaaagattgcatttccattggcaacaagtctcaacatagctcagaaactactgttgactacttgtctcccctataacaatattggatccattggagagtgaatcagtgtctccctcaagttcagcccactcatttagatttttcattttagactccgtgggaaggatgtcccagtgcagagttggcctctgtacccctgattatgtttcagctttctctaatttctctgctaacctgctgttgatgcccctaaaggcactcaatattgagtgtgctttataaatacatgaactacatgtattttatgaaaacataaactacaaatacgttaaaatatactgtagattcattactaaaaggcattatctattcagtatccttaatgtacaaataataaaagagatatgaaaccctgtgtctagagctaaaaatataccttgacagtacaaatacacatggctaaaaggcattatctttttagtatcttcaatgtacaaataatcaaaaggtctgaatacttctgattttcataatggagaaggggaattgtagaaactgtagaccaattagcttgatgtcagctcagaaaagattctagaaaatattattaatgaatgctttctgagagtttaataaaagaagtagtcatcactgggaacctgtggaggttcacttaaaatgttatgccatctatattccttcttctgcagcagagattgccaaactttttctatacatagccagatagtaaatattttaggttttttgggccatacagtctctggtacagctactcaactctgccactgtagcaggaaagcagccacataggcagtatgtaaacagatggatgtggatgtgttctaataaaataacttaatttataaaaacaggcagcaggctgatttggccaattggccatcgtttaccaacccctgctttagaagaatatcttagataatgtgtacctgatatattctattcttctttctgatgggaaatactttctctttttttggcgtaaagacgttttattttctttgctaataaagagttggcataaaaaaaagcatcgcattaaaatcttcataaaggacatggaaaaggctcaagttaataatagtttacagtaagttctcacttaatgttgtcagtcatttcttggacactgctaccttaagcaaaatgatatataatgaaactaatctttttttctcaccaacattgtagtgaaaagatgttgaacaaaaagacgttatccaaggatgtaaatcatttaatttaaagttgcagtttccaagaacctattgactgtgctaagtgaggacttactgtagttaggtagaattataacaggtttaataattatgaaacatgaagagtggtctgtggttgcaggccacaggctgtgtgctcttgattcaattatgtcaatatttttattagtgacttgactgaggttggaattgacttgtggatcaaatgtgtggatagcctgatgaagagagagatcacttacactttgggtgataggagtaagatcccaaaaggccttaggatagcagctgaaatctttcaggcttaaatgttgaaaacagataaatgggaaaccctgtgtctggagctaagaatgtatcttgacagtacaaatacaaattgtgaaaacatagttgaatagcagcctgtttgaacaaagctaagagagtatttcaattagagtgcttgcagagaaagttatccaggtggttgaagggactcagaatcatgtcctattagaaatggttgaaagaagtgtagatatatagcctagggggatatatgataactgtcttcaattatttaaagggctgtcatgtagaagaggaattagacttattctggggggtcctggaggacacaggggagagcagtgggtagaagatacaggtagattcaatatgtaaataggaactttctaacaatttgagctgtccattagagggatgggcattatttagagggtttaagtcactggcaatattgtagacatctgttgctgaccttgtggggatgttgtgagagaatattagctttgactcattattggatgggatggttcttatggtcactaacaattctgagagtgcgtaaaaggtaggccgagggataatgtgctgcgccctacgtcccagtagttggcaaagtccaaacccagatgttttgagtctcctgccttgtttatatggttgaaatgctgactttacacagtgttccatatatgtatctgtacctgtcatctttatgtgattggctagagaccctgtcacgttcacttttgtaatctcacaaagcttgacaaatgccctgtacataggaggagcaaagtgtttgttgacctaaagtgaattacagaacagctgagacacatctaaatattgttcttttactgatcctggttccataatgaaaacatttggaagttgaccagaaattatacctggggattcctagtagaatggtgatgtagatggaacggctctctgcctttgtttctgtctgtggtacaccacacacaaatgccaacacttcaccaagagtggaagccatcaggctgcactctctgaccaggattgttttaccccttctggatggcaatacatcgctccctttctttttcactgcctcctgtgcatacctccgtgctaaattaaactccagaccctgggatgtctggaatatattttccagtcttctgaattctaccaccctgaagtagtcatttgctgtcatcataattctggaagatttaatattcagattgacagtggatatgccggtctcattctttgatgtttggtacatgggcaagtggtcaggtatcctggcctatttatcaccatattctccatggcctgtactcagggtcaggcatatggtaggtagtcagtgaatgtttgtttttgttagtaggactctggtttagtccttacagtagtcccttttatccatgttggtatgttccaagacacccagtggatacctgaaactgtggacagtaccaaaccctttccatactgtttttttttaatatgataaccaagacagctactaagtgactaacaggcaggtagcatatacaccatgctggacaaagagatgattctcatcctgggtggacagatcaggacaacgtgagaatttcatcttgcaactcaaaatactgcctaatttaaaatgtattgacgaattgtttatttctggagttttccatgtaatatttttggactgtggttgctcatgggtgactgaaaccacagataaggggtactactgtacttctgtttcatcctaatgaagtaaagtttctttgttcatcaaggcagtattttctttctcttttgtacctaccatgctctacctacctcatgtcttcattttctgtgccactttcttgctgtgttttattaggataatgttttaatagaataaaagaagggcaaaggtatagtaattgaatgtccttcactatcaatccccccaacccctgaagggagaaaggaaggagaatgtgggggagaggggaaggaagaaaggaaatggtggagaaagtagagaatgagagaagcatcctgtttcatactgagaagactttggtattgaagaattttgactttgttagtgccatataacttgtgtgttgctttgtttaaattctcgtctgctctcatgttttcattgcattctgtggatagcagctaagagagctttcagacacatctgtattagaagtaaaataactgttaatgtcaagactatatctttgcttttttctccctcagcttcttttctcgattggtagaaaacatggaataatggtgccagggttagctttgcctggagaagagttctgtttgccagccctgctgcagattgataaccatcaagggaaggatagcccagtcataagtgaccttgtggactgcgtatctttatgtaccccttacacactagtaggaagaacccaaataccatctgccaatgacagtgaggcaggaacctcacttttgtgacaaaaggattgtactttgctctgctggaactggctcgttaacaattcataagaaccaattaagttttcaagaattttgtgagctggttttttagtaaaacctttattagaagttaagttatattaaaaaaaataattagatgggtatggtggcaggctcctgtaatcccaactgcttgggaggctgagacaggagaattacttaaacccaggagatggaggttacagtgagctgagatggcaccactgcactccagtctgggcaacagacagaaactccatctcaaaaaataaaaaaaagttatgtaaacttacctgtgcttttaatataatttacttaattgtaatcagtattcaaaattcatcacttccttattagctgctacattttactaatatccatgaccttgaggttatttacatctagtatatggtagaaatactacaaaatgatgtgttattgagcctcttttcctaactctgtattcaatgacatcactttagtagccatggtggaagtatttacaccacagaaattggtaaacaggatgtcttattctgttttgttctgctgtaacagaacaccgcaaactgagtaatttataagcaatagaagtttatttggcagatggttctggagactgggaagttcaagatcaaggggccatatctggtgaggaccttcttgctgtatcacagtgtggcagaagacatcacatggtgagagaacatgctcaagagagtttgaagctcttttataatcagcattaatccattcatgagggtagagccctcatgacctaaacatttcccattatgttccatctcccaacactgttgcacttggggttaagtttgcaacacatgcttttggggggacacattcaaaccatagcactgtacaaatccaaatttggtcatttgttttgttgattgtctacacttaaaagaatgatggaggaaatgttattaatacagattaaatttaaaagtatgttgtatttgcatccattacattgtggatagcaaaacaattaagagaatatcttcttgtattttgaaactgtttccaactcaacaaagaagttattcatgtcctcgaggaaggaaactgtttatatcattcatgtcttaggtgttccactttaattttactggttcaaaaacatcaaccaggttttacaaaactacactcattcttcaggtacaaccataggttggctgtagatataagaattgcacatattttaacagaagcattctgtgaatgttaattttcccatttggttggaattcacagtaaagtttagcatgtactttgttattatttgtaaattgcttgctatacatgatttatatcagtaaattttataataaataggtgtacatctatacatacatacttcttttcccaaggagctggttgttaagtattaccaacacactactgtttacaatccaaatgagaatgtagctctgtgtcttaaggtagtgatgatcttgtgtaaatggtgagatttttgccttcatcatagcaaaaggctcaaatgcactataggaaggaaacctttctgattatggaatatgaagtcaggattttaaatgccaccaactgtcgaacacttaaaggacaaagtgtttgaaatcttaaagcctgcctactctatttaaaagaacattagagggcgttggaaagaggtgataaatatcattaggacctcagcaaggctttggaacccaacacattgaaagataattgagtgaagaggatctctggacacaaagcaggcaatttagttatccaaagcatttatgtcaagcagctaatgcgtgaggatttatttatttgtgtttttctctcagagcttaatccatgaggagtacagagtggtggtagggtggaggctagcctttattttgcattgctctgagaagtgttgcgataatgggagaaatttggtgtcctagaaacgttattattataaatgaaaaatcttgaaatacgaggaaagtgaattttttaaaactgggattagaaactcagaacaaaatgagctggacgcgctggtcatgcctgtaatcccagcactttgggagtccaggaagggcggattacttgaggtcaggagtttgagaccagcctagccaacatggcgaaaccccgtctctataaaaaaaaaaaaaaaaaaaaaaaatcagctggatatggtggtgggtgcctgtaatcccagctgctcaggaggctgagtcaggagaatcgcttgaacccgggagatggaggttgtagtgagccaagatcatgccagtatactccagtctgggcaacagagcaagactccatctcaaaaaagaaagaaggaaaaaaaagaaactgagaacaaaatggtcttttgcctctttctacttaaataagatggctcatgcaaaactatatttttgtgtgagatttttggttaacaagaagttgtatttccgttcatcagttagactcagtgtggaggaatgttttgtttaacctactttaactagaaacaaaatgtatttgcagaagtttataggtagaattataaggtgatctaataaacttgaaggttactttcagcatatggaaatcagaattttgttagtggaatggcaaatgtgaagaatgaaaaatccagttgatgccagttaacattaacttttaggaaagaaaaaacggtagatttttctgtgaagagtgtgtgtgtgtgtgtgtgtgtgtgtgtgtgcgcgcgcctgtgtgtgtgtttaaattagatttttctgtgaagagtgtgtgtgcctgtgtgtgtgtttaaaatttagctcatctggttctgtgttgtgtgttttctctgtgtgtgtttgaaaggggacatattatgaacgttatggttccctacctctaagatccattcctaaaatagttttactaatccgaagaatgactaagaatgtaactatggaaataaaatgacttttcaatcctgtgttgactacgtgcctaaaatgttgatttgctaaaacctggtacttccaaattaaatttcatggtatatggatgatttattgtaatctcttgtgaggaaattcatcttaaaaactttttcgaaatcatcctaagtttgggagaggagagcatttctaattcaaagcaggagtcaggctaagatcacatgtctccctagaggaaagaggggaggttttacttgtgcatatgttttttaaatatttatagatacagctggacttttagtactttagttctggttttaatgatggaattcccaaaggactaaaattgttccaaatgtctgaaccgtgtctgaagttcaagaacagtatatggttggtctgaagactttaatcctagttggaaactttgaatgagaaacctggccttttagtcttgtatttcttgaactttctgttaacagaatatctcctcgccttttatgtagcccttaactagctgcagactgacttggtcttctctagtaaagcattttctatgtaaggtcaccagtaaatttctttttgtcaacagagtaccttcttgcctcctattcagccgttaactgttttgtactgacttggtcttctctactaaagcattttgtatataaggtcaccagtaaatttctaagtcataaaattaagtgatttttcttatttcccatctatccagtcaacagtcattttattcagtacctactgtgtgacttggtgctagggattcattagtaaacaaagcaggaatattcttttacaatgtggagctttcaattttctgaccctgttgaccttccttcttcaaatttcataaactcgcttacttctggttagtgaaatcaatgatgattattttaataatgattcctcccctcatgattgtgctcagggccctctctttccctgatgattgtttttcttgatactttgtggatgattttatatggctaagacttccaggttgtcatctgcccatacacagaggaagtcctgagggaacccacgagtttcctctcactgcttccgtgctgtgtaggcaccttctcctgttagaaaaccatcaataggagcttccatgatcatggtggaggcggcaaatagtgtgtattttgcagggataaggcagcgaggacaagttgcctctatctactttagccagaagattagtactaatttctaaaactttcaaatttgtctttaaaaaattgcacccatatagcatatacatttagttgtatgcacacacacactaaaataaacttctttgtatacagtgatttggtataatcttaggacgattgtattttccttttgtttgtaacaactttattgagatataattggcatataatgaactgatcatatttaaactatacaacttgataagttttgacatgcatacacctatagaaccaacacaatcaaggtaatgaacaggctaggtgtgatggcttacacctgtaatcccagcattttggaaggctgaggaagcagaatcacttgagcccagaagttcaagatgagcctgggcaacactggaaaactctctcactacaaaaaaattaaaaattagctgggtatgttggttcgtatctgtagtcccagctactcaggaggctgaggtgggaggattgcttgagcccaagaggtcaagactgcagtaagccttgatcatgacactgtattttagcttgggtgatagagcgagattccatctcaaagaaaaaaaaatgaatatatccatcacccccaaaagtttcctcctttctctttgtaattcctttctcccccacctcccttccatctccaccccagcttattccctggcaaaaaaacaaaacaaacaaacaaaaaaaacaaaaaacaaaaacaaattaactgttttttgtcactataaagttgtatacatttttctagaattgcatataaatggcattacatagcacatactgtttgtccttttttttggaggagggggggttctggcttctttcactcatattatgcttatccacattgtgctgtatataatgtttcacaatattactcaatttatggatataccatagtgtgtgtttatacattggactgttttcagtttttgttattatgtataatgcagctatgaacatttatgtaagagtacaatgtacattctcttggacaaataagagtggaatggctggataatgtactaggtatatgctaaatgttctaagaaactgccaaacaataatcaaagtggttgtaccattttatatgctcaccagcagtgtgtaagagtcccattgtttccatatccttgccaatacttgttatgggcagtcttttccattttgccatcctaataggtatatagtgctatctcattgtggtcttgaattgcatttccctaatgaataatcatgttgagcaccttttcatgtgtgatttttcatctgtatatcttttttggtgaattctgtttatatcttttgccaatttttaaaaattacatttttttcttgagtgtcgagttctttattctgtatacaagacctttatcggatatatggtatacaaatatttgcttccagtgtgttgtttgtctttttattctcttaacagcgtcttacaagataagaggtttcaaggttgttttttaatttttatttaatttttagagataggatcttgctctgtcacccaggctggagtgcagtggcatggttatagctcaccgtaaccttgaactcctgggcttcagccatcatcccaccttggcctcctgactacctaggattacaggcacgaactaccctacccagctaattttttaaaaacttttttgtagagatagggtttcaccgtgttgccgtggctgttctcgaacttctgagctcaatcaatcctcctgcctcagtctcccaaagcaaaggtttcaaattgtggtgaatataatctatcaacttctttttatgggtcatccttttggtgtcatatctaagaaattatttacataccaaggatacagggttttcccttatgccttgctctggaagggttacagttttaacttttacatttatgtctgtgatccattttgagttaatttttgtatatgaaatgagacatatagtgaattcatttatttttgcatacttttttttttttttgagatggagtctcgctctgttgcgcaggctggagtgcagtggcacgatcttggctcactgcaacctccgcctctgtgttcaagcaattatccctgcctcagcctcctgagtagctggaattacaggtgcccgccaccacacccagctaatttttgtattttttagtagagacagggtttcaccatgttggccaggctgatcttgaactcctgacctcaggtgatccacctgcctcgccctcccaaagagctgggattacaggcatgagccaacatgcctagcctatttttacatacttctatacagttgttccagcatcatttcttaaaatgactgtcctttcttcagtgaattacctttgcatccttgtcaaaaatcagttgtttatttacatgtaggcctaattttcttcctttttactaatcaatttgtctgtcttgaggttgccaacccaaggcccatgggccaagaaaagctcacagcctgtctttgtatcatctgttagataagaatgcttttttctatttcttaagggttgtataaaaaaaaaaattaaaggaaatgtgacagaaaacatgtgtactgcaaagcctaaaatatttactgtctgaatcttctcagaaaaagaaaatttctaaacttgacctatcttgacaccaataccacgtcttgattattgtagttttataatctattaaaatcaggtaatgttagtcttccaacttactttttccttttcaaagttgttttggctattcttggccctttgcatttgtgtatgaattttagaatcactttgtaaatgtaaatttcttcaaaaagacctgctgggatttttattcatattgtattgaatctatagaccaatttcaaaaaattgatatcttagcagtattgagtcttttaactcataaacaaggtgtgtttctttatttctttagattttctttaacttctctcagaaaagttctgcagtggccgggcacaatggctcacgcctgtaatcctagcactttgggaggctgaggcaggtggatcacctgaggtcaggagttcaagaccagcctggccaacatgctgaaacccagcctctactaaaatacaaaaattagctggctataatggcgggtgcctgtaatcccagctacttgggaggctgagacgggagaattgcttgaacctgggaaacgatggttgcagtgagctgagatcgcgccactggactccagcctgggcagctgagtgagactccatctcaaaaaaaaaaaaaaaaaaaagttttgtagttttcaggttacaaatatttcacaacctttgtcagatttatcattatgtatttttgaagctgttgtaaatggcattgttttataaattttaatttctaattattccttgctgcaatgtaaatgtacagttaacttttgtatatttatcatatattctgtaatattggtaaactcacttattagtgttaatggctctttttaaaatttatttgtattgtatatatagttgataatgtcaaagaagagtaaatataattttccttttttttttttaatctggatgctttcatttcttttcttatattattgcactggctgcaatctctagtataatgttgaatggaagtggtgagagtgtacatgcgttttcattttaactcatattatggggaagcatttggtgatcttccattatttatgatgttagctgtaggttttctgcacatacctttatcagtttaaagaagtccctttctatttcacatttgctgaaagttttaatcaggaatggatgttggttttgtatcaaatgctatttattaatccattgaaatactcatttttttattttttagtttaatatggcaaatttaactgattttcaaattttttttataaaaacatgatatatttttataaaagtatattaaaaattattcgtatatatatagttgaacttaattagcctgtcattttctttttcttttttttttttttgagacagagtctcactcttgtagcccagtctggagtgcaatggcgtgatctcggctcactgcaacctccacctcccaggttcaaacaattctcctgccttagcctcctgagtagctgggattacaggtgcccaccaccacgcctggctaattttttgtgtttttagtagagatggggttttaccatgttagccaggatgctctcgatctcctgatcttgtgatctacccacctcggcctcccaaagtgctgggcttacaggtgtgagtccctgcgcacagcctattctgtcattttctttcattgtctttggtttctatatcaggataattctgacattatagaatatattgggaagtattcccttctctccaattttctgaagcagtttgtatagaatttatattattgtttccttaaatgtttggtaggatttatcagcgaagcccttgggcctggagttttctttataggaaattttaaactccaaattcaatttgtttaattgacaaagggcttttcaggttttctattttttcttaagtaacatttggtagtttgtatcttttctgagatttattatttctttaatattttgaaaatctgtgctgttgtaacctttcttattcttgatagtgacaattcatgtcttttttttttttttccaggtcagtgtggctagaggtctgtaagttttatcggtcttctcaaagaactaacttttggtttcattcatatttttgtttgtttgtttttgagatggagtcttgctctgtcgcccaggctggagtgcagtggcgtgatctcagatcactgcaagttccacctcctgggttcacaccattctcctgcctcagcctcccaagtagctgggactccaggcacccaccaccacgcctggctaaatttgtttttgtatttttagtagagatggggtttcaccatgttagccaggatcgtctcgatttcctgacctcgtgatcttcccgcctcagcctcccaaagtgctgggattacaggcatgagccaccgtgcctggccacaggtttcattcatattctttattgcctttcagttttctattttatttggtttctactcttatcgttgttatttcctgtattctacttacttttgctctctttttttttttttttagtttcttatgatggaagctgaaggcattgatctgagacccaccttgtttgtttgtttgtttgtttgttttgttttgttttgttttaaagacaaagtcttgctcttgtcccccaggctggcgtgcaatggcgcgatctcggctgactgcaacctccgcctcccaggttcaagcgattctcctgcctcagcctcccaagtagctgagattacaggcgcttaccaccatgcccagctaattttttgtatttttagtagagacggggtttcacaatgttggccaggtgtgagccaccgcgcctgtccgagacccatcttgctttctaatacagtttaatgctatttctccttcaagtattatactattttaggttcatcccacacattttgatatgctgtgttctcatttttatccatatcaaaatactttctaatttttctttaagtttactgagacttgctttgtgactcagactatggtctgtctttgtaaatattccatgtgtgcttgaaaacaatgtatattctgctgtcgttgggctgaatgttctataaatgtcaattatgcataatagtattttttaagtcttatatccttctcgattgtctatttatttgttctttcaattattaagaaaggggcattgaagtctccagctaatatttgttctatcaattattaacaatggagcattgaaatctccaactatagttatagattttttttatttctcctttgagttctatcagtttttgcttcacttattttgaagcttttttattaggacatttaagattgttgtattcttttcatgaattgactactttattattataaaatattctttgttctgaaatatattttgtctgctattgatatagctattgcagctcacttttgatagtgtcttttttcattcctttgcatttaacctatttgtgtccttatatttagagtccattttttttaagagaacttgttttggggtatttaggtctttataattctttttattgtgtctgacaatcttttgcctttttaattgtggatatttagactgtttatatactttcttgatatggttatgtttatatattttatcttattttttcctatgttcctctgtattctttacttacttttccacattttgtgccttttaaaaatcagttgagtatttttaaaggccgggagcagtgtctcacgcctgtaatcccagcactttgggaggccgaggcaggtggatcacttgaggtcaggagttcaaggccaccctgtccaacatggcgaaaccccgtctactaaaaatacaaaaattagctggatgtggtggtaggcgcctgtagtcccagctgcttgggaggctgaggcaggtgaattgcttgagcccaggaggtggaggttgcagtgagccaggatcgtgccattgcactccaagctgggaaagacagagagactgtttcaaaacaaataaataaataaataaataaataaataaataaatttaaaaataataataaaataaaatagaaatcaattatttttaatgattccattttatctcctttcttggcttattagctgtaggtctttgttttttggttttaattgttggttttggggttataccatatcttcaacttataccttcaagtgatatactacccattcatgtataccataagaatcttacaagtgtatacttttgtttcaactctcttgttgtcacacaattctacttttatatatgttctaaagtctatactatattgttattgatatttaattagttaattgttctttgaagaaacttacataatataaattttttttttttcttgagacgaagtcttgctctgtcacccaggctggagtgcagtggcacaatctcagctcactgcaatcttcacctcctgggttcaagcgatacttctgcttcagcctcccgactggctgggactacaggtgcgcaccaccatgcccagctaaattttgtatttttagtagagatgggatttcaccatattggccaggctgctagctgtgctacaatttctggtgctcttcattcttctttacatagatgcatttctatgtaataccatttgccctcttcctaaaggttatcctttaagatttctgtctttttttttttttttgaggcggagtctcggtcacccagactggagtgtagtggcatgatctcagctcactgccgccttcgcctcttgggttcaagcaattcttctgcctcagcctcctgagcagctgggactacagatgtgcaccaccatgcccggctaatttttgtatttttagtagagatggggtttcaccatgttggccaggctggtctggaactcctgacctcaagtaatctgcccacctctgcctcccaaagtgctggggattacaggcatgaactgccacacctggcctaacgtttcttgaagtacaggcctactggtgattaattctttcagcttttgtatatctgaaaacatcttcattttactttaatttttaaaagacatgttagttgtgcatagaactagcggttgatactttcttttcccttctcccagtactgtaaaaatgtttcacagtctttgcaattgcattttttaagtaagaaaattaggtatcattctaatctttaacctctgtatataacctgtcatttttcccctggatgctcttaagaatttcttttatcactagtattgagcaatttttttatgatctgcattggtgtacttttctttatgtttcttgtgcttagggttctttgagcctttagatttgtggttttatagctttcatcaaatttagaaaatgttttatcctcataggactattctgattctcctcagctagtaatttctttacctaatggacccatttacaaaatacactccaggtcctataaattttttttaataggtcatataaaagttactaccaggaatctgatgtttatagtgacagaatcaagtctcgacacttggaaaagaacattgtctgttttctcttgtaaactctgggattgctgaggttttcaaggaagccaggtactaaaccactctgctgttacagtcactgttcttctttttggctttcctacctcctgagattcttggcagatgaaggataagtgcttcataagcctgaaatggtggcccttctgggtcctgtggtaatcatctgagcacgtacttttcatttctgagttagtacggagattcctgaagttctgtctacatctttccaatgttggatttatacccaacatgtaggaatataaaatttagtgctaagatgataggtgttcactttgttccaatcctgtaatttgctgtggtgacatacaagggaaagagaagagccttaaatatttgcctgctagctatcaagtaggggggattatactcttaatctcatttacattttcttgtagctatagcaaagtttgacaggcaatcgtcatatcccccaaattatattagtgtgccagttacaggtctgtgactcctaagtattatttttaatacttaggagtattttaatactcctaagattatatttaaaaaacataatctcaccagtacatttttattccttcctttttaataaaccagctttgacagatgaaaaggaatctgtgctgtagctcagatttctcatgttaggcatattttagccgtaaacttaattatcgcaggaattttcaaatgactccaactttttctgcacttggtatcagaggataccaagtcctgtttttgagctgataaaatcctccttctgaaagcatttgtttattatattactgcttcacatgagctgagctctatcctgaccccgtgttaagtgtctgtggtagatttcattacatccatatactggaagtcctgccaatacactggcagcaaaatcctagtggaaaataaatggcaataaaaaagagaaatgatagcctgtgtgagtggtgaggagcacagctttattgagactggacaaccccagagtagtgacttggcatgcagacatgagcttaagagagtgtgagtgaaagctgatattggaataacgactctgtggcacagacatgggaataatttaattaattgcactgaaatttctttgatgaatagttatgtggtgataagcatgaggtcgaacagcagaatgagtctcagctttttaatgggccagcacagctgcggttttggatgccttcccactttatttctgcctgcagctctccaccgctttattcatccacatctcagctaggagcaccactcgcggggccccctctccatgtcggcagagctgaggggcaagtacatttggccatgggaagcaggctggtgactgctttgaaatgaaaaccagatcaaacgaaaattgtaggatggtgtccttatgatgcctgcacctcccctcctccccaaatctctaggatgcttttacagagtctttgctgctacgttgtataaagattttaataaaaatttcttgtccctggagaaacaggcatgtctttgttgtcagagagctagagggaaatgagcaatgcagcccagctggagtaccagcattaatcccatgattcgtagcccgtattttcagacagatcaattacttatggctgtaaccaatctctcatcgttttcttgctgtgcagggctccatttccagactcggcagctgacataaccttccaacttgataggacttcagctgcaaatctcttcaggtctgctgcctccattcatcgtggttatacaaatgagttgttaaataaaaatcaaaagtaaaaaattatgggtggtaatctctgcctggctcagtaatacccatgggcctaggcaacattttcagttggatttttaaaaaacaagatggatgattcacttgtctgacttccttcacttttatggacaggctttgcatgagagaaaagccatctctagagggaagaaattatccacagtggatacatttcttatcaatttataagttgaaagattaacttagaagtggagagaaaggagattatgaggagacacgaaggacatgtacaggtgagctgtgtctaatgcatttcacactgagtgagtcaccccttttcagctgctaggctgcctgggcttaaggccaggagattctgtatcaaaaagaaatgacccttgctaacacagaggtgtcatggaacatgtaagctgtttatagagtatgtcactgtgtgaatgtagaacttgtgtgaaggatctaaacccaataacctttgaagaatttacccagaatttatttagtgttttcaagttataactactccttgtgtgtattgaacccttcacagctatgtcaggccagctaagccttcctggaagaggtacttaggggccagataaagcaaattggagaatctctttgtgatttgactcactttagatgcacagatgctcatctgttaggaaagcatgtattgactctctttgtgcccttttctttcattgtcactccatcatttccatctcttcaatgaatagtcctttgaggactttcccattttccctataataaccaactacgaaaatttgcaggaagcaaaaaggaaaatgtggacatctagagaatataaatggttttatgtttaatctagggggaattatgtatgtatttatatatatttgtgtatgcgccctgcatgcttgttgcattttgctgtatgctttagaaacctttgcctacatggaacccattagtagtgtcctgggacaggtattcatgaactctgttaacaattaaggaagtaagttcctgctgctacaggctgacagccacagtttccccttgggcttgtatggctttggattgattctaaagaagcaaaggaaacatacagaacatacttgtttgatttgaaagttaaaaaccggtctgtgtctgttttcttctcccttttcactctagcccttcttaggcatcccaatgcgagtagtaaaacataaatcatgcaatatcataagatactgctacagctcttgccctgccctggatttgtttttttgtgcatctgaattttattatgatccataaagcagtatggaaatggctcattggtagggttgcatggcagtaccccatcctcagaccctgccaacaattgaaagtctgagaggtaataagaaataaaagggagatgagatttatagttcgtgagttcaagttgcttttttttctccgtggaatgttgcctgtcttattaggagttctttagtgaaacaaaatgcagtggtagcttagagaaattatggatactttccaggggtgtgggagaagcttaggagtctgtaagccttctcccctggttgcagttaggaagccagttgacagtataataggcttttggaagtgggtgcaatggtttgtgtgttctgtttgatgttgcaaataccaagcccgcagggagatctgcaaagaggatattctgttcttaaagaaaggaaaagattaacctgaaacgtgaactgaaaaactcctgaattctagaggacttaggtgcagccaaggaaggatctcatttacttacgtggaaacatcatttggcaagctgcctgctccagacaagcagatattttttaatgatttcaattaatgaaaagcaatcactaataaacttgagaggattggatcacatattaagagtgtgtgtgtgtgtgtgcgtgcgtgcgctcacgtgtgcgtgtgcagtatttgcatggttaaggtttggaaatacgtgcattctcatacacgcatagaagtcttacaactacgtgtactacttggagcctgcctgatggtccttttcttcacattcagaatcatgcttctgacccattaggagaggctaactcttgttattttggagacattttcaggagtggtaatgaatgggcattaaggcacttctgttattcatgaatatgtacattcacttaacatatttattgagtacctactgtatgccaggtattatgctaggtgctgaggttatagcagtaaaaaaataaaaagatacatagtctctgctctactttagtttataggttattggagagacagacaagaacaaataataatacagttatacacttaaaatttttatattgcctttgtattcaataaaaatttgttgagggcttctagatgctgtagactctgtgatagagtctaaagaaaagcgtcttgcctaatttctgttaaaatcagtggtttgccatttacgaggaataaactggccatgtttagttatggtattgaagaaagggtttgatccatacaggaactatacttcacctctatgtattaatttagtacacagttttaagaacagcaaggtagcattcaagaagagcattctgttatatacttgtatataaaccctattgtatctactaaggatattgttataacttcctcttcactggtatctcctcaactctgagttcaagacctacccttctctccagctgtgggaaatgggatttgtcaacctctctgagacaaagtttcacatcagcaaaatgggaatagttgtactagttcacacggggttgtaaagagtgaatggaattgtgtatttgaaaacacttcattaaagggatggatatttcaagtacactgatttaatttttacaaataatatgaatgtattagatcatcacatgtaccctgaaactatgcatatcaattatgcatgaataaaaaaattgttgaaaaagccggtcgcagtggctcacgtctgtaatcccagcactttgggaggctgaggtgggtggagcgcctaaggtcaggagttggagaccagcctcgccaacatagtgaaaccccatctctactaaaaatacaaaaaattagctgggcatggtggcgggcgcctgtaatcccagctaactagggaggctgaggtaggagaatcgcttgaacctgggaagtggagtttgtggtgagccgagatcgcgccattgcactccagcctgggcaacaagagtgaaactccatcttaaaaaaaaaaaaaaaaagaaaaaaaaagaaaaagaaaatactgtgtaaaggactatactcatttgagtttgtataattttcattattattacatcagatttacagagagaataaaatttattgaagccaactgtgttgtcttaaacctccgaaaattcagaaggaggataatgctgagttcaagtacgatatagaaatcatcatatcttttctctagcaagtgttccaagagaattagaatataatgccaaaattaaggtagaaattaagttattctagaagtgggatagccagtgtcagcatgcatgcatgatccttgaaaagtgatattgggcagcatttacaccaagctttgctatcttacgttctctttttgcttcttctacctggtgttatttgtgccttccctaaagggctgaaattgaaaagaattagtacgaatgcattttcaatgacaccttggccaagaggttcatgcatttcagctttggacaaggtgctatggttcaaatactcatgaatatgatataagaacagtcattatttaaatgatgaacctttatatgagattacactgggtgttactaatctgcaagttgtattttctgtggggaaaaatcagtatgaatgaatcaagaactcagtgtgcatcctgcagtgcatgttgtatttgcatgaacggagatgtaatctcttcaccttttgaatcattttgtttaaaggccctatatagatcattctgctcttactggtgggtgacattttcttaaggttctctccctagatagactaatttgaaaaaaatgcatccctcttgatgtctgcatgtgcatgtgtgtatgcatatgtataaaatatagaggtgatcacaaagcatactgggccacttagcacttccactaattccacattatcagagattgtttggagagcatatttcattctccctactttgtcacttatttctaacactgagtatatctgtacagttcttaatagtaaatggcataatatcttattctctgtattctatacattgtcaaccccattcctagctgataatcagtagtcaaaaatgggtgaataatttgaatggtacttgtctttaattgtgattcatgtctgaatggcttgctggtaactaggagctaaatttaatgttaatccaaggtcacactctagtccacatactggaagctcagcctcttgacatgcatgcttcatgcaattatcaggctgctcccttgtaggataaagtgcggcagtctagaaagcatggcactcaaatgggaagaactgttggtgagtctgtacagaacagatgaggttgcagatatttgaaagcatttgctaatggaaactctgggtaaggcagcatcttaaataatacgtagaatcagcatgctgtctccaaaacacatttgcagcatttattagctgggtgtgagctaaaggtaagctcccattaaaagaaaaaaaaatcttcgtaatgattagcaggggcccagtataatttaaggtattctttggagtttataaatatggcctcataaaaagcctgaatataagagaactgtgactttaagtcattagaagcccagtggtttgataaaataacaggaaacagacaatttattatgagcagtctcagtagctctggattatctataaaacttttacggccttccccaagtggcaagaagccataaaacttgcctgaatgagggacttgttaatttacttgttaaagcaaattaaaaatttataagtgcttttaggtaaatgagatcttctctcattgctgcccttgcggggctgggagtcctaggaggggagagtggatatgcttagacaccactgcagaacaataaaagctattaaatttttccagtttattacagcagagccatgcagctgttgccatggctagctgtggggtaccggtggttgacagcctggagtctcactcaaagggggaaaaaataaaaagccaaggaaagggatgattttttacttttataattctccaattgttgatgttgtagaccatgtctttttatttttccttgaccttgtaaatccagaagttttaaacttttttcttttctttttttttttttgagacagagttttgctcttgttgcccaggctggagtgcaatgtcacaatctcggctcactgcaacctccgcctcttgggttcaagcaattctcctgcctcagcctcccgagtagctgggattacaagcgtgcgccatcacgcccagctaattttttatttttagtagagatggggtttctccatgttggtcaggctggtctcaaactcccaacctcaggtgatccgcccacctcgacctcccaaagtgctgggattataggcgtgagccactgtgcctggccttatactgttttttcttatccccagaagtgtttctgtttattttgtcatacattgttggtccttgaaaattcctgcccgtcatgattccttttagtcatttagtccatggacaaaggccaggtcttaggctgtttttgttaacctcaacatttcttgaaaaaaacctctttctctctcttttcctttcccatatctagccacaaaactaggagaaggaagaaagggaatctggtacatgttcttgtgtatttaactccaaaaactgttagaatcaatattttttgtggaagccaaagtttataggtaaaggcagattttcttgcactctcccttggatgaaatgtcagcgtaggttaaaattcttggatcttagcatcttccttaacttagggctgttctctacgtgttgaatttcttctgtaataataggtttctgaatggtgactttggctggtgggggtcatttttttggctttaagccctgtgactcaggggattttttttttttttggctcccttaaatacaattcacaatgagcagttttctccctgccctagtgacagtaaggtttctgggacataggaaatagcttattcttccactcagatcagaagttttgattgagctctgtggcatttttaaggcagaaaaagacacgttatgcctcaactacctaccctatttaatgttaaattaaaatgatggttatttttaaagtgtgtttacatttaaaaattcctccagaaaagtcaagttctgcaaacattttcttgtagtatttccagtcactgcacaagaaaggtacattttattagttttaagaacagaaatagtagaaagacataattggtacaagtgtttgttcttctacagtatttactcttcagtttttacatatatatccatacctctgatttgtagtttgtttggaattatgtttagaaaagcatattgttggcaagtaaagcatcacaaaattaagggtagagaacagcagtaaaaaaaaaatgacaaatatgtatttttagactgtattccagttttaggaggtatcagcttttagagattccttaacgttaaaatttgtttcagtaagtaactcttgttgtggtcgctgtcttcagtattccagaaataatgctgtatctcttattcaacttcatgaacctctttactggcttccatattaatgtcatttgcatttagagtgtgtcatcttcatttagaatctcagcaaaaattctggtttataaccatctttgcacaaattatctctgtgctttaggacacttttctgggcctggtcttgcattttttatgaatacaactttaagagtggaacttaaatatgtccccttttattggattatccccatagacctgaccacaaagtctgtggaagtagaaagctataacggttgtaccatttttttttttttaaatactttaagttctagagtacatgtgcacaacatgcaagtttgttacataggtatacctgtgtcatgttggtttgttgcacccatcacctcatcatttacattaggtatttctcctaacgctatccctcccccagccccccaccccacaataggccctggtgtgtgatgttcccctccctgtgtccatgcgttctcattggttgtaccattcttttgttcaagagtatcaagttgaatttcatgtactgaaaaagtagatagatttaaaaacatttaaatttaggtagcaaatgacattgggccaaaggtccattgctaaggagacccaggaaagaatttattacaataggaatatgaggtgtggaacccaaggacagctgtcatgaaggataggtaatcacagtaaagtagtgatgcttcatatacatttgtttttgtttttgtttttttgagacagagtctccttctatcccccaggctggagtgcagtggcatgatctcggctcactgcaacctccgcctcctgggttcaagcgattctcctgcctctgcctcccgagtagctgggactataggcgcacaccaccacacctggctaatttttgtatttttagtagagacggggtttcaccatgttggccaggctggtctcgaactcctgacgccaggtgatctgccagcctcggcctcccaaagtgctgggattacaggcgtgagccacttcgcctggcatatatttggttttaagagttcaagctagaattttagagtagatgttcactcattagtaatattgatatatgttgtataatgattgcttaattgctaattttcttatgctaattgatgtttttctataaaaccaaattcttcagctctttacatttattgaatgctatctggcttatgaattttcataagaactgccaaaaaaaaaaagaaaaaaaggggcaggtcccctccttccttctaaaaagagtggttcatgcctgtaatcccagcattttgggaggctgaggtgggcagatcacttgagatcaggagttaaagaccagcctgaacaaaacagtgaaacaccgtctttactaaaaatacaaaaattagccgggcatggtggtgcatgcttgtaatcccagctacttgggaggctgaggcacaagaattgcttgaacctgggaggcagaggttgcagtgagctgaggttgtgctactgcactccagcctgggtgacagagtgagacctatctcaaaaaacaaaaaacaaaaattaaagaaataaaaataaaaaggtagagagtatgtctataatgactttttaatgtgtcagggagtttttaataggaaaaaaaaatcattccactaaaaatatgtcctctgtctcccaactagaatttcttccccatgtcactgccagccattgctgtgacaatatagtctcttactcttttatcaaatattctccatattattgctgtaagtactggacagatatcataagtaaaatatgtccacctggttgctaagaaaaatcccacatttattttatatattttgtaatagctttacgtattcgttcaaccgtaacattttggtttaaagacttcattaagctttcattgtccaatagcaaagaagtatgaagtagataccccttactttgcagtgtttactttttttttttttttttttttgagacagagtctcgcactttcgcccaggctggagtgcagtggcgtgatctcggctcaccgcaagctctggctcccgggttcacaccattctcctgcctcagcctcccgagtagctgggactacaggcgcctgccaccacgcccagctaattttttgtatttttagtagagacggggtttcaccgtgttagccaggatattcttgatctcctgacctcgtgatctgcttgcctcagcctcccaaagagctgggattacaggtgtgagccaccacacccagcctgcagtgtttactttttatttattttttattttttggtgatttccttttaccattagctaccagctgtcaggtattttcatatagttttggcattatagtttctttggttagatcacacacacacacacacacgtacgtatatgtattgtaggtataagcactggaatttagcagagctttttaaataaatgggctagtctacatgcctttctattcttttccttctaataatcttatactaataagattatagttacaagtcagacagcaatttcatggcacctgtagattttgagtaagaaataaaactaacttcagttgattatagttttttttccatcattaatttaatccaaatttctttaagatggctaaggtaaatgaaattatattctcaattgcttgtctggtctaatatgaccaaaaaaaactgttagagactgctttaattatttgaagtgtttgaagaaatttgagagagtattgtagaatttattcttatattaatgcaattaatatattaagattcaaccacatcaaattatgtattagtcatccagaattgagagacatggttgtaaaaatatcattaaggtgtgtggtatttacttaaaatttattcctttagagataccagaataattatttatatctgtttgctaattgcttactctaaatgtttggtcagtaaatcagaaaaatattagagctatccaaaggaacaaacacactgcaatgtgttataacatgcctccattgcccataaattattaatacaatgttactctggaggggtagcataatgttttggaaataatgcacactccagaataaaaaggcctgaatgtgaattctaggcccatctcttcctttctgtttaatcccaggttaacctgagcctccacttacttaactctaaattagtaataattatatctgcctcacaggttctgagaggaacctgtagctcagtacagcaaatagtaggcactacctcaagggcagtaaatagaatattcagtcagggatccacgttctaggctcagcttaccacccaatccctgggtgtcttggtggagttgttcatctctctatattttagtttctttgtaaaggggatacattaaaatttacttttctcactttaaatatttacgtgaggattaaatcatttatgtacaattattagaaaattgtataacagtaggctgggtgcagtggctcacgcctgtaatcccagaactttgggaggctgaggtgggtagatcacgaggtcaggagttctagaccagcctggccaacatggtgaaacccctatctctactaaagatacaaaaaaaaattagccgggcatggtggcgtgcacctgtaagccaagctagttgggaggctgaggcaggagaatcgcttgaacctgggaggtggaggttgcagtgagccaagatcatgccattgcactccagcctgggcaacagagtgagactccatctcaaaaaaaaaaaataaatgaaaataaaaataaaatagtgtaagagtagacaaatgtgtacaacattattatcacaaaaatgaaagcagcttaatggtaattgatcatcctgtttttaagctactagatcagagaatgtgatgtgcccacttgtcctttactgtccttatgatagttgtctttccatgttggcacaatggtagaagctgctgtccaggctattttgggcaatttgagtcaaaaattagcagttattcaatatatacaccttttttttttttttaccagcagctcaatgagggtttctattatatatcaaggggctaatgtggcataagttgttttttcttttttttttgggaaaaatcctaactagaaaattgggtctgttcttaaattgtaaatgtgtgtacatcaaagccattgtaaggataaatttaagtctgatagtgtacatgtgtacatagtttcagtacacattggcgaaatatcctgctgattgctgattgaaaacagttgttaattctctacttcactaaattcagagtggaaaactttccttaatgaagaacagattgaggagatccaagaccttactgtgtgggaattaatggcagatgcatatactggtagttaaaatgtttcattagatgttaatgtcttgctgtgtttttaattgttcaggaattagcctctagaatattaaaaccatctgtttgttatgatgaaacagaatgcttaaatagttattaatttgtgtttcttgtctttttttgagggataatctgtaaaactttgatctgtttggagtttagggaatttggaatgtggaagtgaaaaataattttaaagcacaccagtgtcctgaatagctgaagtatgtctttttttttctccttacccactgcatatattttgtgttctttctctcttttttcttaaaggagggtgagttgactttttttattccatggtgtgatgagaatctattaaacagagctggtttaatagttgatttaaactttaagattatcttcgtgcatgtggattattttacattcaacatcaaaacagaatttagacatttagaggaatgaaggacagcttacgtttttaactctaaggatgtacttttactactatattccactagctctgcataactgttgatggctatacagactactgctggcatgggttctagtcttgactctgctgtttcatgccttgtgatctggcacagattagtctttctcagctttagtttatttgtctgtaaattgggaagtacaatttaatttatagcattttttttaatgcttagaagtaatacatgaagactgcatatttgtcttttgttttgtttttatagagatggggtcttactctgtcacccaggctggagtgcagtggccaatcatagctcactgcagcctcgaactcctgggctcgggcaatcctcgtgcctcagtctcctgagtaactgggactacaggcatatgccacaatgcctggcagtatttaaattttttttagtgattgagtcttgctatgtttcccacgctgatcttgaacttgtccctcaagtgatcttccagcttcagcgtcccaaagtgctgagattacaggcataagcacatacccggacccacatttgttttatgtagtgggcatattaattgctgtctttcttgattacatggagccagtgagatactttggatgccactgagaatatacattagcactgtagctgcaagagccagaaataaactcttcatttactggcctctcccctgtgttgatagccaaacagtggtgcatttaagttcttacccccaaaatgaaaatctcagctaatgtcatcttggctctagttaattgccaggtgtgtagagctacagtggagagaacaaatctacctgtgcatgagatcccaatttatgtctctgggggccctagtatttgtctttttgtctgtgagtttggctaagaaaaattttcagcttctcataaatttatattaatcagtaaaatcatgccaagaattagaagttttatatagttgaatctttctgcatcttggagaaattccatgtgtttagaccaaaaatgaatgatagttgggaaattcatggttctctttacgtttcctttacctcacttgcccctcaatcaaaactgaattatctcatttcctaagtctgttttgcgcaggttaaaaatgggagggtctttatacatcttctggagctgagtgaaagtcacttgctacatgaaagtgaagtttgttgtaaaccttgagtctctaattcaggttcctcagaggccaggctcataatgtgaataagtgacacaggacaatgtagggtgtggggtcgtccttgtcatggtgctccattgaccctttataactatagcattagtgcagttagtgctcttgtttccaggggcacacccccttgctaactggactatgctggcactggacgtcatatgaatgattcattcagtattaaaagaagaatcaggccaggtgtggtggtgcaagcctgtaatcccagcattttgggaggcccaggtggaaggatcatttgagcccaggaattcgagaccagccttggtaacgtggcaaaatcttgtctctcaaaaaaatgtagaaattagccgggcatggtagtatacacttgtagtcccagctactggggagactgaggtgggaggatcactttagcccaggagttcaaggctgcagtggggtgtgatcgtaccactgcactccaggctgagcaataaagtaagaccctgtcttataccatctccatagaaagcaccatcttaaaaatttacccaggatttcttttataaaggttgttgttgttatttttattattaagaaatcagtgattgttagtacacattttaaaagctttctgtcattgcaggatatgtcagaaaaaagtttttgctgtagtgatctttaacaacataagaaaaggagtggttttttttttatacttgttaggtaaaataaataggatttttaaatgcttcatattatccaaattacataaaagtggcaatctcgtcagtaagtatgtataatactaagagagctattaacttttcttggtagtggtttttgaccttttgctgaacaagtactttaaaaattttcaaatgccaggatgaagacttcttaaactaactgtaattatgcaactttttctttataatccgatacctcactatctaaaatatctgaaattacatatgatcactgtttcaagaacaaaatcagtgatagcacattttgaagactatggaatctaaaggctgattttgtatgctcactagcacacatgatacttttcatgttaccattcagcttttgagctctccttactggccaatcccagatgagaagctttttttttttttttttttttttctttgagactgagtctagctctttcgccaggctggagttcagtagcgtgatctcggttcactgcaacctccgtctcccaggttcaggcaattctcctgcctcagcctcccgagtagctgggattacaggcacgccccaccatgcccagctaatttttgtatttttagtagagatggggtttcaccttattggccaggatggtctcaatctcctgacctcgtgatccgcccatctcggcctcccaaagtgctgggattacaggcgtgagccaccatgcctggcctcacaattaagtttataacagggatatgttatgaacttaatatgcttggctattaatatttggatatgttctcaaatattctagaacataggccagatgtggtggctcatgcctgtaatcccagcactttgggaggccgaggcaggcagatcacgaggtcaggagatagagaccatcctggccaacaaggtgaaaccccgtctctactaaaaatacaaaaattcgctgggcatggtgggcgtgcctgtaatcccagctaccccggaggctgaggcaggagaatggcgtgaacccagtaggcggagcttgcagtgagctgagattatgccactgcactccagcctgggcgacagagcgagactctgtctcaaaaaaaaaaaaaaagtttaactctagtgtgtggtataccagttcagttctgtcctcatggaagtaatatggcctttcatgggatagtcactaatgataagtttagtgacatatagtttattaagatagctatggacagtgtaggggcttagtcttgatgagattttaatttttggctgcacttgaaatgaactgggatcaaaatagtggcaagttggatagagatttgctgtcagaattaatattcaagaagttctgatagcttgcaaccaaagtattttatattataacaaattctagatgctcataattattcaattaaaatggataaacagtaaatatatgggttagagaagaacaatgctttttccagaaacaaagttttaaaaacttgttaatatggcaattttaaaacatacatgaaagtaaagataacggtataatgaacccaacatcatctaacttcaacaattaagacatggctaatcttacttcctctatatccctacacttcccccttcccaataggtattgctccccctatcccctggattattttataaaataaaactcagactcaagttatctcacccattaatgttttactgtgtatctgtaaaggactctgcttttttactgtaactacaacaaaatgtaaataataattccaggccgggagctgtggctcatgcctgtaatcacagcactttgggaggctgaggtgggtggatcacttgaggtcaggagttccagaccagcctggccaacatggcaaaaaaaaaaaaaaaaaaaaaaaaaaaaaaatagccgaggatggtactcaggaggctgaggcatgaaaatcacttgaacctgcctcggcttccgaaagtgctgggattgtgagccaccatgcccggcccaaattgttccatttttggtcagtgggaaccccttcagtttggctcccaagcccctttgtcagggtcttgctaggatgacaaggtgttccagactcatcttacatatttcctttctcagaccttcagttggacacttttagttttttcgtgttagaatgggaaaaacaaaagatagaagacattttctatttgagagtggtggctattttaatgaatgacaggccatttaaaaagttattgaaacatgttttttaaaaacagaaaatcataaaaagtaagttttgtgtgtttattttttatattcatccttgaaaaccaaataatattgtctctaaattactttttaataatcaaaatcttattttaagaaagctgaaaactgtactaaagcaatcaaatattccttcaacacattattttttacattgtgtatgtgtattgtgtgtgaatttctgagcctatttgaaaacagatttatcatttagtccatggttatactcaaggaatgccaaatgcaatctgttcattctggcctttctctttaattcttgtacatcttttgtacatttctattcttgtacatctttttttctctattgtttagactttttggtcaaaaatttaaaaattttctgattggcagttggttgaaagagataatttattatctaaagatctggaatcaatagacaggaatgtctggcttactacgataaagggttatggagaccaacgttttatcatgcagataaagcctccaggtatcaggcttcagagagaataaattgtaaatgtttctcatcagacttagagagtctgctctattagtaattctgaaagggaggaggttattatggggcatgtccggtccctgtcccccatcatggcttgaatccgtccctcaggttagccttagaatgcccttgctgagaggaagagtccattcagatggtgagggggccttagaattacattttacagcataattaaacctaggaatagtatccaagttgtagatagatatgtgagttatacatcaaacactgccttttacacttccattttcttgccttcacattattaaattatgaagaaatagtatcgtaatatcctcttggcctaatcatagagagtagagttaacaattctcttgataagcagtagaacattgttaagttctgctgtctggattgagcgtgtctatagtaatgatgtcaaagtcggtcagttcgctcttgattttcttaactgcttcttatttatgtttgagactatatagttagattgatcttggcttattttcctttttaaattttattagggctgggcgcagtggctcacgccagtaatcccaacactttgggaggccgatgtggctggataatctgagatcaggagtttgagaccagcctggccaacatggtgaaaccctgtctttactaaaaatacagaaatcagccaggcgtggtggtgggcacctgtaatctcagctactcgggaggccaaggcaggagaatcgcttgaacccgggaggcagaggttgcagtgagccgagatcgcgccattggactccagcttgggcaccaagagtgaaactccatctcaaaaaataaataaataaacaaataaataaataaattattaacttagtttttctactgctatgaagtccactgaacccctttaaataatgtgcatgtttggcagctggaagcacttcagtcgtttttattttctaagctaatagcacaattttaagtcatttcctgtctaataatgcctaaagtgtttattgggatcatcattaacacaggtaaataactttccaaagtccaaacatatccaaaaatcctgtttcttactttgcattaatgaaacttgtctaattgcattagagtgactttacgatacatgaatttcaagggaatacctaactttctttctttctttttttttttttttttttttttttgagagtctcgctctgtcgccccagtcgcccaggctggagcgcagtggcgcgatctcagctcactgcaagctccgcctcccgggttcaggccattctcctgcctcagccccacctcgagtagctgggactacaggtgcccaccaccatgcccagcaattttttttttttgtatttttagtagagacggggtttcaccgtgttagccaggatggtcttgatctcctgacctcatgatccgcccgcctcggcctcccaaagtactgggattataggcatgagccaccgcgcccagccctaactttcttatttaaaatccaccatggtaagcagagttccaagatgaccctaaaagtacttgtcccttatttactcccatgttttcttatatagcacagttgactttatgaaaggaagttcttctgtaagcctgacctaatcaagtgaactattaacaggatgctgactttctggagtaagaaattaaactgatgggatctttcctttctataataaactgcttttttagaatataagttagataccataaaattcactcattgtaagggtacaagctaattaattttagtaaacttaaagagttatgcaatcatcaccatacaacattgccatcacctcagaaatttcccttgtgaccatttgcaaattggtagaatcttaaattcttgtgaaaaatcctgttagaacttggtgggctatactttaatatattattaaatttaatttgctgtgtttcttcagatttttgcagctttttaaattaggaaggtcatcctgtagtttcattttttgttttgtcaccagattttggcacaagttagctttccatattttttcatgttctggaacaaatgttgttaaatcttcttaaaaactttagactgcttaattatggttttgaaagtatcactgtagaatgtttacttctgtatttagaaatttatctgttttttattttgcttgccatctcttttatacttaaatgtgttagaggtgtatctcatatctttatgggttccccccagattatactatagtttactaactgtacaatattttaatttctaatgatgttcttctcatttttagaattctcttcctctgattttacctatacttgcctttttgtcttatttcttttttgttcatttcaatctttataattaggccatttatttctattctttcacatttaatagaaaatacattaagtccatgagttaacttctagcaaagattttacaacataagttttaaaatttatatatttataattttcattttcttaatttttaaatgttgtatgtgtgattttgtcttttacccagttgttaattgtagacagactttaaaaaaattctttaggtgatatggatattcaacataaaatactgttattactttttatcatagagaagtctgttcatataatttttacattttgaaatttattcttatattctttgttaccctggtacattttcagttggtggtaatgtcccatagatcctctaggtgtgtctctttaagttacccaatttactgtatattaactaagtcaaacttcattttttaacctctgcgtcctttttcattgttttgttttcttgttccttgattagtagaatgctaaaggctcccaccttcttttgctttcttttattatttagaatattttttactttgtatagttttgtataatggtttataacttagaagggtataaaaggtaaagactgtacctttcatcactataaaatgactttgacaggtgatttttttacctatttatttctaaccttttgtctttttccctctctctttttttaaatttaggagttctttgtaactaataaataatgggacatcaatctgttgattgatctgtatatctatccatctctctgtcttacccaacacaaaccagatttttatttttaaatgggagcttaatgtatttatattattatcagaacactttgttttacactttgctttcttgccacttttcttattttctttccctttctctattatgatttgagtcattttatatttggtaattatttggaaggcaaatatttttaacgtttaaattttactaatggttagcttcaagattatcaaattgttatttaaaacactttctctagctgttgtagatgataacaaaagaacctttgattctgtgatcccagaaaaattccttgccctgcccttgtgtccaaaatttgttaaaataattttagcttttattcacaacttggcactgtacacttaaagatacaatatagttttcttttttaaaaaatagtttttctatccaactttataattttacttattgtagttattttgtgtttgcttatttcgattcatcagcatttttcattaagttttttagtttggttcatgtacctgtcatctgaaatacgctttaaaacttaaagaataaaatagtacaaattctatccaatccatgatactttcccaatttggggacaattttatcttgaaaaataaaaatagtatttttcaagattaaatacttggctgctttgatggtagtgtagtctatgggtatattaaaattttcttgaaaaaggagaatcttttgagcttactgaaacattccccaaattttgcatagagttcatttacattcctacagaaaaactcagcagtctgaaaaaggatatgtgctactttgaggaatcaaatttgtggaaggagattccatttggacagtcttctacattgcctgcataattcgcatcattcctctcaaattccaggcatagatatattctccacataatttatccttctgtaaattttgtttgatggattaatgacacctactgggcaagtagcatctttttgaaactctccatatccaagctgaaaagaatgggatagcccagctcacaaatgccaagcagatgtgcacagaattgctataccttcatgcagtctagggtgatgggacttcgttacatgttcattagcagtgacataactgtggatcgttattttcctaattagccattaataacagttaacactgtaatgggatcacaatttcagaatttggagcatatattgttgacagtgaaatctaatgaaaaacaaactagcttcttatattttataaaagatgttaatctcattgatagaattactgccactcatgccagataccagctggctttcattttgcatattttgttctcattctggtgcccaaactattgaatatataatactctaatgggaagaagcttctcacaacagagagtgggttatagtaatttttaaataaacaaggtcctgaagtatgtaaaggctgatggtaagaaatcttactgtatcagttataggaaaagctttcttgtaatagctgccatggatgctcatacaaatcaatgcaagcagatcaatttttcttagctctttaaatgtttaagccagcatctggcctttgtgatgtttcttggttgtaggtaatagctgggaatttcaggtgaaggattacaacttctgagttagttatgctaccccaaacgatccattggatgtggctaaaatgctagtttgaaactatattcagctgggcgtggtgactcacacctgtaatcccagcactttgggaggccgaggtgggcagatcacctgaggttgggggtttgaaaccaacctgaccaacatggagaaaccccatctgtactaaaaatacaaaatcagctgggcgtggtggcacatgcctgtcatgcctgtaatcccagctactcaggaggctgaggcaggagaatcgcttgaaccggggaggcggaggttgcggtgagcagagatggcaccattgcactccagcctgggcaacaagagcaaaactccgtctcagaaaaaaaaaaaagaaagaaaatatattcatgggattggaaatgaatacttctttgcctgaaatcttgtggtttagctttagtacttactgtagtcagttcatttctttgaaatattgagctgtctgacagcttaaaatcctaagtttcctttaaacttgagcctggctttggaggagaagggggtggtgtaggggtggattttatgtaaggctctctgaagagaattcactgaagtgttttttgctggcagggcactgggaaggctagcaggctgcttcctctcagtccttcttgggttttgcccttagcctagatcaacatttagtcagataatttacgtcaggtccactgaagtctgtttttgtgccttggtaaagtcatcattttccttccgtgaagaagcatggaaaaggcccaggtgcaatgtccaggttttgttaagccagttggatattaggaaaagccttgacactctttatagtcttagttcccagctggatatgtatctctcatctaagttgggaactgagtttttattattagttttttaaatagagacggggtcttgttatgttttctgggctggtctcgaactcctgggctcaggtgatccccccgcttcagcctcccacagtgctgggattataggcatgagccactgtgctcagccataaaggtgttgatcaaatatcacctaacaagattattttctttgtgaacgtactatagtcaggtaccacatacaaatttagaacatattatgtggagagtactaatatgctgcagaatcattacttcatgtcaaatgtaaacatctaactgtgcactgagaattagttttttcatccataccttggaggtagttctacctgcccttacttaactcagaatcagtgggataagagtttgatactgcttatgaattggagggcccatgccacatgcaaactttattatcagtataactatgttataacaataggctttttgagcttgaaaaatgtgtcataatttaaaaaataaataatagaaagaaagagctcttcaaagaccataacagaggaggtaagatctgagctttaaaaaacatcttgacatcagaagcacagagaaggtaagggtgaacattccagagggaatatggtgtgaaaaaaatgcagagcaggaatggacaagaaacgttcagggaatggagacaaggcgatgttcattgtagattaaatctctcctttattatcaatataaaagtgaaaaatcgaagagaatgacaatattctgagcttttattccatagtaataacaaaagcctcatacaacttgcatctgaattaacttagaatgaggagctttagcgttgactgaggagaaaactaagtacttaagagctcaggaaggatacaaagtaaaattagcatcaattttctgggctcctttgcagaaggcttcccggagaaagggattttagaagaaagtgataaaggtgaatttctggaaaggatgatagcaaaaaagaatgccttgttttggagacttggggaaagctgactctgtgaatggtataaccaaaagtgaggtctgaactgtagtctttaaagactacaaggaatgttgattcagcctcactctattcatcttggtttcatcttcccctaggcaccatagccacttgaaatcctgcaggcaaaaatttcctacttattgcctcttctattctttgaagtttcctcctgtctagaaaaatggagcttatgtttagtttgagattttccacgttttcattcatgcacccagctctaatgtttcttattgtctccccaaaggaactctgtttcaaatgaaactgctgatcatttcccagcatgttgctttttctgtctttgctttctgcttttctcctcaatggagtatctttcactgtcctctcagccatatgagtttaatctacttttaaaatccaaggcttcagaaatcacttctctgaacctccctggctactttttggtttcattgaacatgtatttccttgtggtgttgtatttgcttatcttttactgcctttttcttgttatattggaaacattgtcaaggggctgtgacttgtaaccagtactacattgcttggtgtttctgaaaatgtgtttggtgatgatattgtagactagtactccatatatttatgacttagtcttatgtagactgatggttttcaattttatgtatttgttcatttttaatggaaaaccagagcttgttaaatgtgtggaaaccactagaacgtaaacttcatgagatgacttttgttttttttttttgtttttttttgtttttttttgtttttttttttggtgtagtaccatatcttcagcacttagttctagcccatatgtggcacttaatacattatttgttgaataagtgctgatttaatttacttaatctgtaggtcttcattggttcttttaaatatgtagtaagaaacctccaggatgttatctcaattaacaagatcattaggtgccatcccagtgtttgaaggataacatcacagcatctcatcattttttcctaggagaagaaaactttattttattttgctctgatttgtttctttttttgagacaagacagaagaaaaaaggtaagaaatcatagttggtgtaatctcactttagtttattcaacatttttggtcttttcattattgaaaaaaaattgcagtggaacagaagaaaaaatttgatggaaagactgctttctaatttatggaccttgaggtttggctttttaggtgtttatttaaggcttgcccactctgttctctacattgacatttcatggtgaatattttgcttattctaccctctgtattttttctatggcagcttgcctggcagtattcagaaactgagaagaatattaaagatcagaaccttaaattgttcactcttttttttttttttgtgagacggagtcttaacgctgtcgcccagtctggagtgcactggtgcaatctcagctcgctgcaacctccgcctcccaggttcaagcgattctcctgcctcagcctcctgagtagctgggattacaggcacatgccaccatgcccagctaatttttgcatttttagtagagacggggtttccacctcgttggtcaggctggtctcaaactcctaacctcgtgatcctcctacctctgcctccgaaagtgctgggattacaggcgtgagccaccgtgcctggctgttcactcttgacaaggatcaaaaacaggaactaagaagcagaccactaactttttccttttttctcttttcttttgcctttagctcaagccaggacagaacagctgcagggacagtgacagtgaaagtgccagtggagaatccaagggcttccaccggagcagctctcgggaaaggctcagtgatgtaagtttaagtaaaaaaaaaaaaaaaaaaaaaattaacgaaaaccactaggccacacacacaccattggttcaagtctgaattacataactttccctcatctttagaactttttgtctacccaagcattgcggttcacattatctttgtatacttatttgagcattgtagttatggtgtcattctaaaatgtcgtttgagcaaaaatgtattttgacaaatcattaggtaggaggaactatttgttaccttagaaacaacaaggccgggcacggtggctcacgcctgtaatcccagcactttgggaggctaaagcaggtggatcacctgaggttggaagtttgagaccagcctgaccagcatggagaaaccctatctctactaaaaatacaaaattagctgggcgtggcagtgcatgcctgtaatcccagctactcgggaagctgagacagaagaatctctgaacccagaaggcagaggttgtggtgagccgatattgtgccactgtactcagcctgggtgacagagcaagaccccatctcaaaataaataaataaattcccgttggatttctggaaggaaaaccttgtgagaatgcgtcatacctcttgagatatctgtttgccctctagatgtgattttcattgttctctagtctgcccaccaacagggcaggttccccctctattacttctgagaaccacctacccctctttggactctcttaccttctttactcatatgtcatatatcagcattttttttttttttttttgagatggagtctcactctgtcgccaggctggaatgcagtggcacgatctcggctcactgcaacctctgcctcccaggttcaagctattctcctgcctcatccttctgagtaggtgggactacgggtgcacgccaccatgcccagctaatttttgtgtttttagtagagacagggtttcaccgtgttggccaggattgtcttgatctctttacctcgtgatctgccttcttcggccttccaaagtgctgggattgtaggtgtgagccaccacgcccagccatatatcagcattcttaactcatctgtacctcaagagcaacacttggaaattcttttgtgaaatggatcaagtaaagagattttttttttttttttgagactgagtcttgctctgtcaccagactggagtgcagtggcctgatctcagctcactgcaaccttcgcctcccgagttcaagcgattctcctgcctcagcctcctgagtagcctggattacaggcgcgtgccaccccgcccagctaatttttgtattttcaatagagatggggtttcaccatattggccaggctggtcttgaactcctgacttcgtgatctgccacctcaacctcccaaagtgctgggattagagctgtgagccacctcgcctggcttaatttttgtatttttagtagagatggggtttctccatgttgaccaggatggtctagcattaacagaataagtgagagagtagcaccatgaaaaaaaagagatagcacttcagagtgtctgagtattaagaataaataaaggatatgtaataagaagcaaaatcttttattttctccattttatttttaaaaaacaccatactctaaagcagtgtgctgttcattatagagtgcaagatgattcattgagttccagaaagaaaatactagtactttttttcttaaaaaaagaaattaaactttactagtattcagtttaacgagcggggaataattgatgtctataatttttaaatacgtggatttaaggagtgtatactcaaaacttttttttactgagagatgtctactaacataaacggttggagaccactctagcacactgagcagttctctatgataataccacatccatctctccatcagccaaggtagacaattccgagatacaatcacatttctgcacctctcatgaaagtttgtgaggtttatgatgagatgttgtatgagatactgtattcttacaggaattaaatggaataaagtataattatttttatgttattttaatatattagttatagataataacctccccttcttctgtgatataatatcaaagttatataaataaagagtactaacagtattttactgtgtgtgtgtttctgtgtgtaagaatatgttttattgtgtgtccatgtgtctgattaattttgtgatggagctatacaaccataaaaccatgacaacttttcttatctaagttgttagcaataataattaatgtttaaatagctgtttttctgagatttttgttatacttttaatgtaagatctcattgactctagaaattattccagggttagtaggtcatatttttttcatagtgtagagaaatgaacgccatgttagtttaggggactagagctgccattggatcttttggcttgtttcctctaactcactttctgttagataaaaagaaattgacaaaagacattccatattcatgaatagaaagacagtattattaagatgtcagtactaccctaagctatttatagattcagtgcaatgtctatcataattccaacaatctttttttgcaaaaatggaaaagcagattctcaaatacatatgaaatggcataaggccttaataaccaacacagtctggaaaaagagcaaagttagaggactcacacttaccaacctcaaaactcactgcaaagctacagttaatcaaaacagtatggtgctggcctaatattagacatacagaccaatggagtagaatggagagcccagaagggagcccatacttatatgcctaaatgagttttaacaagagtgccaagacacttcaatggggaaagaattttctctttaacagatggtgttgagagaactggatttctatgtgcaaaagaatgaaattggactcctacatcgcactatgtacaaaaataaactcaaaatgaatcaatgaccaaaatataaatgtgaacaccataaaactcttagaagaaaatatacaggtaaatcttcatgaccttcaatttggcagtggcttattagatatgacaccaaaagcatgtacaatgaaagagaaaataaattggacttcatcaaaattaaaaacttctcacaccaaagagcattatcaagaaagtaaaaagacagcctacaaaatggggaaaagatttgcaaatcatataagtggtgtttactctacagaatgtgtaaagaactacaactcaataataaaaagataacctaaagcaaaaatgggcaaagaatttgagaaatatttctacaaagaagtacaaagaagaggtacttgaaaaatgctgaaaatcattaggtattagagaaatgcaaattaaaactgtaacgagattatcattttatacctagtaggatggttatgcttttaaaaagagaatgaaaaataagaagtgttggcaaggatgtggaaaagttggaatattcatacattactggtgggaatgtaaaatgacgcagccactgtagaaaacagcttggcagtcctcaaaaagctgaaacatataattaccatatgacccagcaatttcacttttaggtatataccccaaagaatggaaaacatgaacttaaacagagacttgtaagccagtgttcactgcagcattatttatggtagtcaaaaagtagaaacaacccatgtgtttctcaacaaatgaattgataaacaaaatgtgacagcttggctgataggcacacaatggaatatactcagccataaaaaagattggcattgtaatatatactacaatatggatgaactttaaaaatatgctaaataaaagcaagacaaagaaggacaaatattgtatgattccacttataagaggtatctagaataggcaaattcatagagacataaagtagaatagaacttaccaggaatttgggggatggagagtgggagggaggaaagctattgcttgttggttacagagtttctttttggggatgataacaatgttttggaaatagatagtcatgacagttgctcaatgttttgaatgtaattaatgccactgaattacacaattaaaaaatgatctgttaaaaaatgtaaaaataattagggctgtaataatgcttattctgctttcacttcattgaaaatatggaaaatagttataacttttaccagccttgtctactaattgtgtcacctgtgccatttctggtcctgtttctattggttgttttttctcttcattatgggtcatattttcctgcttctttgtatgcctggcagtttttcattggatgccagacattataaaatcctgtcagtcttatgtcaagccagtcaatgaaacacttccgattcatattgtttattatattttaaaattatgaaaaaaatttgtgggcatatagtaggcgtattgttcattaattattaaaattcacactttttgcaacattactgaaaaggaaagaaagaaaaatgacccaaaacgtggacatttactgaaatgttttgagatccctagtcacatttccctcactcatgtgcaggtctgaggttgcagagtcctgtgtcaagcactatggcaatctgaaatctgctgagatgaaagctttttttttttttttttttttttccgtgacacggagtttcgctcttgttgctcagcctggagtgcagcagcacaatcttggctcactgcagcctccacctcctgggttcaagcgattctcctgcctcagcctcctgagtagctgggattacaggcgcttgccaccacgcccagctaatttttcatatttttagtagagatgggcttcaccatgttggccaggctggtctcaaactcctgacctcaggtgatccatccaccttggccttccaaagcgctgggattacaggcgtgagccaccatgttcggccgagatgaaagcttttaacaaaccaacccacagaatggatcttttggataccaaagcaacacctacctgcacaatattttagagaataaagatgccccattttttcttgaaagagaattaacaattaatttatttttttacttttattttagttttgggggtacatgtgaaggtttgtaatataggtaaactcatgtcacagaggtttgttgtgacatgagtttcatcacccagtagtacccaatagttattatttcatcacccagaattatttcatcacccagtagtacccaatagttatcttttctactcctctccctcttaccacctttcaccctcaagcagaccctagtgtctgttgtttccctctctgtgttcataagttcttattatttagctcccacttataagtaaaaacatgcagtatttggttttctgttcctacattagtttgctgaagatagtagcctccagcactatctatgttcctgcaaaagacatgatcttgttgatttttatggcaatgtagtatttcgtggtttacatataccaaattttctttatccaatctgtcattgatgggcatttaggtgtagcccgtgtatttgctattgtgagtagtgctgcagtgaacatttgcatgcatgtgttgttatggtagaatgatttatattcttctgggtttatatccagtaatgggattgctgggtcaaatggtagttatgcttttagcttttgaggaatcatcatattgctttccagaatagttgaactaatgtacactcccaccgatagtttataattgttcccttttctctgccaccttgccagcatctgttgttttttgacattttaatattaataatagccatttgactggtgagatgatatctcattgtggtttttgatttgcatttctctgatgatcagtgatattgagctttttttgtataggcttgttggctgcatatatgtcttcttttgaaaagtatctcttcatgttctttgcccactttttaatggagttgtttggttttgtcttgtaaatttgtttagctccttatagatgctcgatattagacctttgtcagatgcatagtttgcaaatatttttctcccattctgtaggttgcctgtttactctgttgatagtttcttttgctgtgcagaagtgcttaagtttaattagatcccagttgtccattgttccctttgttgtgattgcttttgatgactttgtcatgaaatctttgccctttcctatgtgcagcatagtactgcctaggttgtcttccagggtttttatagttctgggttttacacttgtctttaatccatcttgagttggtttttgtatatggtgtaaggaaggggtccagcttcaatctttttttttttttcttttctgagatggtgtctcgctccgtcaccaggttggaatgcagtggcatgatcttggctcactgcaacctccgactccctggttcaagtgattcttctgcctcagtcccccgagtagctgggattacaggcatgtgccaccatgcccagctaattttcgtatttttagtagagacgatgttttaccatgttggccaggatggtctcaaactcctgacctcgtgatccgcccgccttggcctcccaaagtgctaggattgcaggcgtgagccaccgcgcccagcccagcttcagtcttctttaatgcctatcagagagtgaaaaggtagagtcaaagatgactactggtttttgtttttgttttttctttaaaaattccatattagttcttattatgcttattcttctttcacttcattgaacatatggaaaatagttattacagcttttactgtccttgtgtactaattttgtcacctgtgccatttctggacctgtttctattggttgttttttctcctcactatgggtcatattttcctgcttctttgtatgcctggcaattttttattgaatgccagacattataaaattttccttgttgggtactgggtatttctggtttctataaacattactcattttgggatacaattttgttatttggagatgtgtgtgtgtgtgtgtgtgtgtgtgtgtgtgtgtgtgtgtttttaatgtttgcttttgtactttcttggacaagaccagaacaacctttagtctaaagataatttttcccccattctgactgagtactttgcctaatgcctaacgtcttacaaggtttttccactgtagattgtgggaaaacaaactattccctgccttgtgtgggctttgtaagttcttcctcctccttcccagtggtggttttcctcgccttgggtattttctctcacagatgtgctgactagtcatcaggtagaaactagaggggaaccttctgcagctttcatgattctcgctttctgtgatgctgtctcctccttatcctctgccttggagttccagctgtctttgcctccccttattctcaactgtgtcttcaagactcagggattccacctgggtcacctcctacccggcaatcatgtggcatgaaaactctccaggcagtaaggtgggaaaattttaagggtcaccctacttttttctcttctctcaaatattattgtcctttactctgtcttacccaatttctaaaaactcctgtttcataccttttgtccagttttttagttgcttgaggtgggagaatacattcagtccctattagtccatcatgcccctgactcgtttttcagctaagatgaaaatttctgtcagcctttcacccattttagtgatatttttaggagctttggcagttgagacttactctcaagtgaggctaatcaaaatagtatattattctagctttgtttttttgaattggttaggccaaaagaataagaataaagaattccagtgtagctgtataatttgactcatgcgtaaagcttaaaaacaccaaatatgtggccaggcatggtggctcacgcctgcaatcccagcacttttggaggccgaggcaggcagatcacttgaggtcaggagttggagatcagcctggccaacatggtgaaaccccgtctctactaaaactacaaataaattagctggacgtggtggagcacaggtactcgggaggctgaggcaggagaatagcttgaacttgggaggcagaggttgcagtgagccgagattgtgccactgcactccagcctgggtgacagagtgagactctgtcttaaaaaaaagaagaaaaacccaaatatgctttgcttttctaaattatatattcccagaccatgttgcctggggggaataattggccacaaggactttcagattgtccacatcaaggagacatagtaacttgtttagattagtcactagggaagagttaaggggaataattgaatatatagttaataaatgtttatgatgagttattcacagggaaaatattgcttccaacttaaacagaattttgtaactgaggaaatttgtcaaaagttaggagcaaaacttacttaaaaacttttaataaacaagcctcaaattatgaaatgttaatgggcatttattataaacaggccaagatttaatagaagttctgctatttattgtgtgtgaccttaggcaaagaatgtgacctttcttccccgccaagatggagtcttgctgtgtcgcccaggctggagtggaatggagtggagtgcaatggtgcgatctcggctcactgcaacctccacctcctgggttcaagcaattctcctgcctcagcctcccaagtagctgagattacaggcatacaccaccacgcctggctaatttttgaatttttagtagagatggggttttaccatgttggccaggctgctctcgaactcctgacctcaggcaatccaccctcctcggacttccaaagtgctggattacaggcataagacactgcgcctggccttgttcgcactttcaaatcttcctacctttgcttattctttttatttatttaaaatgaattgcagtggcatgatcacagctcactgcaaccttgacctcctgggttcaaacttttcttgtgccccggcctcctgagtagctgggattatacacaagtgctaccatgcttggctaatttttgtatttttagtagaaatggggtttcgccatgttggccaggctggtctcgagctcctggcctcaggtaatccaccctcctcagccccctcccaaagccctgggattatacacatgagcctccacgcttggcctattttatttctgttcttttttctttctttgtttttcttttccttatgtcagcttcaacctcacttctaccaaacacttcccaacacactgtggaagtaaacttctttaatgctttatttaatgactatatgaatatgactcttttcacctttctctctgaaagaattttgggttgggttgttagttatgagaagacagaaaaatatttaacacctttcaagggttcagatcgttcaaggaattgaaacatctcagaaaataatgaaaatggatcaaagtcttatgagtctaatgctacacagttgtctactcttattattctggtagctatttacagttgagacattttttctgcttccttttgagataccccttctcctacttcaaatcttccctggtctttgggtttttattgatttgtctatcccacagtgccactgttcatccacccatgccagcatctgtcctattctttctttcttcctcccttccttctctccctccctccctccctctcttgaaatctttattgaggttttattccatgccaggttgtttgaccagctactgttaaggaggaaacagacttgagccactaccatgaatgagcttcccacattgttataattagattaggaaatctaatctcgacctgacaaggattcttggtgttttattcctctctttttaaaaaaatctgtgccacattttccttttccttaacagtttgcttatgcctttttccattcctgtcccatacatttatgaattctcctggatatgtcagtatttcagttgccaagaaatgtcaatcaaatttcttttattcatcaggtatagtctgggcatttgaggttgagtggagaacaagatgaaacctctgccctcatgaagtttccattctagtgggagagacaaatctattaagaaatagctacaattttttctaatagaatgttttctgacataaacaatatgaagggcgggagtttgttgctactttaactagtgtgattagataaggcctttctgtgtaggtgacattaaaactgaggcctaagtaaagaaaagaaggtagacaggtgaaggtctatgggaagaacattctgggcaacaggaacaacaagcttagaggccctatcagaagcatgttgtgttcgagggaaagaaaaatggcttgtgtggctacagtagagtgaagtagcacagtggctgaacacgtaacttctagcccatgctaaggaggctgggtgttgtattaatttcctgggctgctttaatgaatgaccacaaactgtatggctggaaacaacagaaatctattatctcacagttctggaggctagaaatttaacatcagtgtgtcttcagggctatgtaccctctgcaggctctagggaagaatcctttttttctcctggcctctggtgcctcccagtgatccttggtgttcctggcttatagatgcatcattccagtctcttctttagttttcacatggtttctacagcagccattggatttacagcccatcctaaatctgtatgaccttaattaggtacatctaaaaagaccgtatatccaaattatgtcattgtattagacttctccacagaaacagaaccacagcagaagataacagaaccagcagaacatgatttattatgagaaattggctcagttttggaggctgacaagtcccaagatctacaatcagcaagctagagacccaagagaacctatagtataactctagtctcaaggctggcaggtttgaaactcttgaagagctgatgtttttattgtgtctgaaagcacaataaagaactgatgtcccaggtcaaagccaggcaaaaggaattctctcttctctgggagagagtcagccttttgttcttttcagaccttcaactgattggataagtctcacccattttagggaggacaatccagtttactcagcatatcaatataaatgttcaactcatctaaaaacatcatcacagaaacacccagaatcatgtttgaccaaatatctgggcaccccgtggcccagtgaagttgcaacataaaattgaccaccacaatcacactctggggttcctggtagacataaacagggggacattgctcaatccatgacaggttattatcttaaaagccactggactatgttaaaaggattggagttgtagttcttactttaaaatgtttattttgcctttgatatgaggaactgtccatgaagacaagagcaagaatgaaatcagaggtagaagccagaaggctgagatgagagttggtgacaacctgacgtgggcataacagaaggttgaataattggtgttggaagtgacgtagcatttttcccacctgatgcttttatcaagttgttgctccatttttacttgatttcttccaacaactatatgcttatttctcaatcaaatatatatatatatattgtgtgtgtgtgtgtgtgtgtgtgtgtgtttggtcggctattagtaatcttatctccaaggtacgtttctttggattaagatttcaggtttttaaaacactactggaagatctgtgaatgagcttgttttgtgacctttgcaagaaatttacttgttcatgtgattcctggcatggtccttctcctttttactcccaagagagaaaagcataacatgaaggtgggtagccaggaatgttgaacacaattagcgatttggaagaatttaaaaatattcaatttaaattagccctagggtcagaacacacattctcacctaggggtggagtacacatgtgtcctgtctgtactcagggagctgtaacagtagccatggcctctctgtgtggatttataatgaatggagcacatctattttagatggataatcaattttgaaatcccttattgtaagtatgctgttaaaacagaaatgttaacttcatgagtttaatgagtagcttcgatgatagcttagtgaagagatggaaggaaaggcaagtggggggaaatgagaaaaggagaacaagtgtttaatgaatatctacttgcagacttgaatgtcagcagcaacattctccctcctggaaaatgtctttcaactgtgcatcccattatgttcctgcagcccgtggtagcatgaagattgagacaaagagagtgtttctaagaaagctctcctttacaatataatgagatggaggtgggtagtttgcagagattgctggagcagtggtcaaatatgaaaaaaaaaaatccagcagaatgaaaagaccatgttaaccaggagatggcttataatgagcccagaaattgcatatcagatagccagctggctagcatttcctcatatccctgtgttctcatgcaaactgctaaaatgttctcctactctattttctcagcctcttaatagttctcatttctacctactgcattgaaaatatgaatgaaatggcaactctaccacttgaagaaataagaatgaagcccttttcagcaaaagtatttgcctaaacatggatggatattatttcaaatgcttttgaaaccaaggaaacttctgtttctttccttaaaaaaacatcttaactttcaagtctcagtttgactcacagccttttcagtattctgtggcctcttttgctatatagtttggacagactttgcttgaagtctccaagcaaaaaaatggaagtcctcccttcttattggaaattgataggggaggcttggcacggcgcctcatgcctgtaatcccaacacttgggaagccgacacaagaggatcacttgaagccaggagtttgagaccagcctgggcaacatagtgagatgctatctctaggaaaaaaaaaatagctgggcacagtatcgcatgcctgtagtccagctactcaggaggctgaggcaggaggatcacttgagcccaggagcttgaggttgcagtgagtcatgatcttgatcattaaggaagagtcttgtgaaattgttcaatagttagggtattatcacctgtctactttcatggttctttaccttttggtgactgtctcttctttggtgactgtgtcttctaaaatgagaaagcagtaccaatccctaaatatacatctgtcaataacttacagcacatttgaaacaatattactgctgtttctaaacattccttttttttgtttttagcatgatctgttgttgcctgtgttcatataatttctgtcttggaaaattattgaagctaccaaatatttgcagctgtatttagatatagactttagattataaatatatgacagagactctttactgggccttttggatgcgagacctcagggatatatgatacgtgttgtgagcctcagctaaagtctgacttccctgtggctggtaacttctgttaccaatactttaatggtggggtcctgttggtgaccaggcgtaatatctcactgaatacaaggccgtagtcagaatcttggggttgtaggactagacaagcagaagtctctttatttaatagatgtcactcctgttaaaattctccagctatgactgaagggagttggcaagtagccaagaaaaatgtggtgaaaagggtttaagaggggaggaaatgtcaatgccatggacatttggcaaagtcgatcacaagagggtttttctacacatgtgttttctgctgatcctgaaatcaaaactgaataccatgcatcttttcccttaaaaaaaaaaaaaaaaaaaaaaaagagtacagtaggttggcacatgtgaatggctcctgatacgagactctgtatgctttctagcaaatgctgaaacaaattccagtggacctttaatgtatatggggatcttgtgtctgtgttccctcgtgtgtctgtgtttgtgtgtgcccgtgtctaggggaggggagttataaggcagggtgcttaaatgctttgttacattatgttaattcctcggcagtgcaatcaaattcatgtcgtaattaaagctgtcagttggaaggcaagccaatcgccatgaaaacacagcataacaaatgaagtgaaatgattctgcgtgtagctatacaatgcttcgccaggcatgaaattaaataagtaatttgatgttgacatcagaaattgaaatgatacccactgttccctcattcagtcagacctgcataaacaatagccagaacaaatatgcacaacaaagccctcttctccacccagctccctgagtaatgtacaatatatatgcaaaacgagcataacagagctttccgagacctgaaggatgtaattttctttggtatacgataagatgatatgtatgtgggggtagggaagtgggtttggtgggagtacttctctttctgggataaaatacatttgcaggaagggaaagaaatgaaataaacaaatcccatggtctctctgagtaattcatcctaaaatgagttcacttcccaggggcatgactccaagctggtggagacctaacttggcttttgctttcttctgctgctgcatggagggctgtgggtgctggaaacaggtgatgctgtcatatggctagtcactggtatgagaagttgtctccatgactactgtggatctccctccataccatttatgggattaagaatgcagcaggattttaaaaaactgagtgcagtgagcaggatcacacatctatggtgcttcattcccctgagcttgtgtgaaacgctgagatgaggaaagttttgctttgggagctgcatttaggaatgccttgaagcatactgttcttgtttgatgtagatatagttacagtaccatgtttcctcctcaaagagcttagcatcaagaagagtcaccatctgctgtatttttatagatgtcaaattctcctgagccatttttcttacacataatccatccattcatttatttatacattcattcaataagtccttattaaatgcatcctgtgtgcaagtcattgtgtgaagctctaagaagcaatgatgaaaaagccagctggttactgctgtctgaagtttccagagtagggggcaggacatgtaggcagaagagctagcagtgaacagagtaactgttgcatcagggcagaggtcattttgcttctgggaaagtataatacccaacccaagctcatcagggaagaagcctggctggtgcagggatgcttagctgagacctgcagacctattcagcatttgcttcaccttcatttcaagcttaatcacaaagaggaagaggatgctaaaaattaaataatttataaagagaggttttaggagaaaaaaagaaacaaaaatcagaatctcaggcaagtttaaaatacattttttgggggggcttcttttcccaaacaagtgatgccctgcattcctttcagaattaacatttttaaattccctgtgtgtcagaactatgacagcctaaactggtaattcttgtgacttaaacccttcagaaaaatggtgcttttcactgctcctcttggcccacacattctctgcattttagtctactaattacgtttacaaaatgtctcatttttgaaaagccctgtgtgtgtactaactgatgcctttagggaataaactggcaagtaggtcatacactggaaaagtcatccaaacccactgggctttttattttcaagtcaatctgggctttttcctcttgcctgcccctttgcggccacaaaactgagtagcttgagaccagggcattgaatgtcagcaagtcagggaggcaagctgatgcgtgtctgtttagtctcagtgcagggcgaaatgccatcattaattcattacccagctgcctgtcaaataaattggcaattacatccaccgcagaagcttggaattcagtaaatagcacgttagcatctctgagttgttgagagatgtaaaggggaaaattaagcaacacggtgtttgtatcagtagcagatgacaaggggcagcatacactggtgatgtgatgtggtgatgaaaagcctgcaaagggctggtaatgagctgtgtggattggaacgtgttaaaaaccattgctgattttccacttttgtctttatgctttattgcagagttcagctccttccagcttgggaacaggctacttcgtaagtctatctcaacttccacatatgtgccttgcattggcattgatttccttctataatgaatgctcattgggatatgaaaaaaaatctgagaatttctctctcagtcctaaagagcagactgatttccattctttattaggaattgttttatttttagaagacatagcctgctgggccctagggatcttaagtaagtccgaggtatatacctggttcctaacgcccaggacattaagctccttacctggccatgtaaggagatacagggaaccctgattagctcatgccaccatttctccacaattacttttttagtaagaagtgtcatgtgggggatggaattcagattatgcattgagataactgatttcttgaataacatctcttcatatacaatgagttgccttttttggtggggaggacggggaatggagatggtattttttaatgaatgttttccctcacagtctgggtagtttgcctttaggtttttctttcagcaataattaatatacttatttttgctaaaatgcaaagtttatttctgaaccttattctctgtcctttgggaaagatggcagtgaggtgacccttcagggattatcacaatattgtgataatcatgaatataaaattcattctcaaacagcagttgtcacttcattatatttatttatagtgaaattctcctttctggatttagtgacccttttcaagatacaaatgaaaaagagtgacaaataagcattatttgtacaataggataacatgtcaatgtaaaagtctgttgtgatgcttaaaggaatctgattggtgttctgagtgatgaacactgatacagtcatgcctcagtattttctgagaaaatagtgaaatcatgaaaatcaaataaagtggaaaataattactaattcactttagttgcttttaacttttctctccaatgctaattactctggttttcttctgcccacgtatttctctcgatacatttacattaaatttatggaaaccagcatcatttcattaataaatgagtattttccaagcttagcaaaagtggcattttctagatgttgacttttttttggtcttaatctgtaataggagaaaaagtataaggatgatttggacctgcttaatacagttagcacacttacccttgctcctacttattgtggctgaatattcatgctaacagaaacaagcaggatacattcagtatcctgcttcagcagtcgaaataacagacgtagccccatctggcatctcttcacaccaggctggatgtaggttgagatgctggaagtaaaatctggagactgcgatatctattctccatccaaaagctaaagcctccccctttgctttcttcagcagaaagaaggccaaagccactaccttagtccttgatcacttctgtactgaacattctagtattttttttttattgtcagtaggatcaccctgaaagaagaaagtcatttctagaaacattgagattttcattatgctttttgcagttatttttctctctagttccaagaatggttatttttattctctaataatatattcttatgatttaaagagtctttaattacatgtctattaataaaatggcttttacagaacattggatgagtataaaagttttctcttattttggtaaaattgctggtagacttactttgcttacataaaagtctgtcgtattattagcttacatggagaagatacataccagatgtgtattcagctttcaactgtgacaaaaatgccctgctaggatgtgtttccaataatgtgattgttatgttatcagagtgcaaaatccattgatattgttgcccagtcctcatgaaaagtatcttctatttcaactttctttccaatagtatcacatgtaataatttcagatactaacttccacactggtgagtttcatacttctaagtggaaatgatatgggcacaacttacattagttctttgccaacatattatttacactgtgctttgtgatttgtgctgtcataatagctttttacttaagcctgtaaagaaggctcagcttcaggtaagtgaaatggtaatttttcaagtctatccttactcctcttcagcatgtctttgaaatgtggatggagggaaatcacctgcagagtccatgagctattagcgcaattgaaccataacatgaattctggtgtaagaaagctgaaggcacttttaacaatctagaaccgttttcttgaacactgtcccaagccccaacttcacagacttcctttgtttctatttagagcttttgtcaacagaggtaagatgctgttcattgtgtttgttaataaaatagacacctgagtatatacatgtgcaggtgtgtgtgcatgcacacacacgcatacacacccttagccaaaaccagtatattttactttcagttcttttatctgtagtgatacattcaagggtttaaaggagaagcctttgtttttgatctggttgtatttgtttatatctccttggttttgtgttccaaagatgtctgcttaggtctgtcacttttccaatccgtttagaagcagaagatttgagaaatgagaacagcagctcaaatcagtatttacataagcatattgcaaagaattcttaaagtagacaaaatagagaaggattggaacaaactttctacatttttgggagcttttgaataatgtgggtgttatacacacagagagacacacatatatattcattacatactcatgcccagctcatattctaaatataaatgaaagtatagactagttggaatcgatttgctttttttttttcttttttggcaagaggactaaaacttgttagagtgtgtgtaggattttcttttttttttttgttttgaacgtcaatgcaatgaacacattttcttttcaatttaaacgttttaggctgtattttctccttaaacatgtatttgaggtttcaatttgcatagtgtataattaagaacttagaggcagaatgatcttttaagactacctgtatgaccttggtccggttattttatgtctctgagtctatttccttatcaatacctacctattagtgttgcaaatattaaatgagataagatattttaatgaacacagaatatcactctatactaccaaataataagtactgccttctgttattcacacaatcgtgtgtgatggagcaaagttggtctcatcaggtggctgtgcaatgttgtgcaaagtaggttttataatttgtacctgtaggatagtagtattttattcttattatattcttcttgtagctttctcaggagcacagcttttgtatttgatcagttatttacattttttctgtatgtgaacataaaacagggtattcatcctctgtgattctatatgaacatgacgatgttggaatgaactgttctattagctgtccacatattatggttgttctctgtaatttgtcagttaaagttacttgtgtattttcttcctcagaagcatttgaagtacttggagcttttaaagactgcttagcagcttttaggattgggctgagagggaaggtacacctgttcaatatattccacttttatgaacttgtatcacatttgctcctttctgacaagaaaaagaaaaattgatgccctagcatatatgaacacagtaactgaaatcagtagaatgaaaagaccagtgagaacatttcgtgttggccagtggtctggtatgtcatcacaggaaagatctggactcattctttatagcacttgactccatgtggagttgggagctacttttggggcaactaaccagccaggcagaacttgattcctgctgtaagggaagtacagccttacttttttccaagtgacatgttctgccttctctggataattttcagccctcttccaggtttgaatctaactgtcttagaaccacagcctcaaatagcttgtatcctgcttttgtaaactccataatttctcttaaggattctcaactaataattttcatcttcctcaattgggtcacatctagtaattgacatactttaaagttatcagggaaaacaactcacttctactcagtgattaaaactgccgcattatatagtaaaggggaattgtgtagtggtatacatcttcagacgggatttgtataattattgttttcctgtgcagttgaattacttaagttgtgtaggtagtgctggtaacaggcagtaggtgcaaaatattgacctgtagctttccatccagggttataaaggtcatagtgggaatattctttgcccctttctaagtttttgactataaacccttgaaatatctcctgttttcctttgctataattttgtataacttcttcttttttctttttgacagggtctcactgtgtcacccaggccatagtgcagtggtgtagtcacagctcactgcagcctcagcctttctgggctcgggtgatcctcccacctcagccttcccagtatctgggagtaaatgtgcatgccaccacacctgcctaatttttgtattttttgtagagatggggctctaccgtgttgccaaggctggtcttgaactcctgggctcaagctatctacccaccttggcctcccaaagtgctaagattacaggcgtgagccaccatgcctggctgtataacttctaaaactgatttggtattctgtctaaccatagttgctttttaaccattttcccatttccccagataatactcaccagtggtgcttgcggctgcaacatttatcttgatgtaactgccagaaaatatcttgcttttattattttcccattgctctagtatattgactttggaaacaaaagacgtcattctactcatagcattctattttcagtagtggtatttccatttataaaatatagtaatttttataaatgccaccatgcccagccacttttaaatatttctgacacattgtattcatttattttctgggggtgaattcttttattagaacattcaaattaataattttgtttggtttgcaagaaaactgatgccatcaaggaagatgaaaagttactacacaaatttcaacaaagatttctataatttataaatgagggctgggcacggtggctcatgcctataatccagcattttgggagactgaggcgggtggatcacttgaggtcaggagttcgagaccagcctggccaacatggtgaaaccccgtctctctaccaaaaatgccaaaattaactgggcgtggtggcatgcacctgtaatcccagctgctcgggaggctgaggcaggagaatcacttgaacctgggaggcagaggttgcagtgagacaggatggcgccattgcactccagcctgggtgacaagagcgagatctcaaaaaaaatttataaatgaggttgaaaattcattttttaatttaataatcccagtctcagatgccctttcattctttgaatttgcatatctctataatatttctctttcaaaattttctggttgtcttatatataataccttgtataagctgatctagcagtggctagataggatcagattcaggtttggattttggcaaggatgcctcatagatcatgttgtgtgcttcaattaggagccacatatttagttctttatttttattaatgttaacagccattgattagacccagtgttcgttaggagctgcaaaatggtgatattgcagttccatcattctgtaaagagaaacatctacattaactacaggtatttggttatcctgaggtacagttaacacactgtatttgaataagagggtttgagctctccagagaacctatcactatttataagatttcttaggggttttagtttcagaagtacagatacatcaacttggtgctgacggcagctccatccaaagcagaagaaactgtcttcttccccacttggcagtacttgctgtgatgctaggaaaggattttgtaattcaagtgttcattcatcacctgttaagtacttatatttaagataaataacattaagtattttaacacttccccccaaataaagaccctaatctttgtatttattagtaattaacactaggtaaattaatttttggccattatatattgacaaaaatctattataatggaaatatttttgaaaatctaaattttatctagaaatccatgaaggatatccagttattattagggcatttggactaattgataaggagttgagttggaaaactactctccagatggagatttcaattcattttaactcacaagtatgacttaaatatctactcttagttcttaagttgcataacgtgtaagcatggctctcaagtcaaagatatgtagctgaatttgaagcaaagcaaactgattggtctatgagaagtgtaagtagagcacttggaagtataaaggagggtcagttaaatgtagcaggcttaaattgtgcagagcttgatggatgtttagatagtcaacaggaaagaaagggtggaacaagtttgaggcagggggagcaacaaagacaagaatacagagaaattgcataatagtgtggattgaattgactgtatgatgtctctggagaaagacgggacttagattgtcagggaatgttggttgattacagggaatgtgggataaagccagggaggtagtcgggtgagtggggaagagatggtttgtagagaaggacgtcaagtaaaggatcaatgactacaatactcttacttggagttagtccccagaagaggagatttgaatgtaggaaaatggtgagtttggaagttagaatacgtagttagaaatttaagtgtgtatttaagtgtaacttaaaatctaggacattaccaatgcctttgaagctacctgtgtactgtgcagaaacatctgggcaaacgaaagttgttgctctcccttatggtgaaacattgtcacattttttaaatgtaaccttcaaaatactacccttaactgtgttttttcctcctagtaacaaaaccagaatctaaggtgcattctgacagactcctccacgtggcgcagataaactctctaatttcaagggccttagacagaaaatataattgtatttcccatgtctaattcttacccttttttggtcatgtttttgatctgttaacattttaattgagggaataggatcagtgagccaggagcagacacaccttgactaaatgaacagtacaagttaaactgtggtgagagacatttaaacatttgtagaatctctacaacaggatgacttttccagcacactctgtagaaattatcttctgcctacacactatgtttaacttcagcttcctcattcagtacaagggaactgagaaatttgacaaaaaataatcaggtgagaaaagatcaattggtgtttccagttgcaaccaataattttaaccctttcattttctcaacatttaaatgagggaataggctgggtatttttaaacatttgctgtctacaggaatctttgacattgctgttgcaaactctttaaggagataagcggaaaacttaggtgctactgatggatgtggggaaatagccctcagccgttatctctctgtcctcctaacccccatctctggcccctcagatttagagggaaaaaatgattttggagaacaaagatttaatgagccactaggcaagagagtggctaaaggaccttaatttctaatatttcaaaatttatgattccagctgccttacaactagatgtctgccatgtgcaaccattgcttgttgctggcctcactgcctttctttgctgtcctttgagccacaggaatgcaaggccatagtgctgcttagtgaacactgttcttcactgtcaacattgaaaggagtcctgatttcaacggagtggccgagtctgcttttgtttgaaagtaatgtattttaaaattcattatgaacaataatgcaattattcataatgaataatgttttatatttgcatcattcatttagggctagtacatagagatactgaagctgttggcttagcctgttccatagctagtagattgatcatagagatgaagcggtaaaggctttagcacagtgcattgacagtcccagagggaatggacaggtcattgccatggaattctgaaaataattttatcttcattttcatctttttttctgacattggctttaaggaaggttgtcttatccttgttggagatttccacattacagaaatttgttgcatttgttgatacaagctatgtaaaatgacccacaggcaatgtcaattccggaggtttactctgattacccacacaacccttattttgatagatttaactagcctggagttttattgactatcactcagaatctttcagatcagagaactcactcctttgcttaactacttaaaaaatatttttgctgaaattgtaaattagatgcctcccaatccattgcataagaaacttatagcttggtgaaacaccaagagtatcatttgaaaaagaggttaaaaaacacaactggggcttgttaaagaggaaaagtggtattttaactccaagtgtcacattttcctatagtcagctctagcagtaaacaagagttattggaggcttagatagtttgagacacttcacttatctcccagtacttgacttcagaagccaaacatttaaaatgtgttttgctcaggtaaaaatgtttatccatttaaaatacaatgtcattttaacaaaagcaccctggtgacaagctgtttagatatagcacagttgataaactgtcagatcctgtacacatacacttgaaaggaccagcgcagtaacacaaggattggcattataaatcactgttaacaaaccttaatttgcttagtaggctaatgaatgatctccaatttttcttcagtaattagcttcgctaacagccatgtcaaagggaccttccttatactgtatttaatctctgctctgaaatctttggtgtctagtttgcaggatgaataaaaacaaacaaaaaacatttcggtctccattggcgactccctggtaataaatccagatgtagggattgtggctgttttcaagtagaaacattgccaaaggtgatgactgtctattagggcttgtaaactgtaatataatcacagatttggaatggagtggtgaagccagataattgcagtgtttcctgtctaaatgtgctgctgtgcgtagtggcctctgattttaaggagctgttaaaaatgcagcaaggcataacagctgtggttcctagaatactcctaatatttcatatgttcatcacatctcataaaatcttgcccagaccaacaaatgactacttatctgtacagctggactgtcttagaaggaaattagagaaagtgtgaatcatgtaggttagcattacagagacccaccaagagctcatccaagcccgtgctgtgccatatttctcttactgctcctcagagttctccctttccatttttagtccccaaagagaacatttgcctcttaccatttgtgagcagatcttatcaataacttactttttcctacctttgtggaaaatagactcaactttgccaagagaacttagggttctggggcagagaaattcaggcgaagttaatatctcaacccaaaatcaaaaagagacaacaaatttagttctcttagaattttttaaaattaatttttaaaataactttgcaatagaactagctctgtgatatgaaaacctggtttttctgggaggaacattagtactaggacattctgggaagcaaaggaagctagtgaacccaaaatgttcttttaatcagatattaaacagctaagcatcatgaccaaatggaagccttaaactgcatttgtacagaggcataatagagtcacaagttgttttcgcctaattgtttctaaattgcccactttactaatttgataattacagtagacctattattttggttttacataggtccagagttacagaacctctaggtcagaagggacttcagaaatcaccttacccaatcaccaatctgagacatgactcaaaaagttatgtattattagagtaggctgacaatttggactgtgaccttgctcatcctggatcctgtccttcagttgttatagttgaaagtcacattaatttttctgccatgccacagtgttttcttgatgtcagtgactgttttcatatgtgatactgttacatcttttttatcaaaaagtctaatggattctgtcttaagaacgagcctttattgaaaaatctctgttgaagtttgtcatggtatacttagtatacttggcttattactttaacttatgtagattctgtcatgtcatatattgttgttgcttttagttccacactggtgaagatcatcaagtgctacaactgtctttgtggcagttaaatttcagtgctactagattttactcattgctcttcttgtaatgccccacgatttgatttacgctggctgagtattacaagtcctatgtatttctttccattggtgattcttatctggagctttaacagaaatcagacattgttcctctgttttggttatttatagatacatctggaaagagttttgagacaacctgtgggcatacttaacatactgtaccttttttctttgtagccatcgtgtacaactgctttaaaaaaattagctggacatggagaagtgtggaaaccattgttctgttacacaatggcaaaataattgaccattaaaatatacctgtgatagacttagttgtgatgtggatgcattcatggtaagcctctctgagttattctaatgtatgtgaacaagcagtattatgtaaaaatagaggaaaggatatgctataaaagaaatacagtttgatacagtatttatgttttaacagatatgcttgagtactttaaatagataaatgaaaaaactttctattatttgtagtaggtctatgttatacacagtagtgtcctgagaaattcttgagttgtgacatacatataaattttgaatacagaagggataagttcattttagaaattactgcaaattttgaattggtagagccatcaaatttgtaaagcttgggtcacatttacttctgtgcattgagtgtcattacattctgttttctttaattttcaaacaaagggttgtaccacgcttctctttgaagaggccttttggtttcagcacatctatgggtacgttgttaacactgtcatacctccagttaaggaatggtacacgtttagagactgctttttcaagtcaaggtgccaattatttcctgcctaagcactattttagtgaactcactttagtctaaaatcacttgttatttatctcagaatgttattaaacaaggataaaatcaatgcaaagccagcgatttatgtaaatcttataaaagtttgattttctttagatttttgtgactaacagcctctcagtcttccttggacaggggagtggttagagtttgggttccctaattctctcatcttacagcctaagctaagcctcaatggttgatactgaagttttgtgaccctcgttcaatgttcagaatctattattttagtacttttagtggggaaaaaaaattctgctttacttcttttcctgctgtgatgtgtacattgtgttatttttctactgggtgtgatttttgttatctttttcagcttcattgaccataattttacttattttaattaacatggatcttattaacagttttctctcctgtacgtttgtgtttgtgacatactcttcactacatacttgaattaagtaattttattatttttcatctttcagcagtatgcttattcttggttcatttactgttttgaagcaatggaattacttacatatttttatttttccttttctctcatcttctgttttccaacctctacctccatttggtcctataacatgataaaagtgcaaacatgagcctgaataataaaggattgcttcactgattgctaaacatatattatagtgctttaaaactcatttcaggtcatcgtggtggcaattagtttgattacaagcatttaagctgtcacatagaaagccttccacttcctagggcttagtttcaaatcatgaaaactgaatgctctatacttatctatgtacacagctcaattttattattttggaagaaagctatgcctgttacaaagatcactcataatttcagaacctggttaaagccagtgtgcaattttggagcagagacacaattttattaaaaaatttaaaatatgcatgtgtacatatatgtaggtagggactatcaaaagagatgtcaaaaccatctatttattctcatttttggatacagtacacattaccaagttgttacaatgtggttatttaaatatcatttgggccaggcacagtggtgcatgcttatagtcccagctgcttgggaggctgagttgggaagatcatttgagcccaggagatcagtgttggagtgtgctataatcatgcctgtaaacagccactgtactcccatctaggcaatatctcttaaaaaaaaaaaaagtaaaatcatgactctcatacattatacaatctacatgtttaaacattttatttaataatgacggaagtaggcagatgttataactttttcaaaggtaaaccaaaagaaaatccacagttatagatgaggaatattgaaatgagtgtgtagatggaggcagaactggcttcaaggaagtcagctgagtctctacctcacatgacagagtttacatgatgttagagaatgtttattttgcattgttatcacttacctacaacttccagacttgtaaaatagtttccatggaatcagaaattaattatgctggagagtgtgctatagacgatgcctagtgtttccttgaagcacatgttttcctatttgatgaaaaatagtcttaaaggaaggtttgtttatttaaatttggcctgatcatttacacgggtgtaccaagaatgttaatttagcatataagccttttaaactttgctttctctgatgtttttacaaaataaatctcctattgcacttttaaaagtattatttgctgtcctaagggtggaaagccaaacccaagaatcacggaaaggatcactgaaaggagtgatcaagcatgatcactgaatggcactctagaagtcttcactcagcccactggtctttctgtcaccggcagtacctgtaaatttgggtgaatttctttcttcttgatgttcccaaaatatcccaaagtaccctaccaagaagtgatctctctttccatctatgtggctggattctgtaaaccagctaccaggctagtttttctgggaggattggtactttatagagataaagtcacctttaattccctgtaagtgtttaatcatatctgattaaatgagcattactcacaaataggacattccagacaagatcttcaagatttttcatactcatcttggtaaataggaaggccaatttttactgaacccatgtaaataactgtgttgctatgaaaagtaagaagacttagagtttttggattctggggtgtcagaataagattccattttaaaacacttcatttcagtttataaaatcagaattgttatgagttataaatagcttaagaaaaaagagagcttccttatattctcagataatagaacactgacataagaccaacaatactcaaaacaatcatccttcatcatttcattgagtcctgtttaattaattcttgctgtactgaatcttgacttattaatctcatcaactcatctcatgaatttcttgactgaaagaagttctggaaatcttgactcagcccactggtctggtcaaagttatttaagcaatgacatcagaaacctgtacccaagagtctattctttgaagtcttaattattttaagtacctggtgcagttttttttttttattgtgggtgctctgaggttgtctttcttatttgaaaaccagaactctgttctactgtgttactgaatgcataactttcaaggaaacataaaagtaaaacaaaaaacggtgtaagtgacagactttacatggctgtggttaattttcacttacaacttttaaaagtgaaaaatatgatgagaatttataacaaaaataatgtaacgtatttgattatttctgtggcatgtaaaacaaagctagtaaagaatgttttacacaaaactatttaagcaaatgagctcatagaaactatgaagattttaacatatttcattacttttcagactcaggtattacaaagcaaggtaaataaaattcactttccatgttctgttctcattatgttctttcatattttggaacaaaataatactttacttcaagactattcatagggtgttccatgaggtcagaactacttccatagtatttctaagatgttattaccatgcagtatgctcattattgctagtttgaaatgaatcagcaagtcagcattttaaatttttttaagttccaatttttaatgttgtaaatatcaatagttaaaacccacacacactctcatagacacaaaataagctcattgaggtcctcaataagttttaggagataactgtaagcggtttggagaccaaaaatcttcagaaacattgcattaggacacaggtgttcttttccttgaaaaatggcagcatacacataattatatttcttagaaactgttgcttctagatatgatgtcaacttcttgcattagttttaatttttaaccaaattaactaacttctatttcacataaaaaaactgggggatagttacgatcttccttttccatatcagcattttagaggagatcatgaataaacataaccaactttctatagccacacacatctcttatgcaccttcataaattgacaacaatgaacacattcattaacttgacccaaagatagtcttctctgtagattataaaaataaaaagcaaaacgatgaaattttaaattatgattagtgctcagtgttttagtattctatcttaattagaaatggtgtaactatccaatgaatatctgttaattaatttaatatcagtctgaggtttcaaattacttaaaaatcttggaaattatgctcaagccaacatagtaagaagcataattactattgaagaaaagtttttgagaatattgatgcagtttggtcaaagaaaaataaagacaaacataaacataaaatagaaataatgctagcttatttggccaggaaaccagtatatttttaggtaaattatctagtgtagagttaaaatgtttactcatgtacttaaaactgataaagaagacttactgtttttattaagccaagatttattaaactaatcttatttggcaaagttacacgtaaattaagtgaacttgagttcataaaatgtttccgaggtaatgtatgcaagaatttattgtttaatttagtacatttaaatggttagagattcaattcttttctgtgaattttaggaatatttagtatatgtaagcacttacactgaataaggctattagaacaaaactcctttagtcttagagactttataatctcattattaataccatctgaggtaggaaaatattgtgcacacaatgaaaggtaaaggtacttttgaattgtagaccctcagatgtgtagaaagcatacagttccaattctagaatttcagccataggtcaagagtaaatacagaaacacaaaaagtttcactagtccaaattgcaaagagctattcctcttcccagtagacatgctgttcttaattatttgagctcaaaacagacacatagaccatcagaaaatactaacagactagaacttttttttctcaagtgttttaagtgatagaaatctaagcttactgtgtggcacatttcttaaagaagcttttctgtgtttaactgtacattttgtagttagcattttcattctcattgataaattcaacagacagcaggccagtcagcctgttttaggttctgtggatatagcagcagtaaataagacaaagtttctcttttcatgacactcatagttaatcaaattaatccctaatatgccaggtgataataggaatctaaagaaaaatattcatgaaaagagttgggctttcagtaaagaataacagggactgaatttattgttctattagaaacaaccaaaacaaaagataaaatacatgacacaatggtttgcatgacactggacataaggcagtaaggacagtgatccctgaaagaaagtaaacaaatgtagtcatctctttgagtgtcccagcttcctgccttgagagaattccaggcctccatgcagggcagagggaattcagaagtaccaagtggaactcagtagactttctgcattaggagaagatactgagagtccaggaagaacaaggtagcaaaaattcaaaggacagagtattaggggggaggggtgatgcacggagaaaggatcccagagatcttcagaggattgctttccgttattcattagagagttaattagctcatgcatttcaacaaacttcctgatgcctgggaaagaaccatccagaaggattagaggcaacagtgccttacattaacccatagccaggaacagtgctgattctcaccagcaggattggaaaaaccactagactcatggggcatagagtcaagtacatagtagggtcttgtctcagtattgagaaataatcagtcattgactgagcagtgctacagtttgccgtgacactttttattttttatctttttgagacagtttcattcttgttgcccaagctggagtgcaatggtactattgtggcccactgcaacctctgcctcctgggttcaagcgattctcctgcctcagcctcctgagtagctgagagctaatttttgtcatttttttagttgagatggggtttcaccatgttggcccggctggtcttgaactcctgacctcagatgatctacccaccttggcttcccaaagagctgggattacaggtgtgagccaccacaccctgccctcccagcacgtttaaaatgtgagttctgatagggtcaaactatttcaagtgacttaactgaattctaaaaccattttatggcattcaattacgaattaccagacattcaaggaaccaggagaataagacccataatgaagaggaaatcagtcaatcagaactgaatcagatgttagaattaacagagaatgatattttaaaaattatagtggtattccgtatgttcagacagttaagtagtataagagcaaaattgaacttctaatgtaaatactacaaggtatgaaataaaaaatatattatatgggattaacagcagattagacattgcaggagaaaagattagttaacttgaattcatagcaacagaaactagccaaaatgaaacatgaaaagattagagaatttgcagattgaacagagcatccgtgagctgtgtgaaaacttcatacagtctaatgcatgtaaattggagtctccagagagaggagggtgagaggacaaaagtaatttccaaatttgatgaaaatagtgcagaacatcagaaacataaagaaaattacaccaacacatattataatcagatttctcaaaaccaataagaaagggaaaatcttataaatagccaggaaatagtaaaaagacataaatgcagaggaacaaagactgacagcagatttttttttttctggaaaaaaaaaatgcactggagcaacatccttaaaagtactagaagaaaaaattgccaacctagaattgtatacccagtgaatataactttcaaaagacatggataagagaatgagatgataatccacaggctaggagaacagttttgcaaagtttgtatctgataaaggacttttatgcacaatatataaagagatcttaatattcagcattaagaaatcaaaaagcctagttgaaaaacgagcaaaagatttgaactgatgtgtcactaaaggcaatatacaaatggcaaataagcacatgaaaagatgctttacatctttaattattacataaaagcaaattaaaaccataataggtatatagtaatatattattacacacctattaaaatggctaaaatgaaaatgactgactacagcaagtgttggtgaggatattgaggaattgcaactcttttacacactagtgggaatataaaatgtacaaccataaactctagtttctctttagatcatgtaaatctttcccctttttaaagatacaaccaattgagagaacagtttgataatttattaaaatgttatatatgtatgtacaatatattctagccattccaatcctgggtttttacccaagagaaaagaaagcacatgtccatacaaatattttacatgaatgttcatagtagctttatttgtaatagccccaaattggaaattggccatatgttcattatcaacttaatgaatgaaaatttggtatattcatacaacagaatactacttagcattaaaaaggaacaatgtattgatacatgcaacaacatggattcatctcaaaataattatcctgagtaaaaaaagaagccacacaaaaaaggtacatattgtatggttccaatttatataaaatgctagaaaaagctgtttaatctacagtgacataaagtagatcagtggttgcttggagaggcaggcacagaattgggagggaggcattaccaaggggcaggagtaaacttttgtaggtgatgggtatgttcattatcatgactgtcaggatggctccacagatatatttataggtcaaaatttatcaaattttatcctttaaatatgtgcagtttattatatttcatttatacttcagtaaagctgttttaaaatgattataaaaactatttccctgctgttgttaacaccctgagatgtctgcctcttttcctatctttctgtgttttaaatacaccagcctactgcactttaatacctctctagctcagacagctacacacaaaacttactctgaagaatgtcaaaatgcatgttttcatcagagaaatatctcatggtcctttgttaaatgttcaaaaattcatgattgggctttataaggcaaatatgtcctgttttatagaattacgggagagaaaatgcatacaaaagagcccaatcctttttttggctggcttttatgtcagagctcaaaattgctctctgataaaatgtaggccaccagattgaattacttcattgaaccactgctgtcctctgttaatggtaattgcacagatatagcagtctttctcggcaacatctcagatatttacctcccactgtttttcaattcaaacctttgatgaaaatattcccagtacttctttaaagcagacatccaactgtctttcttgacaaaagcaaggtctctaaatcagatcctgacaatttgtgacacagcagtctatccaaatcaccttttacctatgtcactatgtcatttcctgaagaaaaaagtgtccatcagacaagcaatttctgtaggttttgggggctggaaggttggtatgccagcaaaaatgagagaggaaaagggaaaaataattttttcctttgacttgtgtggaaggaattcagtgaggggttgaccagatctaataagcaaaagaggggttttgtatatttaaaagatacatttttataaagagagatctatagatatttgttattttcaagatggtaacaattgaaacttgaatctagtgatttctgaaagctgctccctttaaggagacagggaaacaaggttagtttttttttaattcttaactttttctgttagactactttaatatgacaatatttagcagtttattttctcgtcagggattcagctcagtttctggtctacctcctgtcctgaactgagcagactacatttcctcacatgaaggttgtaggttgtacaaacaatgccactggcatgaaccatgatcagcgctctccacttgactcatggtgactttggaggctggagtgcagcacatggtaaccaggagatcagctggatcagcctcagagtgaaactcgctgctattatctctttggctatggttggttgggtgctttttttttcccttttagtattggaaggatataattgatacttgctttcttggatcaaattgtagcatcatatgtttgactgatgggttagttgtaggagctgtcagagcccccctgggacctgctttacaggtttggtgaatgagcagctgacagcacagcaagcacactttctgctgccagcctggttttgttcttcccaggtggatgtttcattataggaatgggcctcaaaataacatttgcccaggaatatttctagagagtggtcatctttggtggcactgttatggtggtatgttgctcatttagagtggtctcattcaagcaagacccatacatcatttggggagaacagtgaggaaaaccgtgggctgagctctggggagggttcgatctgggaataaggcatgtcctagaatctcagtcaggattctactttcaagagacagtgcaaggctcctaggaagttggggccaggaggtaattaaagaggtagaaagagaaaatcttttaaaatcaagtttctgactgcatgggctcttgaatgtggtctttactttgattgtggcctcaacatacaggtggtagcagagtccttgaagggcccttgacttttttttttttttcagagatcagggaatttgtaatttagaaggagaaaactggcactcttgtgccagtaaagcctctgctgatagctgtgtgccgtttgtttttaatcctttctcggtatccgtctctggccatccttatctttactagaaatcaaaggctgtgaagggaccaccagaaaaataaataattcatagcttttcaaagcctgagccccaaatactcaactttcaaagcatgagccccaaatatcccttcccttgggcttgaatttgctaaactggagcctgtgtttactctactagggtaaccaagtattcaagagctcagagaaaaaaggactggccactatacctctttggaggtaagagaggagcccgtgtgagttcatgtgtagaagaatcactttcacctggaatagaatgtcaatcccagaatctcactatctggcaggcaggaagtgataccagtttctggcttggaaaggacatctgaaggatcctgttggttttgttttgttttgttttgtttttttctcctgttggttttgtctgctgacacgtgggtagtgctgacccagtgtctgaccggattgtctccatccataacttcatctagccctgtttacaaaagaatgaacacaagtgacagcctcagtgaacctgcaccatgaggatgcccttacttctcccacactctcactttcttctcttcttggctcctcttcccctgtacttctctctgttgacatagaatatgcaaagtccaagagatgtggcaatgccagtaagagctaagttacttgcagctggcggtgccacctgtgcctatcaaatttcagccaaagcaattgctttcccagaatgccctgttttggggaattggaaagtgaatctgtaggggcggcaatggctgtatagaagagagcttttctctgggctcaaatatgaggacaaaattgtgaagtaggactgtagataatcccaaatccccacttttgcatcttcctgagctcagaggcaacccaagagatttccgagttaatcctttggactttaggtgaactctcagctagaaccatcgtttgcaagcagatctcctgtggaggtgacagttccataacctatcctggtggttgtatagttgagaatgtttgtgattccttctctctccacaagacctcaccacttccagttatgttcattttatttttgtttagtcatttttgtgcttagggaacaatttttcagctttgtactctcacctcataaaagtcctttgtatcattgtgaaaaagcaagtcaaggcctggcgtggtggctcatgcctataatcccagcactttgggaagccgaggcaggtggatcacgaggtcaggagtatgagaccagcctggccaacatagtgaaaccccatctctactaaaagtaaaaaaaaaaaaaaaaaaaaaaaaaaaaaaaaaaaattagctgggcgtggtggcaggcacctgtagtcccagctacttgggaggctgaggcaggagaatcgcttgaacctgggaggcagaggttgcagtgagccaagattgtgccatttcactccagcccgggtgacacagtgcaagactccgtcttaccaaaaaaaaaagcaagtgaaattgacattttaatttagtctgactgcatttttctataattttctaagaatttgtcactttttagtattttctcttttctgataaactgttccagcttttcatcactttttaatcagctttcatcagttttatcatactcaacctctggtatttttctttgtatgctctctttttctcctttttttgttttgttcatgagacaggtcttgctctgttgcccaggctggaatgcagtggtgtaatcttggctcattgcagcctcaaccacctgggcttaagcgatcctcctatctcagcctcccaaagtagttgggaccacaggcacatgccaccatgcctggctaattttttattgttttattatttatttatttgtttatttatttattttttctttaagagatgggggtctctccctatgttgcccagactggtgttgaactcctaggctcaagcaatcctcccaccttggcctcccaaagtgctaggaggcatgagccaccacacctggctcttttctgttgttcattctcttcacccttgtttagatcctaaagtgacccaggcacttcaggatctgaagatagctggatgatgatgagtcttcttaaaaggtagcattttatagcaaacatgatgtagagccactgaagggttttatagttgctgtcctcaggggctggatttttaaactggaatatccatggggactttgaaaattccacctgctggggctctacctcatttgagaaccactaccttaataagttcatggccttacaatgggagtgggaggagaggtgactttggagcagacaattacaatgtgagtgacagttatctctttcatgagtactgctgtacaaactgggaatgcctgatctggttcttggagagggagtggaggttaacctgatttatgtaaagttgtagtggtcatggcgggggaggaggttgcattccatgaagcaccatttggaaagacccaaagtgtggggcctggttatttggaggacctggagatgttgttggaatgcttagaaattacaggaatgaggataggaaggagccagatcccaagtggtcttgacaagtcttgttaaagagttttcatttcatagtgcaagtgatgtagagccactgaagggtttcatgttgtagaatttattagatgtgtgtgagagatagctcactcagttagttttgtggaagatggctgtgtaagcatgagattggaggcaagaacttcaggaaaaattatgatgatgactgggagagaaggtggacaattctagagatgtttagaacacaaaattgacaggacaaagtcaacgagtcaatgtggcagtgatttatagagaggcctcaaggataaccaagtatctgctttattcaaccaagtgagtgctggtacaattcactaagagaggcagtataggggagtgaataagagcacatatttgaatcctagacctgccactcgcctatgagttacattttgggtgtattcatttttaagacgtccatgggatgagcaaagaaagagatcctgtgggagtttgagtctggagctcagagaagcagcctggacctctggtgcacgtgatccatgcagtccatggatcagaactctttcaggaaaaaaaaaatgcggttattaggacaagtgttgagtatgtgtgatttttatttctttgtgatttagctggaggactatagagctgaccagaataaaggcaataaatatataaataatcatctacctatgatatactcaaggcaataaatatataaataatcatctacatatgatatgagtatatcattatctgctgtcattattattagtgaaggcatgttacatatttgtttggaccacagcatactttcaggaaactcttgataaacagctttcttttttatttattgccctgctttcttttgattgcttttgccgtagcatcaacctgcatcttattttaatcatctcctctctgaacattgatgattccgcagctttgttagaatacatcttgggagattccattttttaaaggctctttcaagggcatatggcattagatgattatgatatggcgcatttagaatatgccatgatttctctcctgctgaatccctcacacgtgtttgaagtaattattatcctctctgctagctcatgagacttgttagatcactatttgtgggtgtcataaaatgttggcaagaccccagtgtgaaacgcagtgtgaaatacatgtggttaaacttctctgattttgtatgtcaatcaaaacaaaatggcttaaaacagtagatgaatttcaaaagaaacttcaggattctagagcaaaaatgacacatggaactctttaggtctgtgttttgatatttaattcagggagtcatacacaggaggacgtatgcaatatagtagaatttagatgtgttatgattatatctgataatgttacaaatactgagcagctttttgttacatcatatttggtcccaaaatgtcatgccatgcaatgctgggggtgtttaaataccaaatttatgcatattttcaaggaagaagcagataatcttctaactatacagactgtgttacttatcagaaataatagtttatgaattgtcaaacagtgaaaattttaaaccatgtatccctgataatacttttatgtcttcattaagcatcactaatactgaatatgagtatctatctgatgaggaccttagaatcttattatagttagatataacaagattttatttattgtttttatcatggtgaagggtatataatgtcagcatgatctctcctttagttttacctcttctggtgttttgcagtcttaaatgggtgtctttaggaatatcccttatttctagttttagagctcttacttctagttttagagcttctacctaataaaggtataattagattggtcttttctgcatttattaatcaaagactattcttttacatgtgactttttagcaacatccataatttaagtgatatttgcccaaatattatctgtactcccacctttacaagaggatttaataacttaatagagtatgttatagtaatgagttggatgaccaaatatatttcaactaatagaaagaccatgatgtagctgctgaaatacctgagaaaggtagcttaccatataaagaaagacagctaggattttgatcaccttcttgctttagtgaatgatgctagatcttcctccaacgtaaatctttctgctcactttaattctagatgtgtgaattcttgacttgaggactttgatgtcagatttcacctacttgaaggcccattggaagaataacttctaactcattaaacaattccccatttagccaaagttagtctcatagatgtctgtgatggcttgttaggtggcacagtgactaaatttgatgctcagaaaagatggtcttaacaaagagttctttcttttcacacaagtgtaagctttctgacagttatcacccaaaatgcatcttgttattgttgtcttttctactcatggctgtgagtgtcagacactgtgcttccattcactaacatgaagacatttgtgaaagggccttcatcaatatctgacactggtgaattgaagaataatatactagctacataaaactgtgtttattcttcctaaaccaatcattgctttttgcagcatttccaatgaaattgtgattttttagcagattcttctttgatggagctgtgatttgcaataatcttgtcatgccaggctcaaaatactactaaatgaagacatttgtggaagggaatgattgtaaattgcatgcaaatttcaactcggctggaattaatcaatatggaaacagaacttgtgcgttcctgatataatgatgctgaaactaatcccatggagttctatttccgtgggaattaggcagttattttgctttaaatctatctctctctctcctttttttacccttgaagacaaagtcctgtttttgagttttttaaaagtaacttctttggggatttagagaggttataaaggaaacaggagtaaaatcaagcatctgacttcccctgtggggacatctgacatttcctatttaatttgctgtgcttgtttaatgaatctttcccccaatttttcttgctagtttttttttttcactgaaaattctaaggcttatgagatagtaggtgatgcaatctttattctatgttaaatatgcgacactggtctctaaatgggatgttctttcttttacaccagtttcttagggtgatcccagcttatccttgatgaaagctttttgtttttgttttttaagtcgcttttggaggaacaggtcaccaaccttgactttttaatgcctgcttacattcaaatttctcattttctttgattggcaagattaggtttatggccttttattcttacacttggcaactagatcggttaaccttagattatttgttccccaccttttcttcagctgtttaggtcacaaatttgtagaaaggtcttatcattggcatattttgtaccaccagtgcatcagtgctatactcatatatccttagaggctgacaacttacttcccagcccctttggagtactttaagaatccctttatttatagcccagcttaagccccagtgggtaacactccataaacctgcagtgacatccagtggcctcgtggtgtaattttttacaaacttttctaaaaggaattacaggggcagtatttcctgtcaaagaaaaatactgttggagttattgaagggggtttcctaaatacatttatgtacaatagttactggcatactccttgataggattactaggagaatgattattcattttttggtttttgagtgaaggattaacggcctctgatgaaatcagctttattccaagatcagataaaaaatataaaattgaggacaatatttttaagaggacaatttttaattaaaaaaaatcaacagtgtagaatttcctattctggatagatttaagaaataaaggagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaaaaaaaaaaaaagaagtaaaggagaacctttagtttgtgcaactgatcatgaagtttaaaattctatgttgttccccttcttggttcttgtgcagtcaatgtctttgagagtcttcttccactgtgttaactctttaattttctcaaaccacctaagactgctactataaatcagagccaagagattcccaatctgattactgtctttaattgtattattaaacgaaaacatatttttataaaaatgatgccccattattataaaatatttacgtggtagaaaaatgtacgaagaaaatgtgagcacatcagtgcaaatcttacccttttcacagaaataaccagcgttaacatttggtaaacctctttgaaaatgctctctatatgctcttttatattctttccatgcatatatattgatagaacgataaataaattggaagctaagaaataatttcatgatactgaattgaacgacttataacggctgtgtttatttggtttgtaattaccgcaaaatgttatactaggtggggagaggaccaggaagaggtttgctttttttaaaagagatgactttgcctttcttgtgacagggagggctggctaggcaggatcaggtttgggagagggtcaatagagaggagtggtgtgcagccacctcatggctgccagctatgaggtttggtttagataagttaactgaggctggaatgggacagcatagttcatatgtttaaacacccaggacgagatgttcccagagctcagagagttcatacgagtaagtctagcatgtagaaactaagccagtagaatgttccaaactgatgctaggcacattcataccaaagatgagtgttaggttgtggtggtggggggggggggggcagagggggagggagaaggagagggagagatctttagatatctttagcaattgatactgaaccagaaatttgaaatttagatttcgctctgtcatgcccattccccagacacttctcagatacaatgcaaaagccatatgctactgggagagaggcaagaaacctgtttgccattctagtcctaacaaagattagctgctgtgggggaaggactatgaatctccccctgctttgcaaagaaatggggcaaacgtcgtttgcagttgagagagatcattttgcccatgattctgcactaatgcactgatcctctacctctggtagaggaacaggaaactttctcatgcccaagatattccaccaatacaaggcaaaacttggcttccccgtgggagggatgtggggaagaaaactgattgtatttcataccctgaactgagtaggaagcagagattacatgtcattggggtggaggaagaaatgctaagaaagtcatgtacttgagtcccagatgtgcagggctaggctaagactgtgcttggagcaggagaactgagaaattctccttcccccctccaagagccttcaaccataacaaagaaacagtaacaggcttgcagtctactgctagaggagtggcaagagcatgggaagaaacgcagacaccctgcaatgcttatgtgcaggtcctacttaggtcctactgtaagtttagggtggatcctgaacactgagaaaacctttttgacagcaaaaaataaaataaactttcatttctatatagatttagattacaaagttatgcaggtagaattctcgtataaaatcaatctagttttccctgttgttacatcttacacttgtaagatgtagttgttataagtagatgtaattgttataagatgtaattgttataagtagtaaaccaatattgctacattattattaaatgaagtacatactttattcaaattttcttagtttatactttactgatctttttctgttgtagtatcctatctaaagtaggatactatgttgtatgtttagtcattatatctcctcaggtgcctgtaagactgtgacagtttctcagatagtttttctttttgatgatagttttaaggagtactggtcaggtattttagagaatgttcttcgattggttggattaaaaaatttttttgatgtttttctcatgattagaccctcagttggcctctgttttgaatcttctagactcacaaaagactatgtcacagcagtctatcagaggaggaatttttatcctgtggtgcatcaacactagttatagcaacagtaaaatacagacacaattcaactactgagtagatttattcagtccccccatgctaacagcttgaaagaagtagttacccatttccaggtagaaatattatttacctgagtttcttttatacataaagtttgggttcaattaaaaaaattatgacatagacacactcacgtaagataaaaaaaaaaggtgactgttcaagatgtaaaatagtcaacaaaatctgacatgcaaacttcagacagggaccttgaaataactatgattactgtattaaaaggtttaatggaaaaggtggacaatatacataaatcgtgatgtggaattttagtagagtgatggaatctgtaagagtcagaaaaaaatgctagaaatgaaaaacacaatatcatatatgaaaaaattttctgtgggtttatcaacagacttgatacgatagaggaaagaataagtgaccttgaggataggctaataaagcctttcaactgaaatagagcaaaaagagtggaaataaaaaatggagcattgccatagaaaatttcctgaccgcctaacatacttcaagagagagaaaataggctagaagaaacgctagaagagataatggctgagaattttccaaaatgaaagatagccaaccacagactcagaataaatatgaagaaaagcatacctacgtacactgaagtcagactgctgaaaatcaaagataaagaagtcttgaagacagagaaaaaaataaatattcatgcagaggtataatagataaaagctcagtacattttatgtcagaaattatgttagtgaaaagagttggagtgacatctttaaaaaactgaaagaacaaataccctcaacctagaattctgtatccaggaaaaatatattgcaaaacggaaagtaaattaagtcttcgtcagatgaagcaagagaagttttgctagcagaacaggtctatctgaagagcttacaggaagctcttcagacagtaggaaaactcttcagatagcaggagtacgctgctctatagaaagaacattttgttctacacaaaggaatgatggacaccagaaatataaaaatatgaataaacagacaagacattttttcttctaatcttttgaaatgagattagagtatgggttgacaatgagcctggtatggtttgactctgtgtctccacccaaatctcatttcaaattgtaatccccacgtgttggaggaagggcctggtgggaggtgattggatcatgggggcagttccccactgctgttctcatgatagcgagtgagttctcatgagatctggtggtttaaaagtgtgtgacaattcctgcttgcttgctctctcctgctcccctatggtaagacgtgcttgtttccccttcaccttctgccatgattataagtttcctgaggcctctcagtcataatttctgttaaggctgtggaaccatgagtcgattaaacctcttttctttgtaaattacccagtctcaggtagttttttatagcagtgtgagaatggaccaatatgagtcaaatctaacatcaggcttgttttgtgcagcccatgagcaaataatttattttaagggttgtaaaaaatttttttaaatatagaataattaatgcatatgcaacaaagagcatatatggcttgcaaagtctaaattatttactatctggtgctggtttaaagcaaaaataataattctatattatggggtttataacatgttaaaataaaattttggcaataataccttaaaggatgggagggaggaaatggaaatatactgttgtaaggtttaaatggaaatatactgttgtaaggtttctgtacaatacatgaaatagtataataacatttcaaagtagactatgataagttaagaacgtatattgtgaattttagagcagccattggggaaaaagataaagtacaagatataattaacaagccaataaaatgaaatcataaaaatgctcagctaatacaaaagaaggcaaaaaaattaagaaaaaaagggaacaaaagaacagatgactttttttaaagtataatagtacatagataccatatcatccttagcaataattacactaaatataattggtcagttaaaaagcagagattataaaattggatagaaagtaaaacccaattttgtgctgcctgcaaaaaacccattttaaatacagagccatgactattttaaagcaaagaggatggaaaacagtatgtcatgcaaaccctaatcaaaagaaaactggagtggtctgggcttatgcttataatctgagcactttagaagtcggctggatcacttgagttcaggtgtttgagaccagcctggccaacatggtgaaaccctgtctctgctgaaagtataaaaattagccaggtgtggtggctcatgcctgtaatcccagctactctggaggctgaggcaggggaatcacttgaacctgggaggtagaggttgcagtgagccatgattgcaccactgcactccagcctggatgacagagggagactctcaacaaaaacaaacaaacaaaacaaaacaaaaacagaagtggttttgttaatatcaatacagtagacttcacaatattaccaagtataaagcatggtatcacacacaatatagtgataaagggatcagtccatcaagaaaacaagaattcatcaagaaaaaggcctatgtacacaataacagagcttcagaatacataaagcaaaaactaatagaattataggaagaatagacaaatctactaataaagtttgagatttcattgctcatccctcacattgatagaacaagttaacacagattaggaaggacaccaaaaacttgagcaacactaccggtcaccttgactcaatcaacatttatagaatgtgcccttcaacagcaaaatacagttttttgtccaaatgcacatgccatactcattgtagacatattttgagctattaagtaaatttcaataagtgtaaaagcattgaaatgatgcaaattatgttcactgaccacaacagacttaaactagaactcagtaacagaaggatacccggaatgtcctcaaatttttggaaattcgataacatacttttaaataacccatatcaaagagtaagtctcaaatctaatttgatttttacagtttacatgcctcttttttctaggcatttaaaaaatatacagaagtacagtctagactgcacatgtgtatataattgatgacagtgacattctctcggaatttatattaatgtagtgcacaatatatttgaagtacatttggcataaggacgtactaagtcacaagacttgtttggggaatgtgatttctttggataaaattaaattccttgaacttgacaactaatcaggctgaaaaaatacacttgaagctttctgatacattattaaggaagttacagaatatccatgaatttagttagctttacactccagtggtactcctgagtattttgtaattgaactcgttgatcttcagatgtgaattggttcttcagatctgtgaccatcagtctgtctacaaacatttatgcaggctctctgagcaagatgcctttcctcacggtggtttctaaactctcccaatattttcagctgcctgggtaggaagcattagggcagacgcccaggctggaatgcagtggcgtgatcttggctcactgcaatctctgcctcccaggttcaagagattctcctgcctcagcctcccgagtagctgggactacaggcgctgccaccacacctggctaatttttgtatttttagtagagacagggtttcaccatgttgactgggttggtcttgtactcctgaacctgaggtgacctgcccgccttggcttccctaagtgctggaattacaggtgtgagccagtgcacctggcctgctctgcttttaaagaagcagaatttgtctagatgtttttgaagaacattatgtaataaaatagcagtaagagtatgaattctcgatatgtattgaaaattagagtctttaaaagtcttggtgtttagaaattaatattagttttaatatgactctttaataatgaagaatataaagttctctgtgtgctggtgagaggactttttatttttactcctggaaatacatgatttgtaccagtcacttgtgtggccataatatttttgccctaaatattaggtcatcatttcctctttattgttaggtaacccagaatgctaggtattctctaacagaagaaaaaaaaattggtttgcagtcctggtaagctgttggagattttaataatcccaataaaatatttccatttttcaaatgtgtttagatgtccttggcagatttagattagttacatgagatggatagaaaacaggctcagggcttagggtttattttgatgatttttaaaatttgttgaaataagagttgttttatttaaggaaaaaataatatttctggattaagtatttcaaatgcgttatttttggagagatgctacagagcttatgtcaaatgattattaatatatatatattttttttgagacggcatctcactgtgtcacccaggctgaagtgcagtgtcgcgatcttggctcactgcaagctctgcttcctgagttcacgccattctcttgcctcagcctcccgagtagctgcggctacagacacgtgtcaccacacctagctaatttttttgtatttttagtagagacggggtttcactgtgttagccaggacgcttttgatctcccgacctcatgatctgcctgcgtctacctcccaaagtgctgggattacaggcatgagccaccgcatacggcctattaattcttaaaaacaattgtgaccatgatattagcacctaaagcactattccttttcttagccttgggaagacttcatggtcatgaatactattaatttgattttttaaaattatgagtgccatatggctgtagaatgcagaggtttcatgaaatatattcagtgagaaccagaagtgatttactaatgcctcaaactcatttaaatatctaccaattcaacatataaaattgtcttcacgagaaacattacggggtatgattttgtatttgatcataatgcttgctaattatttcctgttagtattactggtaaaatgggggttggcaaattctagatagtgatgccacatatgtgtggtgtgggttccttacaaaactttatttgctgcttaattttgtaacattgcatcattccctaaatagcctcaagatccaaatacaattgcagtaatacttgctgaaaattggaaactattaaaaacattcatttgctgggaatcaggagaggggagggaatttcaaataatagaggtttttttttattaaaaaaaaaaactcacaaaatctttgatccactgtctctcaaaaggcaatttgatagctaaatgcaagtattttttttttttttttttgagacagggtcttacttcttcgcccaggctggagtgcagtggcatgatctcagctcactgcaatctctacctcctgggctcaagcgatcctcccacctcagcctcccaagtagctgggtctacaggcatataccaccgctaatttttgtatttttgtagtgttggggcttcaccgtgttgtcaaggctggtcttgaactcctgagctcaagcaatccgcctgccttggccttcctggtgggattacagggattacagccactgcgcctagcctaaatatattaataagttttaaagttttatattatttccatttctattttggtagtaaaggtaaatgaacaagcattatagatcacagacatttaggttaaaaggtccaagctctttgagatgggatatactagggacacgttatcttttttttttttttttttgagatgaagtcttgctcttgtcccccaggctggagtgcggtggtgcgatctcagctcactgcaacctcactgcaacctccacctcccgggttcaagcgattctcctacctcaccttgccgagtagctgagattacaggtgcctgccaccacgcgtggctaatttttgtatttttagtagagacagggtttcaccattttggccaggctggtcttgaactcctgacctcgtgatccaccttcctcggcctcctagagtgctgggattacaggtgtgagccaccgcccccggccggggcacattgcctttataactctatttaattcccttgcttgcacgttgaatagatctaaatgactgggggaaaagtaaaaacatagtctttagtccctttcattgtggtaaattcactgaatgatagacggaaatttcagccttcttgggtctactgccaggttctgtagttatttgtatgtctcatggagaaatcctcattgattacactgtatggctaaactgacttaaaacagataactgagcctatttcaaaattgaaaattctttaaaatggaaagttagtactctattgttcccaaactgttggattgcatgccattttcccaaactcacagacgttgataagatttcaggcaaggggaacaaggaaggggtcacagtggaagcgaattcttcccctttttctgactgtgtttgcccacctgtcctttacccttcgcagttctattctgagaggtatgtgaggaagatgggagccactgctgctagattgttgccattaaccagctttcatggcttttgtgggagcctccttttcattagtatttgcaacatgttcaccagcaaaatgattatgttaggcagagacatcacatcacttacatttcatagctcagtgcaattttcataaactgcgaggcaacatccaaaaaaaacatgactcagaattagagtttcagaagattattatatagacattatttccctcaggtcacgggctttagtcaaatttggaggagaatgaaattgccaacagtgaaaagcagacagaaaggtatgagttcatgagcagagaaataacattttcatttgttccttccccatgggaaagattcagcattccggtaaatggagacggttataagaaatgaatttttgtcagcagggatgtgattttaaggctcacttatccattggcaatctagatttctaaccccaggaatctgggaaattgctacagaatgtagtctttattataaacaagtttttttttttgggggggggtagtttttccctccttcttttcttggtcagagctttttaagacgaaggactacatttctttctgcatttctggggtcagatgattgcagatttcccatctgccctgagtttctctccattgctgttgctttgtgatggaaaccctttctttcctcctcaccaagcttccctcactctgtcgttgcttttcctaacccccctgtgtttatccagcacgacactgacaatattgaaagctgcaaacttcctatatggccatggagtggtggatctatggcctgatctctctgttccccagcatttacaggatgtcttgtgctgctgctgattctatatcctcagttcttttgtgtctgtggacctgaaagagcaaggcaggaaatacagctttccaggtagctctcattttaccaggtataaagagcgaggatttgcaaggtttctgtaaggtaatcccagacaaccttcttcgtaattaaagaacgttctttcatgggaaattttattttccttcttcgatttcatcagatgcttctcagcccatcactcattcagattctatgcaatggttctttttctagctagagtacatccttgagagtagaaaatatttcatataatctaaacccttcatttctagagatgcagatagattctgtaacattaatctcacctttatattttttcaatttttaataacttgaaaatatgtatatctaatgccttctttccctatgcacttttgcttattttaatatttctcaacaccataagctatttgcccagctgcatccttattagacagtgctattgcctgccaaagctttttgagagcaaattgcattgccttcattattattatgtctacaatataatgattatgaaacatcattattatagttgattaataaatgataattgatgactctcagttcataggatttggcccatgaaattcatcacaatttgtaaacttttctccaaaccttcaaggattctaaaaggattgattttgctgcaaagtatatgcgattacattttttgatacctagtaagtagtagtggttgaggattcactggcctggccagagtgagggtgtatactaaatgtctgtggggtttcaatttcttcctattgaattcttttaaaatgtagagtctcttaccactgggagtttggggaacttcgcacagtggctcatgcctgtaatcccagtactttgggaggccgaggtaggtggatcacgaggtcaggagatcgagaccatcctggctaacacagtgaaaccctgtctctactaaaaatgcaaaaaattagccaggtatggtggtgggtgcctgtagtctgaggcaggagaatggcgtgaacccgggaggcggagcttgcagtgagccgaggtcgtgccactgtactccagcctgggcaacagagcgggaccccgtctcaaaaaaaaaaaaaaagaaagagagaaagaaaatgttgacggaaggcattctatctcagtctctgcaatgagccattcgcattttgtggaatcctttctggcattaattgggggacagaaacagcatctggcatatttacatgacagtagcatgtacttctcttttatatgtcattcattcgtacttccaataagttcttttctaatatgagcatacattgctttattgtgcttggcagatactgtattttttacaaattaaagttttgtgtaaaccttacatcaagcaagtctgtcagcaccgtttttccaacagcatatgctcacttcatgtctctgtgtgacattttggtaattcttgcactatttcaaacttttttattataattataactgttgtggtgatctgtgatcagtgatctttgatgttactattttagttattttggagtgacataaacctcgctatataagaacagtgtgtgttctgtttcaccaacctgcctttcctctctctctctctccttccctggccttcctattccctgagacacaacaatattgaaattaggtcagttaataacactacactggactctaagtgtttgagtgaaaaaagagtctcatgtcactcacttgaataaatcaaactctagaaatgatttagcttagtaaggaaggcatgttgaaagccaagatgggctgaaagctaagtctcttgcacctgttggccaagttgtgaatgcaaaggaaaagtgattaaaggaaataataggtgctactccagtgaacacatgagtgataagaaagtgaaacagcccttttgctgatatggagaaattttaggagtcttgatgggagatgaaaccagttacaacattcccttaagccaaaacctaatccatacaaggctctctgttcaattctgtggagagtgagagaggcaaggaagctgcagaagaaaagctggaagctatcagagtgtggtttaagaggtttaaggaaaggaactatctctagaacagaaaactgcagggtgaaacacaagtgctgatggagtagctgtggcatgttacccagaagatctagctaagatcattgataaaggtggccacgttgaataacagagttttactgtagacaaaacagccttctattagaagaagatgccacctatgactttcaaagctagaaaggagaagtcccatgcctagcttcaaaggacaggctgactcttcgtaggaggctaatgtagctggtgactttaagttgaaaccattgcttattttatcattccaaaaattgtagggcacttaaaaattatgccaaatctgccctgtgctctagaaataaaacaacaaagctgggatgacagcacatctgtttacgacatggtttactaaatattttaagcccgctattgagacctactgcttggaaaaaaagattccttttaaagtattactattcattgataatgtacatgatcacccaagggctctgatggagttgtacaaggagataaatgttgttttcatgcctggtgacagaacatttattttaccattcatggatcaagaagtaatttcaactttcaagtctcattatttaagaaatgcatttcataaggctttagccaccgtaattagtgatttcctctgatggatctgggcaaagtcaattgaaacctttagcaaaggattccccattctagatgccattaagaacattcatgacatataggaggaaatcaaaataccaacatgaacaggaatttggaagaagtttattccaaacttaatggatgtctttgaggtgttcaaggcttcagtagaggaaattgctgcagatgcatggaaatatcaagagaactagcattagaattggggccttgaaggtgttactgaatttctgcaatctcatcaccaaaattgaacagatgaggagttgcttctttatggatgaacaaagaaagtgttttcttgagatggagtctactcctggtgaagatgctgtgaatgttgttgaaactacagcaaagaatttagaatattccataaactcagttgataaatcagtggcggtatttgaggattgacttcactttttaaagaagttctatgtgggtaatatgctatcaaacagcttcccatgctacagagaaatctttcatgaaaggaagagtcagttgatggagcaaacttcattggtgtcttactgcaagaaattgccacagccacccaaccttcagcaaccaccagtctgatcagtcagcaaccatcaacatgtatgcaagaccctccaccagcaaaaagattatgacttgccaaaggatacctgcaaaaatccatccaccagactcaggtgtttgttagcatatttttagcaataaagcatttttaaaattaaggtaactacattgaatttttagacataatgctattatacacatatagcctaatatgtctattagttttagacataatgctatcaattatgttaataacttaacataatttttgtgttcactgggaaaccaaaagttcatgggacttgctttattgcaatattcattttattgtggtggtttggaaccaaatctacaatgtcttaggtattcctgtattttcattaagaagtagtatgactatctcacataaaggctgataacctggaagacacttagatttcaatatagtttggaacctgtctggattccatgtattacttcaacaggagtgaagaatcccatagtctgatgaatttttgcaggtattctcttcaccataatgaggtttcattagggttactgctagaataggattgtttgttattagtttccaatgaaggatggaatattctcaatgtaggaattcatagtacgtacaagaaagctatagatattgttagtataataattatacaatagtagtagtataataaaatattcaagcaatcacttaataattacttcaagtctcactgtctgccctccagaatcaggagcaggatgtctgaactcctcattctttacacttttactcaaaagctcttaactctagagacagtctttaactttttggtatttggtttcttcttttgtgcaatggcaatgattctgcctgtgcaaacaactgtcaactgtttttctcagcagtgctagtgtaaatgaagttgaatattaggaataattaaccttccttgcttacatatgccatttgataatgctcaatcttctttgttaagaaaacaatgcagtaaaatctttgttaattgagatgaagtgttgtttatttaaatttggatcattctgaaaaatatatttgttccaacaggcttattcctgaaaatctttctaaaatatgttcagtgtctgtctgccttagaatggtccccaaatataattgaatctctctctggtgatgggttgtcttgcacagcctaggacccatcatactggagtgcttttctctctgaatcaagcagcagataacggaatttggactgctttgatctcagatcataccctggaagttgtgttttaataagtaaatttcttatatgaattgttttcttagtgttgtacctcattcttcataaaagtaaaaagtatattagcaagttacagaacaagaagtatcatgttgcctaatcaatgcaaaatatcatcatttcctagacaacttcacaggagacatagcatgattagaaggtcagacttgattaaatcccgtgctttgcccttagttttttgaaatttcaaaggaggcaatctctctgtcaataaattttcaaattttataaataatagtaatcctgatgccagcaagcagttattgagctttgtgtgccaagtactgttctaagcatgtttcaagtaataactcacttcttcacaatgagcctttcaaggaggtactgttattgacatcatttttctagtgaggagcctgaggcttagattcagaaacctgtgagtcgccatatagctagtagctggccgagccatgatttgaacttagctgtgctcaaaaccaccacaccatgatacctcagagatgaatgtgtgcgtggtggttatgggagaagagaaccacatttacttattttttgtctgggtcttgcatggtgttttagatcatttcatttctgttatttcattttgaaacatttctactataattattatccatattttacatatagggaatctagtctcagaaaaactgaagcttataaccaatattttacagctagtgataatgagggagcagacatttgaacttgacaacctaaattcaggttctggctaggggtttcgttaaggaaaggaaaaattccctccaacaaaggtcatttttatgatgtgtaagtgatttaagctttctgtataccaccccaccccttacaaagatttgtgttttcatttttaattaaatctgtctgttctgcattctcattgtttggacttttttcaaatcattgctaatacactggttcttcttcctgttagtggtttgtggttgactggttcatcttctaccgttaacataattctgttttttttttttttttgaggtggagtcttgcgctgtcaccaggctggagtgcagtggcatgatcttggctcactgcaacctctgcctcccgggttcaagcgattctcctgcctcagcctcccgagtagctggggctacaggtgtgtgccaccacacccagctaatttttgtattttttgtagagacagggtttcatcattgttcttatttttatttgtcattcctggaaattaattttgctttgagtttgggacccctaacatgatgtcctttagccccgtgaagagtgaatgtccctgtggtgccattagccacttgtacagtgtcctgagaatattttaagagaaatatgaatggcagtaccacttggataccaattaaaaatacttttttttttcagtgaaatacgtctttaaacctgcaagacacagagggttggttctcttggtttccttagtcattattgacatcatctataactttctgttgaaataacaaggatttttatggaaagctgtttttgttcctgttcctgttgccagttttcacatccttatatattattaaagatacagaatgggcttttaatagatcctacaggccaggcacagtggctcatgcctgtaatcccagccctttgggaggctgaggcgggtggatcccatgaggtcaggagtttgagaccagcctggccaacatgacgaatccccgtctctactaaaaatacaaaaattagctgggcgtggtggcaggtgcctgtagtttcagctgttcaggaggctgaggcatgagaatcgcttgaacccagtagatggaggttgcagtgagctgagatggtgctgctcactccaacctgggcgacagagggagactgtctaaaaaaaaaaatgtaggtcttatggagtcacagagtcttaatgaatctccattgttatatgacagggtcttatggatgtcttttggaatgcccagcagcaagtgggcagcttcttaacaacccactgtgactcatgaggaagtgtgtctttgtgttgtttatgactgtgtttttatgggtaggacttcccactgtctcactttcctggcttgccttctcttctgtttaccctggccccacctttggctcagctgggcactacgggttttaccagagtcagttggaatgcaagtgcatcacaccagctctccatctccctgtggcattttatggctcagagaggattggaactaaaccttgggtggctcatgatcggttgtacccagccaagtctggagaaatggagaaaatgcctgggtttgttagtctacatgtccttcacattcttacagacacgtcttttgagtccagagaaatgtaaatcttttcctttttgtttttagtggtttatttctcaggccctgaagcatgagttttggtcacccctacagcaggggagatttcttcaaaaacagctgtgattatccgaaggtgttacattgtgcttttcttttcatgcatttttagcacctgcacatcatagttttcccgggaacctccagcagtgtcacctgctaacttggcagactggagagactctcaaagccatgtctgacttctgtgtccatctggattatttctgtcacatgatgatttggcagatgttttctgcagatctctagctctggtaaacaatggtgaactgggcccatatactcaacttgtaaagagtgatttccccaaaaacaggagacagacatttagcaagataggggctccttcatgtgaaagttgatctctaaggttagtataaattttctgatctagagggaattataggactctgaggcccacccttactagcttgccaccaggcttggtataaccttcattgcaaatgctaggattcatgctttggttgtacatgaaggggattatttctgggtggtattttatctcctactctcagactctttcagatctagctggatgttcaacataagccttttgtgtaattcccatgggctgtagctctgtggcttgagtagtggtcacaggagctctaatgccagaataaatgatgctgctaacagaaaaaagtagggctcatttctctgcaaaatgctgcacaaagaagactttctttgcttcttctggtacatgtggtaagcgtagaaatagtttattatggaagtctttcagccacaggtctttctaaggcaaaattgtatcctccagggaaactaaaataaataccagcctaataaacttcagattttaaaaaataagttatcatattgcatttctgtaagaagaaaaatatgaaaggttgatgtgtgtttttattccactttgatttacttcccaagctgtcctgtcccaattcaatcttaaaatggaagaaaatactttatcatttgaagaaggatgaatgtagtacagaattcaatttttaagaattcaaggtaggggaagtaaattttgatgccaactttcaagtttttaaagaataaaataaaataaacacatacacacacagttggctttgtgttggaagttaatgatagatgtcttctcggtattctttgcaaaggaagtcttccatccaggctttccctcatttgtttttaattacagtcatggtctacctggccttctcactagcactagctccctatgccttttgctttgctcttaggccgggcttttggtccctccctcctcatctctggttctctcgctattccttggctcctcttgtcttgctgcccagtttggctcaggtacatgaactgcaacctacattctgccatccctgcagctgcacaagcctgtcgttttccatactattgtattttcaggtctaacatgtcccctttttactgccctttctcagtctactttagtggttattatcttgtcatcaatctctttaaatatggctaggctccgaagattcctctattgactattgtgtttgctttattttataaaatttattattaaataaagctaggaaatgtaatataataggcttccatttacccaccacccagcttgaaaagcaattctgaatttgctatttatgttactaatttctttatatatttttcacatatgcaaatcaacaaatatatagtatgcttatattttggaaaattgtatcttattctttatgtgcttttttaactttttaaatggaagatgatgcttgtgagattaattcaggttgctatgttttgctcttccactactgcatagtattctattttaagcctatgccaccatttattctatttatgagcattcagattgttttcatttttgttattacgaacaatgtttctgtgaacatgcttgtacagatctccttgcacttctgtcaatttattatttcagcatattttattgagcacctattagtgcttggcgtgattgatacaagactgctaaaacaagtcgtatcttgaagccatatgctttagagagacaaacaggcaaattctgttgtaggagtcttctcacctatcttcttatttttatttcactcctcctttgtcatatttcacagttctgctaaagttaacttttttttttctttttttttttgagatggagttttgctcttgttgcccaggctggagtgcagtggcgccatctcggctcactgtaacctctgcttcctgggttcaaggattctcctgcctcagcctcctgagtagctgagattgcaggcactcgccaccacacccagctaatttttttgtatttttaatagagacggggtttcaccatgttggccaagctggtctggaactcctgacctcaggtgatccgcccccctcggcctcccaaagtgctgggattacaggcgtgagccaccaagcccagctgagctaactttttttttttttttttttgagatggagtctctctctgtcacccaggctggagtgcagtggaatgatcttggctcactgcaagctccacctcccaggttcacgccattctcctgcctcagcctcccgagtagctgggattacaggcacccgccaccacgcctggctaatttttttgtatttttagtagagacggtatttcatcgtgttagccaggatggtctcgatcgatctcctgacctcatgatccgcccatctcggcctcccaaagtgctgggattacaggcgtgagccaccacgcccagctgagctaactttttaaacatagttttaatcattactgttattgtcaaaaacattcaaagtctccctgttgcttatgtgataaagttgatactcctcagcttgccattcaagaaccatcctagcttaaccttttctcctgtttacatctcacccatacacctttcagatgccagtgtcatttccctttcatgcctctcagtgatatttctttacccttagctatcttgcctgttttgaactttatccaggatgttgaggctttactcagttttcaagatccaaatgaaatagtttattattcctcttatacccttcgtctaagtgtttattgcagatagtgggatatgcatttgtttagctgactaggagcaggaaccatatggtaattgcctccaacatagtaggacctcattaattaaaataataatttataatcaaatcgaactgaatggatcatttggttctcagctttgctgttaaaactctttaatggtcctaatgggaggagggagtagaaatagagtgaatgttttagttttctgttgcttttcaaatgtttctgactctcaataagtgcttgtagcttactaaccgagcaaccattctaagcgggatccttaccacatcaaagtgggataggttgagaagaaaactggctttagtaagagagacagattcttcataaaaaaaaaaaaaagaccatattctcaccttagtaggattgaactaaagcatacttaaaccagcttccattctcatctcttggtcacctcctttctgccttttgggtggcaatacacgttgatggcctgtcacctatcatgcccttctacttatctccagtccccagggtagaaggcagatgtggctgcatgtgaataaggggaagcccgagtccactgtgtccgcgtttccattttgaaggaaaatgggagaaatgaggccagtggtttgataaattatatcaaaaatagtcccttcatgctaatggagtgcgaagaagctgatgtactggagatgatctataatatttcatatttctctgaggagaaaaatgataaacttgatgatgtgcaatttattcatgtttcttcagatgagaaaaaaaaatcctcaagtcaactaactgcctgtttctcactcctggaagctggcatgtggattttacactgggattggaggctgggcttgtttagagaaatgcctagagagactttgattaatcaccagacctttggcagttggttgggagagggtaattacgctagcattgccactattttatcatcgctattttatggctctacaccgccaggtgacaaatgtgttaattattgcatttcttatcctggacttctcttgcctgccccctcccctcatggttttggcccttagtccttctctgcagctcagccctggacggcagtaacttgtgcaatcaaagagctgttctttgggagccatgctgagagggacagggctatcagccctgctgtgtgcagacgctaaccacggggagctggttaattccctttcctcttccttctgcccatcaccctttgggtcaagtgctgctcagagccagaagctccactggcttctttaataactgaaaatagcacccctggactgggccatttcactctaaatagccccctggaggaggttagaaacagaggttgtcttaggcaaagagatttaggaggtaaaattgtcctttttctgtctttttcttttttttttttttttgttgccccttctgtctttctgttacccagagaaagcttcacaagcatgcctgtaatttagttgcaccattttattacagctgaaagaattgaatgtaaagaaggaagtttaatagaacatataattcagcagatttattgatggggaggtatctattgtagtttggccagtgaaggcaggtcatagaggaaaatttaggtaagtcggattttctttaaaaagaggcccaagagttagtacctcaggattttgttttcttctgttccttgggcatgctggaaatttgttagctcttaaatcaacaacttgttattgacagtcatctttttgctggagaacgtattaaaataagtataattatggtgcctgacctcaaaaagaaaaccagttggttatataactctaaaaagatgagtagccacagagtgtagaaagccacagagaagagcaaatgccattgttgggaagcagagcctatgctgggtaaagtttcctgggagtttcatcctccaagaacaagaatttcttcttctgaccctccaccttctctggaaatggggtgccacatcttttgccttctggctaaatttttgtttattatatgcctctttcactagaatgcaagaacatgactacttggttatgttcttgcttgtaatccttgtttttagaacaagacctgacaactcgattatggtcagtatatatattttttggatgtatgaatgaataaatgaaatgagatcttaacatgtaactatcttcttttagactacacagggttttgactataattgaaatttttaggcttcttcagctctctcttttttgggtccaaaggatgtctcaaaccaaataagaaattccttcttattgatctagtggttacagacaagagacgccagccttctttgtcttttggaagttaggagtgtgtccctgaggaaactatgccctgggaaggttctttatttataatacaaaatttcttttttgtggttgagctagatacagatatttttcaatttttcctttcttcgaaggctatattttggcttaatctgtacttacagcataactattcatgctaattataattcatatatgaaaatgcaccaaatatgactattagaagcttttgaaatactgtttgatactttgcaatatagttatttatgcatatctgcatttgattttaaacttcttgaagtaatgttttatttatttttgtatctccattgctcagcaaagggtggcacatagtaggtccttcatgaactaatattcactagagcactgtgggaacttatttgcaacacccttggcatctctcttatccattggggatagcaagtaatttgaactgtcaaaaccagtggtgttgctttgggcctaaatgacattaaactttttttttttttttttttttttttttaagaaacgaggatcttcctatgttgcgctcgctagtggtcttcaacctctggcctcaagtgatcctcctaccttggcctcccaaagtgctgggattacagttgtgagccaccgcacctggccccaacattcaactgttttttctgacagtaactaagaatgggataaatgcctctctgaggcctttcccagtttgtgaggccacttgtcttattatttgtgattgcaggaggacatgcatcatattcatctaaaggttgaatacatttatttaattgtggcttgtgaagaaagaagagctaatatgtggtcacgttttatgctatttaggatcgaaaatcagtcagtcatgaagccatttcttttcattctacttttggagatcatattatgataagcttttcagaagcattaataacctagactcaagcctatgtagtttggaccttcatgtctttacatgtgtagaatcaaagagcaataggagttggtgtatatgtgacttgagaagcctcacatcattcttggaatatgttgtcactagtgtcatcagtggggcctacgtgccctgcctgccaactcaggaaaggcgtgagattgagggatctagatttagcatttattgaggaaaaagtgttgtataaactattgaaattttacataaaaaacaaatagatctgttttgggaaatgaagattttcaaaagaaatatggtccattttgaaagagataattgcaggatatattttagtgtggcctggagcttaccaatcagaatgatattttgacattcatggtgtcaaaaggtaatttctttttgccttgaatcttatgcttgaagtatgttattcatgtagctatatataatgggattacattttaggggaacttcgggatgatatgtaaaaatcctgaagaagttgtctttgtgttttaaaacaagaaaaacttgacacaaactggcttacaggaatgtgtttcttgcaggtttcccttagaagccacacaggaggcagttttcattggctgatgatgtttatgggtataaaaaagaaactttgggaggatttgataaagtctcttttcagcttaagataacatcattttactcacgttagagcgtttgtgtgtgattggagttttgatggtggttatatttttggctttttttaatgtttgttgcttactgccattcctgaaccaaaagataagttgttcagataattgcaaagacagattatggtaatagtgatactaatatctaacatactacattaaatatgtggaatttaatttaattttttgagatggagtctcactctgtcacccgggctggagtgcagtggcgtgatgtcagctcactgcaacctccgcctcctgggttgaaggattctcctgcctcagccttctgagtagctggaattacaggcgcccgccaccatgtcccagttaatttttgcatttttagtagagatgaggtttcacctgttggccaggctggtcctgaactcctgacctcaggtgatccacctgcctcagcctcccaaagtgctggcattataggcatgagccaccgtgcccagccaatatgtgtaattttaattatttagcacttatagcaattttataagatgggtactttgtttatccctattttttagataaggaaactgaggcagcagaggttaaagaaacttgcccaaagttaggtagctaataagtagtagaagcaggattcaaactgaggtattctggctctgtaatccatgctcttctatgcactgcctttgcaaatctaatttcaacttgaaatgagttcagtggattgatagtagattagtaggggagccattccaaagagtttcttataattaagtgaacttgagaatgtaactggcaacagtgaagagattcccactctatttcatctgtaactttctgatcttaccgtggtggtcacatttgttgtaagaatatttatggtggtgtttaggataagtttaaggaaatgttgatcactttttgtttgatctgagatattgatagatatttatatactttataaataggtaattaggtatatatgtaaatatgtaagatatatacctattaattacctattaaatcattcatgctggcctctgggtatttacatgaatttttttcagtaagtcttgcctttcagatatatataaactagattatgcttaaatatttatttggacaagtgttttcctctttagttaagaggccatcttctgaaaaattagactgcagtaaagcagtaattccgcctcagttttccatgagggaagatttgtcatggctactcctacttttggcattataatcacgtgaacttattattcaaattaatggcttcttggcataattttcagaggtctctactgcaaatctcagacatctacaaatcagtacatgtcataataaaaggaagaatacagactgtcagacatactcaactagtcttctttttttttttttttttttttgagacggagtcactagtcttcttttggaatcacatcaggaaagggaagttgttagtgcttatgccaggtagctggaagacatctttgtgatatttatgaagatcagccctgttgggcaatcgttgcctctgccagaatgacttacccatttatctaataaagggaaacatctaaattcttgaacatgtaataattcacttgataaaattcaggtttttataaacaaatcatattaaaaccccaaaagttaattaacaggtgataaaccttgcttttacttccttgtcccatcacattcattcatagtcataatacactgacaattattgagtgcctttgatgtgccaaaagcacttgctaaatgctttgtttggaaagggatgtttgttaattggggtggtacctcccaaataatgaaacatacacacttttgttttattgaggatagggttttatcattccacagctgttccttgagtaagatccgggcttgaaaggccaagttcttctacaggggcggatctttgaggaggaagaggcaggtagctaggaagggctaggaggctacagaggttaaaagtggtctgagattagggagaatggctaaaagtgagtgagattttctctcgtgtgtgaataattgtaggaagagattctggacaacatatgcagaggaacaaatggagggatggtctttagtcagtggaagtggaaatccattggatcatccatgagcccatctgaaatcagcagcccgttaggtagaagcttgaaaaaaagaactgttgtgtttggtgaatatatcacgattttggagaatgatgagggcagaatcctgcatcctttctagctttcttgagaactttgtacgagagtcactcttaccatcatctaaatataagtgatgtgtcctgctgttaaggaattccaccatttgctagctagtggacataaatgggcatcttgttttcttttctttctttctttcttttttttttttttgagacggagttgcgctctgtcgcccaggctggagtgcagtggcctcccaaagtgctgagattgcaggtgtgagccaccgcaaccggctgcatctttttttctttattaattatttatatgtctggaagtctagatatatatttgtcttcgggaatggaaaggtaccaataggaaattttgagtaagccagagtattctagcaaatataggaattacgccaagaacagccagaattgcccagcactagtgataacctggtgaaaagaaagaccatcaatttatgtgttccaaaaatgatgtcagcattgcaagaggagagctgactgcgtaggctcatcctcatttctcaggagagtgtgcctgtaaatgaccaaccaattacaagcagatgataatgaagcaaaatgatgtaaatcaagatctgaggagtgacatttatggccaagacttgataaatatggaattggagaaagaagataggaaacaccagaggaggacagcaaggactgtagttttttttactgtggataagcccaactccctactgtggcattgaatcttggccaggcaatagtttgattgctgatttccttagaagggaaggattcttgtgtaggattaaagtaaaagtaattccatgacaacttgttactgaggaagacagccaaatacatatttcatgagtaagcaacagtcattttggtggaatatggtgtgttacgtaaagcttggtgctagattaatgcccaggtgaccacttggaggacaatcagtgtagccctgtgaaagatacaaagtattgcctgcctaagtctcagtttctttgtctgtaaaatgtgtgtttaagtggagctgtgagacaatgagaatatatgtaaggtgcctggcacttaacagttgttcagtttctctctcttgagcatcctcaaagctccttttattgatttctttgatgctgaaagaaagagaataaattttgactgcacgatgagcttcattttttgaaggtgctgattctcacccccatttccagctacattgactatcgttagccacttgttacccatctagtgaagccatcttctatagtgcagtgtgtgttagtaggaaaggcttatttggccttgaagggctcgtttggccttgatccggtactgattgtggtttgaggttgagcatgttaaggatgaatagtagctggaatggtccatgatgtgtgcttagtatccttcagaatgtttacatagtcatatttagattgcttctgagaacaagagaatacagaacaaaatgttatgttccaaataaagatcacaataagaagaaatattgcccttctagcttggcatcctttttctgccatgatttccctttgcattttcttcccataccttagctttagccaaggatacagcagtaagtgttgcttggtatttaatcaaattaaaacctgtgctaggtaatgcctcatagattttattttgccaagatagatgtttgaacggaaaaagaaatagtgtatattaaggactaaagggggtactcttgttttctttcaaatatgataattagtataaaactgtctttttcctgccagttggctcatctcatctcctagcagctgttttaaattccttaattgtctattgcttactcagctatcatttcacaaatttcctcactgccgcattttcgttgaagcaaattctgacagtgggggatgctcacctcacaggctgggttgagctgagttctagttatcctctttgagtaacaggattaactatcattagacagtgcattcgggtaaggtgatggttccctaggtctctttggagttgattactatagaaatgggcatctggtggagcctcaggttgccaattgcattactcttcattttactgatgtttcaattctgtttaacccaacgtagacttttttttatgcttataaagtaataggagtttcctagaggatttgcagcgtacactattgtataatctcattgcttataattttttttcagaatgaaggaagtgggtattttaaccatagcattttcattccagtatcattaaccatttaaatacactttgttaaatctatcacattttctgttaaaataatgtaaaattctagtagaaattttaacagtatcttactgtaaaaatactgtaggtaatagaccctgagataagacagtctgctgctttcagaagcatcaacacagagcattcctcaagcatttgatttaagtaaatattattgaagccttactaaattcaatttcagatattgtgctctttgatagcacaatgacagcttacatatgatgctttcaaatgtcatccacttatttctttttttttttttttttttttttttgagacagagtctcctctgttgcccaggctggagtgcagtggcgcaatctcggctcactgcaagctctgcctcccgggtttacaccattctcccacctcagcctccctagtagctgggactacaggtgctcgccaccatgcctggctaattttgtttttgtatttttagtagagacggggtttaaccatattagccaggatggtctcggtctcctgacctcatgatcctcccaccttggcctcccaaagtgctgggattataggcgtgagccaccacacccagcccacttatttcttaatgatgggaaaactggtaatacaagaccaaatttttgtttatacatcaaattatcaactttcatgtcttatttcatagtcatgcattgcaggaatgtgcgtactgcataaagtgacttgctttatcaggtttgaaattcataatacagtcagaagatgattaacagatttgttcaaatttttatgctacgatatgttcttgtccccatgtgaataaatgcaacagattgtttgtaaccattttaattgctctgattttacatggacaatagttttgtataagaaaagacaaaaaaggccaggcccggtggctcacaactgtaatcctagcactttgggaggccgaggtgggtggatcacttggggttaggagtttaaaaccagcctggctaacatggtaaaatcctgtctctactaaaaatacaaaaaaaaaaattagctaggcgtggtggtgggtgcctataatcccagctattcaggaggctgaggcaggggagaaagaaaaaaaaaaagaaaagagaaaagtagtcacttggtttaaatgcctggattttgaaacctaactccttgttttacctctgtagttttaggcaaatcacttaacttgattgaatctcagttactctcactataaaaatgggaccagtaataccttcttcaatgtgatcttgagaagattcactggaataatggtgaaagtaccctatcacagaatttatagtaggtgctaaaaatgttgtgtaccttcctttccttcccttagaaagacagtctcttttatttattgattgtacttttgccaccacagggggaaaaaaatccctgtttcttataaaactttctaggaaattcatgaatttagtgtgggccctctaattctgacaaatacaatattgattttgagtttgttgctttaaatttgccaaatgaaacgaaagttttacggttttccttttaagtcacttctgatatgtggagcaaacaagtctgtatttaatagtaagtagtttgctaattgcaaagcactaccaacttaacacaacttaaaatgagaagctgagagggggccagagcatgaaataagtaagtaggttaagaactgccacacagtccatcatgcttgcagagaagaatgtgagactgtccgaggctacagtgctggtcaccttagcctgtgtaaactctcactttctcagttatcagtggaagacaggggttaatccttattagtctgaacacatcacattgcaatgatctgaaagctaaagacatggcataaaggaactctgaagaaaccacctccactgagactgctgatgcttcgaatggaatttgggcagatggaatgctcatttaaggagcaaatgacatggacggggggagtcaaaatgataaagggagcctccttgcatttgttgtatcttacttctgtgtgagttctggcaaaaagcaagcatgactagaaccctagaaaaacaaccattaggtagatactagttatagtcaatcagagaaagccagtatgtgcgaagagagaagagaagaaaaccacatggtaaaaatgtaatcaaccagtgggattcttttagttcataattgtaatcatagatggcattccactacctttgtcttccatctggaccaagtatggctgtgtctagaggttctgttgtactatttctgtggtccttgaactctgatggcaacctaccttgacaaggccaaaaacctacacaactctgagcctttcttggtagtggcattatctaaacgtatgcatttgtaccttatcaggcttaatgagggaaaagaaacggcttttgaagacactaatgggaaattattataagtcaatgaagtaaaaatgcaaatagatttgtatcttaaaacaggaatactgctagaagctaaaactgagtaagatcttgctctgtgccaagcacatgctattttgcattaaaagagacccctgccttctacatagtatcctcattttacgggtagaaatcttgaggtttagagacgtaaagtaaagtaactcacctaaagttacatagctcatgagcaatgtggcagatgtttaaggacacctcgtctgatttcagcgcctaaatgaagagccttttacaaggatgatgatttttgcagcaacaagacaaagatgtccagcaataggaaaaagattgtaaagaaatgttaatccctgtagagggcactgttcagatttaactcatccaacataattttctaacatgataaagcagacctgcgccagctcctgactgtttcagataggtttgcctctggggaagaaagtgcagtgattcgtgtaacctactgtcagtgttatttaaatctcagacctaatctagaatttactttaataatcttttattattttcctgtatattcttatgatttctcccttctcaatgaataatgaatttagcataatgaattcagttagttctaggcttcttcatatctatatttaatattcaaagcactttcttctcttttattcctgatttaccaaaatctgtgattgtgccatgaaaagatgataaaggagaccatctcttggatctggaaagtgctgcgtgttagtttataactgggcaaatgtaagcataacgtttggccagggttgggtgcggtggctcacgcctgtaatcccagcactttgggaggtcaagatgggtagatctctttaggtcaggcatttgagaccagcctggccaacatggtgaaaccctgtctctactaaaaatacaaaaattagctggatgtggtgacagacacctgtaattccagctactcaggaggctgaggcaagagaatcacttgaacctgggaggcagaggtggcagtgaaccgagagtggcactgcactctaacctgggcgacagagcgagaccctgtctcaaaaataaataaataaataaaaaataaaaaaagtttgaccagaggactacctccattgtctttcttttctacaatccagtttagatactttctggactaaccataacttacatgcttgtccaggagtattggccagagttagagtggtcacattaattctaggcaagggtgaagatgaaggagtagagccatgtttccttgaaggacagtgatgatgctttttagagcttattacgtgtttgctatctctcccatcccaagcagtcaggggttttaactttgaagataataataactgtcttcagtgggtgaatttacatctgttttgacccaaaagataatttaggatgacttatggaatctgaagctaaatgtcaaatgtaattaaatgttactgttgtgtcttgccttaagaagagagctggtgagttctagcagggtttgggaactatttggattaactgctttgattctttcccacattatataagaggtgttatctcagacagcacagaaattgtccctgggggacagggaggcatcacatttcagaagtacctataatatttcttcagcatgtctttgggcctggctttctcaatatttctaccttttcttgaaatctccacttggatatggctctggaagatggcagaaacgccatcttaaaatatacataatatttttaagaaatcagttttgaaaaacaagaagtctcttttcctgacggtccttcctcaatatgcttaaattattgaataggaaagcttcagtaagacacaactattaacataagtgctaaggattaagaaaaagatctgtcacaaattatgtctgtctgtaggaaggtaaagttgtgcctttgatatgacacctacccctggaaatcatattcttttccaagatataaacccaaatcagaatagggagtgagctgttaatatgaatactgaatctggacaggcacggtggctcacgcctgtaatcccagcactttgggaggctgaggtgggcatatcccttgaggtcaggagttcaagaccagcctggccaacatggtgaaaccctgtctctactaaaaatacaaaagaaaattagtcgggcactgtgctgtgtatcagtagtcccggctacttgggaagctgaggcacaaaaatcgcttgaacttgggaggcagaggttgcagtgacccgagattgtgccgctgcactccagcctgcacgacacagtgaaattctgtctcaaagaacaaaacaaaaccaaaagaattctaaatctgctctgaatagtagaagacaatgggagacatttatctttggtagcaacatattccaaagacttaagagtttaaagaaatcatcattttcctatcgcttccttcctttctctctcaatcctaaaatactctctgggcaatcaatttcggaattctttcaaggaaaggaaaccttgattcgtctgcctgttaactactacaaaatgtgtagattcctgctcttccatgttactactcagagtaataacgaaacacctattattgtcattatctggagaaaagaagctcctatactggattaaatgatgttgctgtgcccataagaaaggcaggtattgggcagtaatgaaggtatggcagcaggaatttatactttgtctctttcatcagagtagctcccccctcccctttttatcctgtaggaggaaattgtggagtgagagaagaggtctgatctgtttggggaaaaagtatcacagcctattagttagaagcaatgaaattgagacagctttgggactccattaagtgtgtggtgtttaggcagactgtgtccctgggtaaagtgtgctgttgaagaggatagtacacaatgaaataattgggcttgggaaatcaactgggcttcagcagcctcatatctccttgtggggaatgggtgagggagctacagctttccctcccttcttttagcataaaagctataccgaataaaatagaagggaatttcttgctgagtagatggactgtgaatatattttgaataacacaaacaatggagataattaaattttgtctggcacaggaaggattcagagcatgtcacttggaaccccctcatgccatgttcttctctaggcgtctggatatatggttgcagcaactgaataaaaataactcagatttgatcagtaatggcagcatctatagggacatgttttaatgcactgatgtgtatgaaattaggttcttaaataaaacattattcctggatattttcatttcaaaggataagctgaaattcacgaacagtgtgaactagactgacttttcccactgagatttactgataggcaaacttttgtgcacattgtggacactggttgagggtaggctcactagttttggtactattaatggtcagttgcctgtagaacttgtgaagtaagaaaaggtatatctatagcaagttcaaggttcagataattgttgttctctcttaagaaaaaggttttgagcggttgtcttctttacacttagtgtatgtaatgatagtttggctaaatatgaagaagaaagagaaatagcattactactgtttattaataacttttctttgtgccacacatttagctattcaggcactttgtgtttgtgtgtatacatatacattctcttatatacatttgcgacatgtggtaaaaggccctactttttggagtcagaaattgtgctcatttctgtatctgccaccttgtagctgttggctcttgaacaacaactaagcctctactttgaacatcaattttctcagtaaaatgagggaactagactaaatagttgccaaaattcttagtccacacacacacacacacacacacacccattttgtacttctaaagacactggaaagaagtttacggatggaggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaatagataaaaccacaaagatggggaaaaaacagaacagaaaaactggaaactctaaaacgcagagcgcctctcctcctccaaaggaacgcagttcctcaccagcaacagaacaaagctggatggagaatgattttgacaagctgagagaagaaggcttcagacgatcaaattactctgagctacgggataacattcaaaccaaaggcaaagaagttgaaaactttgaaaaaaatttagaagaatgtataactagaataaccaatacagagaagtgcttaaaggagctgatggagctgaaaaccaaggctcgagaactaagtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcaaccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatattctttgaaaccaacgagaacaaagacaccacataccagaatctctgggatgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaactcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagacatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatctctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaagaagtttacggataaaagaatgagaagtagactgacattgtacttttcattaacgtgttgaatgcctaaagaatggaaggaaaataagcttaaaattttgaatctatgataaagaaaactattgattaaccatatgcatatttgacattaaaataattcataattaggactaacagatttctggcttaaaaaatctaacaattactttaagaagcaaaagacatttccagaataaagtagggggatatatagaaaagttggtaccttttttaaacagagtcttcttttgtaaggaagtagaatttattcatcaaaggagatttatgaaaagtatggtggtatagtgagtggcctcactagttttaatgattgatatttgaatatagcttagtcttataacaactccccaaataaaaatttaaaattcatttgtatccctttgattttcagtgctaaaaactagattgtgaatgtcaaggaaatatttaagttatttctgaactaatgtatttgtagagagaagaagggagtgtgcacgtgatcgagaattatgttttgaaaataaatgaatgattggctattaaaaaaatttttaagccttaaaaaaaaaaaaaaaagacactgtataaatgttagttgtttgagcatttttgtatatacgtgtatgtccacacacatatacacaacattttaaaataacatcagttattttccctcttttatgtttttattttcctaataattcataccagtgatgtaagatagtggtacccagaccccataatctaagaggaatttgttgccatttgaacaaggaatgtgttgcctcattcatattttcaaaaggatataaatacattgttgtatatctttaggggaaatatatattcagtattttaaccagagttctcactgctgtgttcccacattgttaatatcaggtagtttgcctagatgttcacagtagaagtacagggatgtagaaacatggtctttcttcccaaagaagtcatttttctttaaaatttgtgaaataaatgaattaattgagtcagcctttaacatagtaatccattttgcattattcagctttgattgaaagagacagagaaaatatgttttgtcggggggtggggagaatgggagatagagatttctcagaattaacagggtgctctatagctcaataagaggccctgtatatacagcaggatagatttgtagttagttaaggaaatcttaagtctaaaggttgtaattcccttagaattcctgtaagttaattgtttttcccccactgtaatgcatacccttgaaaggcaggaaccttctgtttatcattgtatcccaagggcctatcataagcacctggtaaccaataaatgttgaactgatatatgaaattttcctgatcttagagattaagtattatcctcatggtctaggggaataaaacatccacacgtccaaaccatagtaattctgtttccatattctgctatctatgggtttcattattttaagtattctaaacttacagagagcaagactaatactttaaaattttattttggtctatagggaaaaaaaaaggttatttgagtttggtgactgtgtccatcactttggtttaccactgaattcacagcagatactaagaagtatctgcattgttttgtttggtttggttgggtttttaaaacagggtcttgctgtgtcacccaggctggagtgcagtggcatgatcatagcccactgcaacctcaaacccagagtgaatggatcttcctgcctcagcctcccaagaagctgggacttcaggaatgcaccatttgtgcctggctaatttttatttttttattttttgtagacatgggatctcactgtattgcccaggctggtcttgaactcttagcctcaggtgaccctcctgcctctgtctcctgagtagctgcaatcacttaatcctttaatagtcccaccaatctattattatctctgtttgacaacttatgaaactgaggtcagatagggcaaatgcagtcatgcaccatataacaacgtgtcagtcaacaacagaccacatatatagtggagatccaataaattataataacatatttttacagtacttttctgtatttagacacacaaatacttgccattatgttacagtactgtactacataggcaactatgctattcagtacagtaacatgctgtagaggtttgtagcctaggagcaataggctataccatagagcctaggtgtatagcagactgtacaatctaggtttttgtaagtatactctatgaagtttgcacagcaacgagatcacttaacaatacatttctcagaacgtatgcccattgttaagcaaagcgagactgtaattgacctaaggtcacacagttaacaagtagtgaggttttaaactaaggcctttgaccagtgctcttgatcattacagagtggtaccaacatggtagcataagctttaagaggagggaaaacttggttcccgtggctttatcagggaagacttcttagaggaggtagcagttaagctagcccttaaagaataagtcttatcttgaactgaatgtatgctagagtcagaattatagaggattagattcagaataaaaggccatctgtttcaagttcctaatttgcagaggagaaaactgggatctgtgaggttaaataacttgttgtaggacatatggctaattaagtggcattagaactgttctcttccctcctctatcctgtgttattccctgtccccctccgttaatgcacactagctcatgttaagtctgttttttcatcaacactttctaataagagttcctaaaaacattttacagcttgaaagtggaggctttcttgtgtatctatgtatggtgatgaggttaaaccaggaaagggtcagggcaggcatggaaggagatactagagatacgtggagacatggagagacagaccttttctatctgttttttgtttttttttcctagcattttactttattgttacatctgtttccttccataagtatagataattgagtgttgagagaaaggggacaaatgaaattctaatgagaaaaaaatgatttaaaattccacaaaatctatggaatttcagcctcttaagtaacctgggatgtttttaactttcactaatgtttattagccagtgtccttcctgccacccacctacaaggatgtctcaaggatgaaatgaggtcatatatgtgaatacacacttaggatacaactgccatgtattggcagtcttgtctgttccctgggcctacactgttccttgcctcaaaatgtagtactatcaggtagtgttgatgtttcattagccaagtggttatatcagatttatgtactgctaaacaattgatctgggacttgggtaaatactcattggaaaaacatttgttgtattctgagtgctccctgttaatcttctcctcctcagatagcaagctagatctgggacttaaggtggatttttttccttatttttttttcctttgttttacccaatgattgaaaatataaaactaaacctttttcagtaaagtctgaatcagcagatacttacattactttggcataggctttttatagactagctagaagaatacagtaattagcatatgcatttcctcattaaaatgtcattagtgaaggctttgttcttttaaggtccttcaaataaggtttattgcattgcattccatcactaatattttaccaggagtcagatatcttacttaggtgtgttgaagcaagggttactttggactttctatagggtaatgacctaagagcagacctggacacacataaatctctatgcttacattgggtgggccctactttatgtactagtaataattaccagtctcttctcacactgtccattcagaatcctttggatatatagacatttagcaaacctagacttgtttgaaagaataaactgttatctgcactaaactgttttccttggttatcttggtaggatttgatttgaaaaaaatgtatgaagaattagaagaaaagaaatttataatgtactataatcatttgagatacagtattatgcaggagtaagaatacaggctttagaatcagaccattgaggattcaaattcttgcttcatcatttactggttgtgtaactttgtgatacttagcctttataaacctcaattgtctgaatgtaatacggaaatatgagtggtccataccttataggaatgtttgagaattcagttagattatgcatgtaaagtatttagcactgctgcctggaatatatgatctattattacattaccggctgggcatggtggctcacgcctgtattcccagcactttgggaggccgaggagggtggatcacctgagctcaagggtttgagaccagcctgaccaacatggtgaaaccccatctctactaaatataaaaaattagccgggcatggtggtgcatgcctgtaatcccagatacttgggaggctgaggcaggagaatcgcttgaacccaggaggcagaggttgtagggagtcgagattgcgccattgcactccagcctgggcaacaagagtgaaactccatctcaaaaaaaaaaaaaaaaaaaaaaaccaacaaaaaattatctttataatagaaaaaaggagtgtgtgtattttcatatgtattgtatctgctttctacacatctttgacttaagaaatcctaacatgaaatttcaaaacaagtaagaaggtatttaaggagtggtcattaatatcattaattggcttaaggcaaactttctttaaaaagtcacacacatggtgtattcaaaataaactacttcacttaatcattttaacatttctgctatgcagcgtgactagcaacttgaaggagcaagttaggaaatgcctttgatgaccccatgacatcactatgttattaaataactggaaataaactgaaaattatgggatagtctttaaggctttcatgacatttcagcattttagggttgcagtattccaaggacttttagagtaattgcatgtcatcctttgtgtgttgtgggcaaatttgggttagctaaaagttggtcagttaaaaaaaatttatattaagcatctactctgagccaggcattgttcttttttgctgtgaatatagtgctgaacaagaacagaagccttgctgtcaaagacgtaacattccagggtaagaaaatagataactcataaagaaggaaatgattaattcagatacttgtgaggctatggagaagataacctaggctaacgtgatagagatgggtggtgaggatgtgagttaaggggaggccttttgcaggttgttgggaggagatgcaagtgttccaagcagaagaaagaagaagtacaaagtccctgatacactaacaatcttggtgtgttcaagggacaggaaaaaggccggtgtggctggaatttggtgttcaaagcaagagaggagagataaaggaagatgagtcatgcagagccttttgaaggctgtgggtaaaatgtatgttatacggaacttagttctaaatctagttgcagtggattaacctggagagtgatgcaaactgagttttactctggaaaaacactgtgactgttgtgtggagaatatgctcccaagtgtagaaactagatcaccttgcatgggccaagagagatggtggtagtttaagactaggattgtagcagtgaaatgtaaagtggttgcattcggacatattttggatagagatttgacaggaggtaggtggattggacatgggatgtaaagtaaaaagaggaagcaaggatgacttccaggagtttagcttgagcagctggatggctgatatcatgtgtaggcatagggaaaggttgtatgaggaagaatttatagggtgtgagggtgtgaagcagggaataattttgttttgacatgttatgaaagaaatgccaattgacggctaagaaaagatgtcatctgggcaggtaaagaatctaggagattgggaaaatgtccagcgtggaggtataaatgtgaaaaccatcagcatatgggattgaaagctatggggctgtttggattccctaggaagagaatataaataaagaagggggctgagaacagagtctcatttataatatcctgataaggaagaagacccagtgaaggagatgaagaaggagaagccagtgatgtaacacaagcatggatcatggcaaaagagaaaaaggtgtttcataaacaaggatgcttggtatggccacctgtgtcagtactgtgaagttgaatatgatcaggacaaataatattaattggggctttatatttctcctttactacaaccgattaatgaaacaaaaaattaacctagcacccaaggtgtttcttatagttggtctctccagtctgttttagtatcatttgttagttatttccccaaactaatgtttagcttctttctccaaaaagaatatattttttttcctggttctgcttgttggaatccccccctccaccatgatataaaagtaatggggcttattgtaagaaaacagaaaatacaagaaaataagggacaagatttttaaaaatggattcaattctgggaacaacaaatgacattggggtataggaattaaaccgtgtgcattctgtctctcaccccaattttatagtcatttgctggggaccttttctccccagggtacttgcatagcttttgtcaagaataacccttctcacttccccacctccttcttctacatgcagatgcagcacttttctgggtaaagttttagcaatgccttccttctaaaatgaaagcattttctcctcacgattagcatctgtttatagaatagttcgtattttcgtaattagatcctgcatagaaatgcaaaggctgctgtgtaaaaggataatgaatctttattgcacagttgaaatcagatttgtgcaaaaggcactttgaaaacagtaataagcagagacatgtattaaatcacccagataaggcacccactttatattttctatttataaatggaaattatgactacccagtggattccatatgacatttcctattaccagcaaaggtttttagctttgaccataaaagttatctaaattcaaaagcctctgtggattcatggctctaagaatacttctggaaggggccaagacagagtggaaagggtcctttgtctttttcttttgtgtgtgtatgcactctgcagaggggaaggttagcaagtggtagaagaaagaagccatttgaaataaccatgataagatctaatcaggaaacccagtgtccattacacacatgtggtaacattttaagactcttctggttgggctccttgagaaccaagctcgtgttcttataagctcatccttatattttcccattgtatgcatcgttgcatggcaaacacaggatttattcccaagctaaacctgtctcttggggtttcttatcttttacctccttggtgagcctcgggaagctagagcattgctctatggagaaaggagggtggcattgggaggaagggtaggaaaaacattattgggaagcagagaaagtcaatgtcaaatgaactgccaaggatgaatattatggctgctgggagcctcggagagtatcgtgtgtcttatgtgtctatttcacagtcggtgcttcatgtgagatggcagtctcgcctggaccgtgcttagtatcgatttactctcaggcatgccagaccattttagcattgctgaaggaaggaaatcctatgtatttccccttataaacagacatatcaaaagtgtatcttttaaacctttttctttctgtcttcttactgttctttctgtcttactgtaactcctcctccctccctgatttaaaagaatttttttttttttttttaaaagaaaaaagactttctggccgggcgcggtggttcacgcctataatcccagcactttgggaggcagaagcgggcggatcacgaggtcaggagattaagaccatcctgattaacatggtgaaaccccgtctctactaaaaatacaaaaaattagccggatgtggtggtgggcgcctgtagtcccagctactcggaaggctgaggcaggagaatggcgtcaacctgggaggcggaggttgcagtgagccgagatcgcgccactgcactccagcctgggtgacagagcgagactctgtctcaaagaaaaaaaaagaaaaaaagaaaaaagactttcttattaagagagcattatacaggccaggcgcggtggctcatgcctgtaatctcagcactttgggaggccgaggcaggtggatcacgaggtcaggagatcgagaccatcctggctaacatggtgaaatcccgtctctactaaaaatacaaaaaattagcggggcgtgatggcgggcgtctgtagtcccagctactcgggcggctgaggcaggagaatggagtgagcctgggaggcggagcttgcagcgagctgagatctcaccactgcactccagcctgggcaacagagcgagactccgtctcaaagagagagagagacagcattatacagagaacaaattgagtagacttttttagaatgatagagtgtcagtaactactcatacctgtgggggaaagaaaaaggcttcaaactttgcacacttctagcccttccatgaaaatagaaggaccttatttgaggctagttttgtggtggtgggatctgagcactgctgagtgttaacaaaagggaataaattgatgccaaatttagagaccaaaaatgccatcattttcacctgcctgaactcttctgttgttttccctagttgctgccttgcgctttttccgcagtacagggagagaaatcagttgtctggctgtctaaactcacggcatctgcttagcagtttcaccagctcatagttgggactcatccctctgtcagaatcctttgctccattagaagggagactgggaccacgttcctgaattgatttgcatacttctacgttacctagctcagacaacatatggccatgtggagcacttggatttatttctgtttcctcaaattaaattcctaaaaaattggataactccacagtttgtttggtgttacaaaaaattttagttccttttttggtcggcaaagcaacacaattttggcattaaaaaaaaatctctggattactttaaaaagagtgttgatttgatttgcttcccctcttctcttacccctttcaggaaaaaaaaaaatgtatgttgaatcttaaaacactgcatcatgttgcaaaatgtccatttaggcacactgaatagaaagtatcatcgagtcatttttattcttgtaattcagtaatcttgtatcttttgcctttttctttttccttaatgttaattgtgtaactaaatgtctcaaacttgggacttttcactttacacatccatgtgtaaaaatacatagatacatacagtcagatagaagaaataagactcagtgttaatagatcagtggttggggtgggggaactatacttaacaatagtatgttgtacatttcacagtagccaaaagagaacaattcaaatgttcttaacataaagaaaagataaatatatcaggtgataggcattctaattactctgatttgatcttcccacattatataaatgtatcaaattatcacgtactccccattaataatactgtatatcaacgaatttttttaaaaaaagaaatagatatcatacaatgaataactggattaatgtgaaatgatagaaaaagttaccattttaggctggatgtggtgacccacgcctgtaataccagtactttgtgagtctgaggcagtaggattgcttgaggccaggagtttgagaccagcctggttaacgatacaagaccccctttctaaaaaaaaaaaaaaaaaagccaagtgcagcagcatatgcctgtagtcccaactactgagggcatagaggtaggaggatcatggatcactggatcacttgaggagtttgaagttgcaggaagctatgatcctatcactgcactccagccgaggtgacagagcagcaagaccctgtctcaaaaaaaaaaaaaaaagttactattttaaatgcacttcaactttgaacagtactaatgtatgaaaatcatcttgtcttctttaggaaattctttgttgcctaaattagggataggtatcatacactggaatgagctctaaaacgatggctcttgctatgggaaacagttttatttgggtactcatgtcttctctcttaagggatcttaggaagaggctacatggtaaagaagaaatagcatgggctttagagtcaagaggcctgagttttaattctcaggctttatttgtccttctgcagtggccttagcaaatattataacctccctaaagttagagttattgtaattgtcgtacatacaatgttatcataagaaaacagtgagataacagatatcaaagtacctgggcagtgtttgacacttggtggtctataaatataaatatcatttcattcctgaaggtaactgcagcacttttgaaaggctggtttgatgctaacacaggaggattagacctaattatatatttctaaggtcttagaaatggggagctaggtttttcagacaatatactgtattttgtttttcctcccttttgctttaaaacagaaggcaatttgtttcaaactctgtgctccaaactggtggcttaattaggcaagtttattgactgtcacagaggctgtggttaaaaactggcaaatatcatgtgactatattagtatctctgagcaaataaagggaaaagacaggattccacccaaccacatttttttctttctcttttctcccaagctcattcttgcactgcaacattccacttataatctgttaattaaatcatttcactccattttatataatttttaatttagcattcattttcaacttagcttttggcttcatttactgataataaacagtgttgcatacaacacatgttccacaaaacactcagtcacacacatacagatgccaataattttttccagtatgtcaggcatattaaaattaaaggcagcatctcccctcaccctttccattactgaatgtgcaccctgtttgaataatacatactccccgacagccagcagtggtctaatgtgtaaaaattatgtgtagcgtgtcactagtacctttttttaaattcgtggttttctcagacatgctctgtggaaggtttctggaatggtcacttcgataccttggatctgtatatttggcttaatgtatacaaacagtaatattttctagacttattactttatgggtttatagctatgtgatagttattgagaaagaaaactctagtgtagcattcaaattacttttcttgtagcttattttttgaatcatagtctgaattctaaatatatgaatatctttaaccgtagatgatatccagaagtttccaagactgcaagctcaggggtttatggaccacttttaaaagatagatactaagccaggcacagtggctcacgccagtaatgccagcactttgagcaagcaagatggactgatcccttgaggccaggagttcaagactagcctgggcaacatactgagaccccgtctctacaaaaagtacaaaaattagctaggtgcggtgacatcttttagtcctagctactcaggaggctgagaggagaatcactggagtccaggagtttgaggctgcagtgaggtatgatcatgccactgcagtccagcctgggtaacagagtaagaccctttctctaaagaaaataaaaataaaacatagatacctgtgttgttgttatagctgttcatatccttagaattaatttaccttgtctgctcctgcatattatttgtctcctcataattagcaaagttccacagggccagatatcaccaaatatgaatagtagattttattctaaggtcagtgagaactgaagaatgttaggggctgactcaatcagatttgtttgtatttatatttggaaaaatattactctccggagaatgttttggaatgtttggcagggtggttggagagacatactacaggaaagaaatgatggtaacttagttggcagtgggaaaagtgagtagtgaattactcagagctctttgggggtgaaatggactggacttatatcagttgaacttgagaaaaggagaagcatcaaggatgatgtaacttttaggtttctggcttgagcagttgtgtaggtggtagtaatttttcatggtgaagatgatgaaatactttttgtacctgtctcatgattgctttctgtacatcaaggtcagaggtcataagctcataaaatgcttggtattagaattcttacataaaggatgtcttctgttttagtttagtaatacaatttggcttaaatcacagactttctctaatctttgttttgattgtcatctgccgagagcttaagacagcaactcacaggttggcccattgagaatctgacaaatgaaaaattataaaaaaaattcagaatccctatattgtagcccaactttctttagcacttctatccttgaatgctagggcagtgttgtatactgtgaagatctttgtagatttttctactctgtaacattttaatagttccattttggggtattacagctgttcagtcctccccatacctcaaattatagttagtctccttcaagtcccaaatttccagtgtacatatgtttcatcttatgtttaatctggacagagtgttggaacgaaatatggaccctgaaaggtgtatgacgggcttgaagtctcagccctactacttgcttaatgtttgatttgctaatccaaacaattataatctgttaattaaatcatttcactccatttcatataatttttaatttagcattcattttcaacttagcagatgctcctggtgtcccacccatacccctctttcccttccactttagttcacaatggccctccttcctcccgctaggccttatattcattcatcttcagggtttgtctagtcaatgaattctgctttgcctaaggagtaggcaggaagtaggtgaaatgaactgctacctgagcaacccacagtcaatgactaatgagagttgttgtataaatacaccagcttccttgcttcttaagtgggataactttgaggtatacattctacactggcttccggagtcctcccagtggcatttgcttctagttgcccatagtggtagttggctgaataattacataccctttattccctgtctgctgtcatgatcttactttcccagtctcctgctattgtttacctcctaaataaacttctcattgtctgcttctgggagaaccccagactaagacaaccactgcgaacattggtttcctcatctttatttattattactgttttttgagacagaatcttgcgctgtcacccaggctggagtgcagtggcacgatctcagctcactgtgacctccacctcccaggttcaagcaattttcgtgtttctgtgggacgtcttacataggcgtattttttttttccggctactaccactatttggactaattattctgaaattttacttgccaagtttcagcttttattagcaagaaaaaatgttatgtccacagtttagaataaaatcacagagaagaaaagttggatgaggatattggtttgcagtcttctgtctgtgtttctgtcttctgagcattcacagatgttcctatccttctttccactggtgttcacataacctgggatcttgtgttgtatgcagtcactctcaaggtaggaactggaagataaagtatgtgggtgacatggactacttagaaggaaactgaagtttacatgttgagcccaattagaagcagctgaagagaggagagaaaaaattaactgagaagtttaataggcacttagagcatggcgaataaagctgagtggcacccacttttcatttcctagttcattctagttgtgcttttttaactgcaaagactaaaaaacgaaagcctttatttcccagtctgtcttgcagctaggattctgggtgtgaatcaggtatatttgctcaagatttggaaggtcgacatgaggtaaaggttattcatcttcagctttagctctttttatctgattagccagggcaggagaagtatgatttttctgtggtgatgtttcagttttcaactcagcttcctagatgttgaaaggcagttatgatgcgatttcctgatcccaggttgcagcttcgctagtgcatttgtagctgggctgctgcaacaatggacttctgtttatggcagaagaaaggccatactttaaccttgtctagtgattttttgtaagaggttggttctctgtattaaatcacttcctacagaaaatttcttaagtgttttctggtttttgtttgtttgtttgtttgtttttaccagaaccctaactgatatagatggttgaagcaaactttatgctgtaaaggtccagacccagataaaaacgagagacaggaaagatgcagcaagatggtctgcaggcctgcccatgcatacactactccatgatctggtgtctgcaagaaaacaaagcaactgctcattaagtaacagggcagctaatgctttagctcttgaggccctgtgtcatataacttctaattcctctaattcatccaccaagggggcagtgaggcagttctctgtttgaatgctacatcgtttctgacttagtgctttgaagtggatgacatcttacttttttttcttatcttagagataaggtgaacagaggaaaaggagaatgatttgcccaacctttggctaaaggagaaaggaaagatttagagtccagtgcttctgacttccctctgatgcggtaacaaggataatatgagtatctaatatgctggggcacagtaagatggctctgaaggtatgcacagtagagaaagccatggtccttgccctcagggtctgtgatcggccactgaggcacacatttccacttcctgtgttccattaattatgctaattttccaacaagccccagccccacctctgtcaattatttttgtctcagccttctaattacaacattatatgaccattcagactggtactaattaaatcattacttaattcacaaagtgtgcgataatgctaatgcttcttgtcagctgaaattacaacatggcacctactttcttcattcttggtagatggggccagggggttgctcttttaccaaacatcttttgcttaccctctgatagccacctgaccatcagccagaacctaccttcttccagaactgggaaaacagtgcagtagacctagcgatatgtacctgtaattcatcactatcatatgaaatcatcatcccagttttgtttgtggagtaaatcttgatactcaagaaaaaaaaatagtagtaagatttagagtactatttgctacattttttgtcatttgttctgcgtattatttttaacagagtaaacagtagcttgtctctttttctcatttctaaaacagatttgttttccactcaattagacttgtgatcacgagaacacaaagtagtatttttctccttctggagagagacataccgtatgatgggcaaattgtcaggaataattataccaaatgatggaataaaatccaatggaaaacatctctctcattgctagtgatacatttttatttaagacacaatgagcatcaagcacatttatgacaaggtgaaattgacaagtggccctctgccatgattttatttttaattgctagtaaactaattagccagaacaacatgttgtataatccacaaaactgtcgctcatgcgttctccaataaaagcaagatatatgatgtggaaaagttctctaagagctagccaaaaaaaaaattatttcagaattttgagtgtatagacatcacagtaaaagatgtctcctcaccagtggaagaacatttgtatataacatttgttttgagatctgaacagaaattaaggacaaacagtaaatttttttcttttccttttttttttttttttgagagagagtctcgctctgttgcctaggctggagtgcagtggcatgatcttggctcactgcagcctctgcctcccgggttcaagcgattctcctaccgcagcctctcaaatagctgggattacaggtgcttaccaccatacccagctaatttttgtatttttagtagagacagggtttcaccacattggtcaggctgatctcgaactcctgacctcttgatccacccgcctcggcctcccaaagtgctgggattacaggtgtgagccactgtacccagcctgttttttccctttttaagatcaaagtatgcatcaaaatagccaaccactttcttacatgtaattaagttttatgtagttgagtcacattaagtctaagacatacattctaggactaagactttacagtcattcagtagttacttatttgtgcaaggcttggcaaccttttcctttaaagggacagataatacatatttttgtctttgtgggctgttcagtctttgccacaaccactcagctctgatgtagagcagccgcagtcatagataacgcaaaaataaatgtggcagtgttccaataaaactttatttatggacacaaaaatttgattttatgtaatttttatttgtcacaaaagataattctttgatttttttcaatcatttaaaaatataaaagccattcttagctcatgggttatacaaaaggcaggggtgtggatttggcctacaggctgtagttgccaacctttcctctgtacctgctgcatgccagcgtcactcctcattctttagtatcagacgtgtgttaggcagggtgctaagcatcgagggatattcagagatagagcaaagtcccttccctgatgaagcttacagttaagctagaaaggaaccatagatgggacagagacacataatattagatgttaaatggtgtccctctgtgacaaaagccaccattgctttacaagtttaagagagagggaagtcacttcagctgatttaggtgatctgctaagtaagacatgacctggctagctacggatgcatggaaatgatgggatatcagctggatcctgaagaaaaaggctgtggacctttgaaaaggtaacagggcataatgcctccttttagaggaagggggaactgaggatggcgaaaatgtcaaccatgagtcacttattcctatcatttttcccccaattctttctttcatgtcttctcatgaaaatttcaaacatatagcagttttaaagaatgttacagttaatacccaaatactcaccatatagattctaccattactattttgctatactgttttattgtatatctatcctatcctcttttgttttagaattctggtctcgctctgtcacccaggctggagtgcagtggtcactacagcctgcaactgctgggctctgcctcctgagtggccaggaccctatgtgtgtttcaccaccatgtttggctaattgtaaataatgttttgtagagatgaagtctcactatgttgcccagagtggtctcaaactcctgggctcaagctgtccccctgtctcagcctcctgcattgttgggattacaggcatgagccaccacacctggctgctttattatatatctgtccttctgtctattcattaatccattttatttttggtttattttaaattaaatttcagacatcaagatacattttcataaatatttaagcatgcatatcattaactaaaatttaatgttggcttatagtttttcttcttttggtgtaaaatttatatacaattaatcgtaccaacattaaatgtacattctctgagatttggaaaggctgatccttttgtagcctaaattggaagatacataaagttttcatcacctcaggaagttccttctgtcagtccttgcccccagcctacccctggaggaaccactactctaattttctctgctttaggttagtttgcctgttctagaatttcagagaaatggaatcatacagaacctatcattcggtgactcacgcctgtattcccagtactttgggaggctgaggtgggcagatcacctgaggtcaggagtttgaggccagcttggccaacatggcgaaacctcgcctctactaaaaatataaaaattagccgagcgtggtggtgggcatctgtaatcccagctactcgggaggctgaggccggagaattacttgaacctgggaggcagggattgcagtgagccgaaatcatgccattgcactccagcctaggtgacaagagcagaactgtgtctcaaaaaaataataataaataaagaatctatcatttgggtttggctttttatcatcatatattttgtctttacttgcttagtatctagcaagaatataaatgcaattattttgccagagaaaagtatatgtttgattaaggaaaacataaaatacaactttgtttaaatatctgtatgtatattcttaaattattgtaaaattaaattacctatggattaaatttttcacattaacattacttagtctattatgctccagcattttacatatttatgttatttaattaaaatctttgcagtagatatttcccattttgaagaagaggaaactaagacagcgaataaaataataaacaatattatttcttacctcttactgttgccacttcagtgtcagggaggaagagggatagcaaatgtaggaagggtgtttgcaaggtgagtgaaggtgaagctgctttgttacaagttttcttatcaagaaatggatagaacataggagtagagaagttcaataggaacatgcaaaatttgtctattgtaaaagaaggaagaaaactggagaatttaaggactattttttaacatctatgattaaaatattatgaaacaatatctttttaaaaagtgatatttttcctctagtataacacaagttgttagaaactaaggaatcaccctatcttctttagtaaaagcctacaactggtagagtttttttttttttaaggatctcaagatacttcatgaacctcaaaagactttaagttctctgcaatgttaggaaatgacttcatgaatatcacagttcaaggttctgctactgcttttagaagcccccaaagtgtgaagacatctagtacagtatacagtaagaggagaactggcttttattgctcacaataggaatgttcccatctatctgtttgcaaaccaactcataaaatatttgaatattcttcactctgctttatgataatatttcttggcttggaaatttgctttttttttttttttttgagacaaagtctcgccctgtcacccaggctggagtgcaatggcgtgatctcagctcactgcaacctctgcctcttgggttcaggcggttctcctgcctcagtctcctgagtagctgggattacaggtgcccgccaccacacccggctaattttttgtatttttagtagagacggggtttcaccatgttggccaggctggtcttgaattcctaaccttgtgatcctcctgccttggcctcccaaagtgctgtgattacaggtgtgagccactgcgcctggctgaaatttgcattttcattaatagatcatccttatttaacaatgaacttcctatgtgtttgtgacacatggaaaataagtaggcagcatttaatgtcatttgggaagcagtgcttatagtagttcggtttacattcctcatacagccatgtgccgtatagtgatgtttccatcaatgactgcatatgcaacagagtcccacgagattataatggagctgaaaaattcctattgcctcatgacatcatagcctggtaaggttatagtgcaacaaattactctcacttctgtgctgatgctggtgtaaacaaacctactgcgctgccagttgtataaaagtacagcatatacagttatatacggtatataatacttgatagtaaaagactatgttactggtttatgtatttactatactgtaattttacacttattttagtgtagtccttctactagttaaaaagaaaaaagttaactttagaacatctcaggcaggttcttcaggaagtatttcagaagaggcattgttatcataggggatggtagctccatgcatgttattgcccctgaagaccttgcagtgtgacaagatgtgcagctggaagacagtgttattgatgatcctgttcctgtgtagtcctcggctagtgtgcatgtttgtatctttgtttttttttttttttggttggtttgtttcttagaaggggtcttgctattttgcccaggctagtcttgaactcctgggctcagtggtcctcttacctcagcctcccaagtatctgggattacccacatgcaccactgcacctgtctgtgtcatagtttttaacaaaaacatttataaagtaggccatgtgcagtggctcacgcctgtaatcccaacattttaagaggctgaggcaggtggatcacttgagcccaggagttcaagatcagcctgtgcaatgtggtgaaatcttgtctctacaaaaaatacaaaaattaagtgggcatgatggtgtgtgcctgtagactcagctactctggaagctgaggtgtgaggatcacttgagctcaggaagtagaggctgcagtgaactgagatagtgccactgctatccagagtgaagccctgtctcaaagtataatacaatacaatacagtacagtacaatacaatacaatacaatacaatacaatacaatacaatacaatacaatacaatacaatacaatacaatataataccatacaatacaatttaataaaagaaaggttatagaatatggatataaaggaagaaagtatttttatacagctgtacatttttaagctaaatgttattaaaaaggattcaaaatttgaacaatatataaagtaaaaaacattacagtaggctaaggttaatttgttattgaagaaagaaatttttaaataattttagtgtaaccaacatgtacaatgtttataacatctacagtagtatacaataatgtcctaggccttcacattcatgcactgctcactcactcactcacctagagctacttccagtcctgtaagctccattcatggtaagtgccctatacaggtgtaccattttttaatcttttatactatatttttattacgtcttttctgagtttagatatgtttagatacacaaatacttgccatcaggttacagttgcctacagtattcagtacagtcacatgcaagtttatagcctaggagcaataggttatgctatgttgcctaggtgtatagtaggctataccatttaggtttgtcgaagtgtattctatgagttcatacaatgacagaatcatctaatgacacatttctcagaacatattcccatcgttaagcaacacatgactgtgcttagtcttctacacaggcttagtcttccttgttaattgaaactctatgtttcttctcagtttaagaagcttatttcaggactaattttcccccttttagaataagtttcccacatcacttggttacatgacaaaacaagttaaatcactgtccctttttgggtttaatatgtccagatgcaaattaaagaaataaaatcccttagatttttctgtatcttgtctcccttcctcattttctgcagaacagtttttaaaagttaatttaggaaatctccaaaatattagattagcatgacttcagagctataaggttcctgaaaagtttatgtagaaatgttgtttttagtgctttaatttctcttatagcatcttgatgggtagtcattctgcctaaaggagaactgaactcatcctgtgtcccaggagctttgtcatatgaaaagttgtaatccattctggtgcttcagatgttgaaggcccagtgaaattctacaagatggctgccacttgagctttggccttgcaagtggttaggaagatgttggtcctttaatctctgtacaggggttcagaagtagttgatagtttactaatgaaaaatgttatatgtagcaaaacacaagcaaaaaaatcaaaaacactgatgacttatataaattattaacttaaggaagattatggtacttgaaaaattattttacaaaaaaagattgtattaggaattttttctgctcttttttctcaagttagtaccaatgtaacatggctgtgttcatgtaatttcttttctcaatttggttcaagatttgtgtagctcccagtggtagattttgcggttgtattgcatgattaaagtgtccatcaaaatcttacagttggtaaacagtattaaaaatccatctccagcctctgtaaactgtacagagagctatgaatactagaagaaatggaagtattttaattaacccaagtaggactaatcaaagcagagcaaccagtttattcaattgaacatgtaaatgtctattcattcttgacatggcagaacatttatgtcatctattaaaagctattctgttgcttgtatgattataagctattgttcaacggggaactgaatcttgtaaaggcttccccaccccactttttgtttttttgagagggagtctcactctgtcacccagtctggagtacagtagagcaatcttggctcactgcaagctccacctcccaggttcatgccattctcttgcctcagcctcagcctcccaagtagctgggactacaggcgcccaccaccatgcccggctaattttttttttttttttttgtattttcagtagagatggggtttcactgtgttactcaggatggtctcaatctcctgaccttgtgatccgccctccttggcctgctgaagtgctgggattagagtcgtgagccaccatacctggcccccccttttaataattacatattacagattattttttaacatgctttttgctgtattcaggccacttcagataacccagcttcttgcatgaaagaatacagacttgggtaacttggttcagctaccctgccatcacctctttccttcaaagggttttctcttcttcatttcttcataataattcttagtaaatatctactacatgctgggtacatgtattctaagcatgttatatgcagtatatcatttaatttttgcaactatattgttattttttccattgtatgatgaagacatggaggaagagtgttgcatagtgctgtaagtggtagaaataggatatgaacacaaatctcagaagatccattgtgttgaaatgaatttgagttgtaccaaaggtgattgacattagacaccaggaagaaatttttgaaatgagtggatgctctaaggagccttttaagtgagtacagctaaaaggggttggggtgaaggtagtttcctgggattttttattaccattaagacacgtaaaaacagtttgtataaaatcccatttttcatgaattagttacattcttaccttgagccaggaagttaaactagatggctgtctgaagacccgggtaatacatttaatacagtcttatatgtgtataaaaagtggaaacaatgattcttttaacttttaaatatgaatttttattgcaacaacaattagaaaatataaataatacttacacccctgccattctaatgtaacacttagttttgggcctacttttttctggtcacttttctcatgcatttaaaaaaaaaaaaacaacctttttaaaggttttaaaaacgtttcttaaaatgtagtgtattatatttatgcccaaaaatctatccatgttaagcatataattcaatgagttttagtaaatttgcagagatttgtaaccatcaccacaatatgatacagaacatttgcatcattccagaaaggttcatgagcagtctctcttcttctccattctttgatttcttaaggtggaagtgtctgttactggtttactgtttcttcctttccaacataggtgtttatggaacttctttagctgaagtcatgaaaatttgtatattctatttttatttctattccgttcaaaatatcttctgatcgctcatgtgattcattctcttaactcattggctatttagaagtctattgacatatttcaaaatatttgtgaatttcccagattttcttgttgtttgtttctaatttaattagcaatacagaaaatatactttatgtgatattagtcattttaaatttatagatagttatggcctagcatatgatctattttgatgatgtaccatgtgtgcttaaaaggagtatgtactatactcatttggggtggagtgttcttaggtcagtttgtttgatagtgttggtcaagtctactatattcttgttggttttctatctaggtgtcctgtttattatttagagtggtatatcacagtctccagttatttttgcattgtttgtgtctccctttagttccgttagattttgctccatctgtttcggggtttgtagttaggtatatccatgtatatcattgtatcttcttggtgggtagacccttttatcattataaaatctctttgtctctagtaacagttttgctttaaagtctgttttgtcggacagtattctctctcccctttattattaaactacatttaatttgtattaaactacatttattgttcacatactgtttttcaatcttttttaaacttatttttgcatttgtatgtaaaatgtatcgcttttagaaagcatatcattgggtctcttttgaaaaaaatccagtctaacaatctcttttttttgaattttaaatttatttatagttaatattattattgatttgattggatttatgtctccattttgattttcatctttttttgttcagttgattttcctttactgcttcttttgtaactaaataggtgtgttttagtgtatcatttttattacttagttcatttttgctctatgaaaatatttttttctgaatgggttagggtttatacatgcattctaccttaacacagtctattttagtttaatactgactttgtattaaactttgtcagtttaataatgactttgtattaaagtctgtgcagtagtatgcacaaactttgcttcactatagatccatgtcaccatcttttatagctattattatcacatacatctatatatcttatatacccaacaatgcagtattgtaattattgctttgtataacctatgcttaaagaagttaagacaaagacaagaaaatagaaaaatgtatgtatgatttctttcaacatataaaaacctatatgcttactgtttccattactcttcattttttaaatgtggaattgatttatggcttggtagcatttctttggcacacataactatattctttctctctttctttgtgctactattattatatatattaatctttctatattatatgtcctacaacacaattttacaagtactgatttatgtagctcttttttaaatcgttagagacaagaaaagacaaaaattatatagcctcctatagttacctacatagttacctttaacaatgtttatttttcttcatgtggatttgaattaaggtctgttgtcattttgtttaatcctaatgaactttatgttttgtaaagcaggtgtgctaacagtgaattctttcagtctttaataggggatttcttaattttgccttcattttgaggaatatttttgctagatacagaaattttggttgacatctatttgtttctttgagcacttgaagacatcctcccactgtcttctgccttccattatttctgattggaagttggctgttcatcttattttgggtgccttgtacatagtgagtcatttttacccttgatactttctagatctcctctttttctttgcctttcaacagttatatatgaaatgtgtagatgtggatctctttgtgtttatcctacttagaattatttgataattttggaagtttagattaatgtttttcattaaattgggggaggtttttaccattatttcttcaaatactttttcagaacctttttctcctcttcttggaatctccattatgtgtgtgtttgttatatttgaggtgtgctacaggtctgttatgttctgtttattttcttcattttttccccctgttcttcagatttacaacctggatcaatctgtgttgaaatgcactgattctttcttctgccgttcaaatctcctggtgaggttctctagtgaattttttatttgttactgtactttcagatttcagaatgtccaattggttctatttaagaatttctacccttttattgctattctctatttgatgaattatgacatcatgcttcccattaaatctccaaactttttcggaaggggatctttgaatgtgtttataacagctgatttgaagtctttttctgttgagtccatcatgtaggctccctcagagatagtatctattgacttttttttccttttggaatggtaaaattttaattttttgcatgcctaatatttttgctgaaaactgaacattttagataatatattgtagcaactgtataatctgatttccccatctcttccctcacacatacctagagttaatggttgtttcttttttgttttttgtttttgcttgttttgggtttattactttagtttcttactggaatggttctgtgcagcatgtttccctcataatgtgtggctgctgttgtctctactccattgagtttgccaccacccttaccacttatataagcctagctttctagggaccacccctgaaatcaaaatagttgagtgctcagttaaagattggctagagattgtatctaaacacttagaacccctaaatcactgccttctgcttttatgatggatccataaatgatttggggaatgaatcagcagtcagcctatttaccagtctggcccaaatcttaatttttgtgttgtaaggcctcatgctcagcagaaataagtagcttactaaggctttctgcaggctctctgagcaagtgtgcagctttgtgcatatgcacagctttccaggccatcagagataagtaggatcgcatcaatgccctctttcagttcctggatctgcctattaattttctgactggcctactggtttgttgcttgcttcagtcagttatgagatttcagggtagctgcagtgttgtcctttcctgattgtttgcattaagatcactattgtttttgacaataccctttgtcatagaattttccacataaaatcagtcatttctaggatcagagccttcatcttcacagcacacccaccccgacagcacttctgcatcaggaagcaggggtggaactagggagtgggagtagcaccgcactaaagtgctatagactctcactgttgtcaatgaggttcggtgagttttcttgaagaaacacttctcagtttattgcatgcctttggtcaatttccagtgtcctttagagattgtttttgacaattttgttctgtttcattgtttatttttgtggcaaggatttgccaacctcctcactcagccattttggaaggtctgctgtcttgggtatgttgttgttgtttagaaacatacatgctacaaagtacactcttgagtatacagctaaagatttcttacatgtgaaaacacactcgtaatcaccacccagattaagatacaggacatgtccagcacccgttaatctttccttcctagccttctagtttcatcccagagttaaccactgtcctgacctctgtcattacagattactttttgtaatctgtgtggtttttttgttttttgttttttgtttttgagacagagtctcactctgtcgcccaggctggagtgcagtggcacgatcttggctcactgcaagctccacctcacaggttcacaccattctcctgcctcagcctcccgagtagctgggactacaggcgcccaccaccatgtccaactaatttttttgtatttttagtagacacagcgtttcgccatgttagccaggatgatctcaatctcctgacctcgtgatctgcccgcctcagcgtccaaagtgctaggattacaggtgtgagccaccacacctggcctagatatgaggtttttttgtttgtttgtttgtttgttttgttttttttcttgagacagagcattgctctgtagccaggctggagtgcagtggcgcgatcttggctcactgcaacctccacctcccaagttcaagcgattctcctgcctcagcttcccgagtagctgggagtacaagcatgtgccaccatgcctggctaatttttttgtattttagtagagacagggtttcaccatggtagccaggatggtctcaatctcctgacctcatgatccgcccacctcagcctccctaagtgctgagattacaggcatgagccactgcatccagcctataatctgtgtgtggtttttaaacttcatttgaatgaatatttaaaatatgtcctctttttcctctagcttcttttactcaacatagtaacttttgaaatttatccatgttttaggtgtagcagggatttttaattttttaattgttgtataatactttattaatagatatgccacagtttccttattgtgggacatttgggttatttccagtttgtggctattattaatgaagctgctatgaacatcctcctctttgtctttctatgagcatacatacgtacagttttaacgtggtcagcaacataatgcatgtgtaatttaggctcttgctcttttttttttttgagagacagagtcccactctgtcacgcaggctggagtgcagtggcacgatcttggtgcactgcaacttcccccttccaggttcaaatgattctcgaacctcagactccccagtagctgggactacaggcgcataccaccatgcccagctaatttttgtatccttagtagaggtggtcttgaactcctgacctcaggtgatccgcttgcctcggcctctcaaagtgttgaggattacaggtgtgagccactgcgcccagcctggggtcttgcttttttaaacttagcattatatcaagtgtttttccttatctctgtcattgtcatgacaagagtcattattttttcaggtaggtataccgaaagctatttccatttctatttttagaaaaagtcaaaggcctgtatttaataattactcttgacaacacaggtagcagttgatgctcaattcaataaatatttgttttcaacttttaaagaaaaactccagaatcgtatgctttttaaaaatagtatttgattgaagattaaacaaaacttactgctttttctgccccttgaaatgttccataactctatgcaattcacatattagtagtatcactttttaaatgtacaaaagcagacattactgagagccttggcctcaaaacattcatttgattgcctttctttaaaaacatatttcatactgggttatggaaaactcagcatttggttttggatataaataaagccatatgacctttcatatttaggagctgaatccctcttgtagaaacttgtgatgttgctttgcccactttcctaccctccctaccacgtcatccaacacatgtgcacttatgctcattcacatacacctcgcaggctctctgtgtcctgggacctacacttcacatagtacttggaaatattttctcttgaggaaatggatattagagttgcaatggtataggaactgtatacgtttttcctatctatactgtggtttttcttttcaaacattgtcgagatttctgatggataacagtagttgtgaaagacacaaggagaatgggagggaaaggaattgcttaatggacctcacataattgtgactatgactccaggtctgctgcgtttagaaatggaattgcgggcagatacatttgtcaaatttaacttaatcccttggcttttatctgatgtatatttttccattaacacagtatacctttcatctctactttcacacagtcaaacagcgtctaatttttggtggactttcttttcttcttttttgatgctaacattatccccgtagggtcctaatcaggttttagactatggagagaagaccataagaatcaccaaagcggaatttcccattgctggtaaagagatgcccaagatgcagaaggcttgaaataaatcgggcatgaaataagtggcgttacagccctatactggctttaccgcaagggttaaatttgctcagtgtctgcaatttcacctttcctgattgtcatacagagtgagatcattgtccaaaggttgatcatgtggaggatgtatgtgcttttgaagtgatcaaactaaaagagaaaacaaagctcatggctgaagtcatcacacctgaataccatcttgtgatgtcatggttttattggtatgaattctaaccaagctgtgggcatttaagtcatatttgtggatcagaagccatagatatttgcgcttctcataggctgtgcttttctgatactttgatcattattatatggtaactaacatatattaatatattaatgtattatatcatatttatttagaccccagtatggatactaaatgggataaagcatatgccaagattttttaggtcttgggattatttaatttttttagaactggcgttcattgattgtcattcacgtttctcttcacttccttatgaaaagtttctcaactcttctctcagtattttcttttcccctgtgagatatgtttccttttacactttttcattcctctaccaaatagtaataattgcaaacatttattgcatgtttatgtgtgtaccaggtgctatgccagttgtttttatgtgtattttctcagttgctgtcttaacggctctgtggtatttttatccttggtttacagatgaggagactgagcctcttttggtctctttccccctttaaagataaactcctcctatctccttaaactgagcttgtaacctggacctctgattcaacagcccacaccccaatttgtatttggctatttgtattgggctatttgggtggtggtcctttgaatgttgttgtgctaatggaggcctaaacgttgaatcccgtgaatggaaacctcttcacatctttactgcttgtcctgggatcttcacacctggaatattgatcttcaccgagtaatttgggaaaaacagaggcagaggctggaagctgctcaccgtcctatggcagggcaggtaatgtccttaatgagatgggcttattccagtggagcagtggtggggaagcaaaagcttggtgttctctcctcatggttgcgaaaatattcacataaaagattcactagctactgttaataattgaaggactttcctcaaaatccatgtattataacggtttaatatactaaaatgatttggaggaaatcggcctcagcattggtgaatgtgttgacatatgaagctattatttttataattcttattttagagatggagtctcactgtctcacccagcctagagtgtgttggcaagatcatagctcactgtaacctggaactcctgggctcaagtggtccttctgcttcagcctcctgattagctgggactgtagtcacatgctaccacccatggctaattaaaaaaaaaaaaatgtgtggagacaggatctgactatattgcccaggctggtcttgaactccgggcctcaagtgatcctccagccttgtccttccaaagtgctgagattacaagtgtgagccaccccacccaacctaaagttgttttaagcttattgtgtgcatgttggttgtgtcaccagccgggaggggcttataggctgcaacactgttttctttcctatactacctttattatcacgtaataactaaaatacgtactatctgtttttaggtggatgctctgcttctcttgatagatatgaaagcaggatacctatcttccacccctgtgtttttcttttttcttttcttttctttttttttttgagacagagtctcacactgttgcctgggctggagtgcaatggtatgatttcggctcactccaacctctgcctcccaggttcaagtgattctcctgcctcagcccaccatgtagctgggagtacgggcacccaccaccatgccgggctaattttttgtgtttttagtagagacgggggacgtgatttcactgtgttggccaggcttgtctcgaactcctgacctcgtggtccgcccaccttgggctcccatctactcagatgtcctgtcttcacaggggccctctttgaccaccctctgtaaaactgtactcatattattcactattctttaccttgaccctgtattttcttagcacttatcactattcgatataacattttatattcttcaccaccaacccagactagaatgtcaggtccctgaaagtgaggtatgtgccatactcaccactttctccccagtatccagagtggtgtgtggtacatagcgaaactcagtaagtattattgaatgaatgaatgaacacagatgactagaaaaatttctagaaaattttaaaacatgggcatattagccatgaatttaatttatagttttgttgttttcttttgggtattcaaaaatataatttcatttgtttatatctctaatgagatagtacagtatttgtgattcttctagtgtgatggcatgtacagtttcattggtgagtatatgtgacctactgtgccaggtggaaatggagtgaatgaacattttggggggaactaaaaagcaattttcaacctttttgataagctaggttaatactgtcttctcaataaaaagtactttttcttcctcttataatgttcatggtcttcatctgtatgtgtatattgccgatttaggaactaaagccgaaatggatctcagactatttcccacagactggtagctgtatcccctctgtcagcaagtatttgatatcttcagtgaaaattgtttctttttccacttttagcttctgtttagttttacaagtctaaacaatttttggcaagtgctaggggctcacctgatgcactttttaatgcattccactcctcgttgttattttctctgtccagtacacatggtgctccttccccctcattgccatcccactttggcagaaagcattatggatgctgtgtatgtagactcatcacccaagccagcatgcatgggagagggggcctctagaataataattgttacttggtgttctctgtactactctgtttaatctccctgcttaccacttactgccttcgtaaagtaagctcaatacaattatttattgcaatttgtgtagaatgtcagatgtggaacagactttgcacactcatcagatccagcccctttgttatttagatacaaagactgagccctcagagaggagtcttgcactagactctagacctcccttgggcaggggactttcttgttcactgttgattcctgcttgtctaatacagtgtctccatgtaataggtgctcaataaaaaatattgcatttttcaaagtctcatatgtaagtagtgatggcagggccagaacttgaaccttgcatctcctagttatttgttcattgtcactgccacaattatctcattgtagtttaaagagagtcagcttccagtcttttaaaatacaattacctttaattcatctgtggtaaacaaacagcagctgtctctcattggcatggccgcagttccaccactgagcaattctagaaactgacactattaaccattctgctaaaaaggactcttctactcatatgatatcctggctgtgtccaaagtgtaatatttaattgcattttcttaatctttaccactgtattgctaagctttctaataccttcaaaataccaaatctcaggcttatcctaattaaagaatctcaatttaatccataatgcatgacaattcaatttgttgattgctttttctccccctctttgtgaaattcccgtcaaatgtattaattcaacatgatgaatcctgtattcaacccactggagtgaataattaaaattagctgataaaactttcagcagaattactttgtgaaattgctgaacagatgtgtcattttaatgaaaatccacagacaagctccttctccccctcggcaggataaaaatattatcccctcggcacatacttaatttggtggtaaatacactcggagcgattgctggaagggaagaaaaagcaacttgtcacacttagtaacttgatttttccccagcatgcagtaacagctatctacagtaattcatagtgctctattgttgctgcaagtcccaaagagaacttattaaaatgcaataatctcctatttaaacagaaacaataaccattaaatttcctgtggatccaaaattgagcacaagccccatctggtaagagtgattagaggcctgatgagggaatttaatttgcaacattcaaagactaaatctgagcagatcttgtcacctgggactcgagtgctgcttgctgtcttcttaaaaatctcgacctaaactgaaaatggaatgtagaagtgaaaatgttacccaggggccacccccaacagtattgtgtttcattatgtctccagcaggcctagtgagcagaggggattttagtgctgtccgctttagctttgccggcaaggccttttgacaggaccaacactaatgctgtcatttcctctactgccctgtgcatctgtcatgtggctgcccctcttagatcgtggactgcctgctccctcccttcttatttactttcctcttttagcttagcaagtcctctctctaactttaagagttctctagatctcaccagtctccctttcctgtccaaggagtcagatgctttcagcaggctactttgagcaccactgtatcatgctttacattttatgtctcctccttgcctatagacagtaccccctctgagtttattattagtgttttttttttaactgtaggaggactaagatttattgcatgttattagtaaatacaaattgtcattttcctcctcttcttagcttttctcttacaatcccccaccttatttatattacttctgagctccagagaaacaagatatgcgtgcactcatcatcagagagatgtgtttctgtgtatgtgtgtttgtgtgtgtgtgtgtacatgcacttgtttgtgtgtggttataggcctgatcagacagatgtcagtttatcaattagtagaactccctaattaagtatttgctttgagcaatagagctcttattggttgtgaggtaacttggcaggagggaggcagttaccgatgtaatagagatgcctgagcagatagtttcgttgagcagatactatttgatgtcctttaatcatcagactcctccacttttccttcttctgggctcctgatttatccctaaacaatcagagcctctcctccataattttatgaactacaaaatttacaaaaatgttttacaaaccctctgcctccccagtatcttctccagcccccatgtcttggggcaggccacatcaggtctctctggctgcttcctttcccaggccctactacctactctggcccatcatatgtcttttgagaagatgatttttcagttcttttctttagtttagaaaatcagaattaattgattaatttttaaccccttctacctttctcctcccctaccatatgaattcatgcagagccagccctgcaacctaattttttttgttttgtttttgagacagagtttccctctttttgcccaggctggagtgcaatggtgcgatcttggctcactgcaacctctacctccggagttcaagggattctcctgcctaagcctcctgagtagctgaaattacaggcacccaccaccatgcctggctaattttgtatttttagtagagacagggtttccccatgttggccaggctggtcttgaactcctgacctcaggtgatctgcccacctgggactcccaaagtgttgggattacaggcgtgagccaccatacccggcccctgcaacctaatttttaaggagaggtggtaaggttcattccatgaatcataccacttggaattcttgaaaaattaattgcatttattgcacacctactctctgtaaggcaatgtacataagaatggaggagatactaagaaaattgagtcccactcctattgccgatcgggaaagtacggcataagcacatgaatatttagaggtcctgtggtttaagtaacggtaggtaaggaatcattgggccagatgggatcagtgactcactgaatattataatcagagatgtgagtgcagaataaggaggagatatgactggggactggtgtagttcttagaggttgcctgagctggctagcgtgacattcctactaagcaatgagcctagcaaccagaatctcccagccccggtagccaaggagcacaggtggtaggctatagaaggagatttaatgcaacacagctgggttcaatatggtgcctctttcagagccctggctacaattgatgtaacctggtaactagtagctttgactttgatgtcagacacatctggttgtgaatattccctgaaccactcttaagagtttctcaactctttgagtctgagttttcttgattgtaaaatggtgtttgataatacatatgtggttttcatggggattttgtaaagtgcctggcatatggaaggagctgggtaaatgatggtagtacacttataatcttaagggcagaaggaatgaattaaatacagagtgaggcctagggactcttgctatgctccctcctgactccggtctagtattactaacatctttccagaaaccattcttctttatgttggttttggccctttgtgtccccatctctagccctttattcagttggtctgctcaaggcttgcatgccatttttggcattgaacatgtgatcctctagtttaatatagcatgtgcaatatggtaatttaagaaaataaatgtctgtatgcatagaaaacacagcatcctcctttaattcatgggtttatgggagattacagttttcttttagtttaagcctacaaagtgtttatagtaaaaaagtttcaatgaaatgatttccaatttatatttccttttcactcaccaccacaagtcagaaatcaaatcttatgcttagaagaaagcaactccaggactgtatccacttcgggttttgaataacaacagtaaggtggtctgactccaagattaggtccttgttgtttggacatatctaacaaggaactccatccccaagtgctggagaatccatgaagtcagtggtgtcttatgaagcttgagcaattgggaagccttcccagtcagctttttggcctcctctaggtcttaattacaaagcggattcatggtcctgcctgaaatctgattgagacatagactcctctatcccaaatgatatcattatcaacattggttccctgtggtacacatttgtcatattcattatgatttgtacctaagattccaggccacaataatagggtaagagtgtataatgggaaaaataacacaaatcgttttgattttctttaaggaaattcattgccttaacattacatacttgcctttgttttaaaactcactctatgccttatctaagaggagtcaatataaaagattttaattttagccccatatgctgtagctatatataaatgttctgtaaaatatatcccctagataaaagtacttactacttttttgaagttttttttaaaacctttcttttggtaaataaaagtctttttagctttgatgtgactattacacccttggtttgggttctttctccattccttcatccctagcccctgtgggacccctgtaagaaaaatgggaggggagagaagcatgaattccttaataagtcccaaaggtaatcaaaagaaagaaatgcagtatgaacaaactcacaaaatattcttgtgcttctttggggaatacttaatgcacataaggtcaggcctttgtaatgttaatttgagagtgttaggaagaaagccatcattttacaggcaatgttgctctctgaaaaaagctttgatttacagagaaatgctgttctaacacacctgcattaaaccagtgcctgccgactttgagaggcctgagttgcttgagcagaggaaatgcttcattgaggatgcttagggcatttggctgaagtggtaggaagtttgccagaggtcctattttcctgtggtcaaaacaacctgttcagtttggatatggtacagcccctattctttagacatgtgcagagtgacagcacaattccgcaatggcctcctttccaagattggccttagggagggaagtcttaccagacacagtggcaacatagttagtataggtatcttggttatagaggttagacatgaatagcctggtttccacctcaggtggttgcccgtgccttctcatcaacttgtaaacctccatactgtgtagaggagattgtgtggctagaaggaatggattcatcccaaacccccaaaacaggattcggataagtgaccatccagcctgcaccagagcattgccagagactggccattaattatcttcagaggcctctcagttcatctttggctctcctctctcatccatttctgtttcttccttcttccatccatacttcccctgctctttcctcctgccttttatattggtctgtattctacttttgggtgttatacaaatcagaaaacatttttatgttaaaacaaattaaatatgaatactctttgtgaagtgcctgacatgcagtaggcactcaattacttcctctcttccatcctactgtgtgataactcttctagtaattgagattatgttatcatgagactacatgaaaatattatcatgccccttctgagttaatcttattcaacctggtttctcatcccttcatcttcttagtctccctgccctcaaatagtccactgtgtgtgcacgtgcgcacatgtgagtgtatcttaaagtacagttttcaaaactagctgcacttccctatgttgggtctgatttgccaattttttatgaaggaataagcaaaaagaaagagagcaagagaggaagaggggagaaatgccgtgcttttctagaggagcaaatatatggaaattacccttgtttcttctctaaagtagtaaaggtcacagcagtagttgcaaaacccgtaggccgcctactgccttccacacattcagcattactattcttgcctattttacccttaggcatcctttatttcttgcacagatggtctcactcaggcctaacaaaatgttttaagctttgcataaattaaaacgaggtctctgagtacaaaagtgcaacttgttttttacttgaaaacaactatgctggcatcttttacaaaattacagcctcaagccaggtttccataatcagttttcctttaaaaaatagagaggaaagaatgtatccttgtgtgtgtgtgtgtgtgtgtgtgtgtgtgtgtgtgtgtgtgtgtgtgtatgagtatatatataatatatgtatgtataccaaacacaaatggtcctaatcaatgggattatggcttttatgatgttctgtgttcctttgaaggttgatcaggcatgagtggtggatgattcagtttgaataaatagatttggaaatattattttgggggtccaggatttctgagtttcttcattagtttagtacatgataacaactgttgagacatttcagtgtgcggagactccctcctagaactctttactatgtaccttataacagggttttactcaggctaaccttgactgtgctcaattgaaagaaagtgatgagtcagctcaaagagaaatagtctgtttctcccaactctgcgataatgtgtcccaaagtagtgacacatggcatattccattcttaagataactggcagacaatttgtacaatcttctagacacattgcttccctttgattcacacatcatcaccaaaagggtaatgctacaaatcttttctctattcatgactactcttaacagggatatggcttgtaaagaagcttattgatgtgctttgcttgaaatagaatcattagactgggcctgccctctcatttttaccttgacagtaatagtaagagtatgggagatactcttactcttattattactataactataatagtaatactattacagtatagtaatactattacagtaatagtaagagtatgggagatactcctattcttactgttactgtcaaggtaaaaatgagagggtactgtgtgagttattttttatatattgtcatcttttaataaccctatgtgcccactatagagaagttggaaaatatagaatagaaagaagaaaaagttatttttttattttccacagttaatattttcacatattatttcattatgtttatttcctcacacactagtgatcatactttcaacagatcatactgtagatattactgtagatgttatattcatttgttcacttaaactaataatttgaatatactttactattattaagaactctttgttaaagatcaaattgttttaaaacttaagttagagaggcatttatagcattagataatgccagccaggacatatacactatctttaaaaatgaatctaacccttaaatgaaatccagcagccaatctaatgtttctttgtaataagcaaaatatttttctgtgttattgcatctcacaggaatctattcctaaaggattcaatagtaaagatgctcagtaatcatgctctagagtttctcatccctctaaagaacacacagcagttctgtgaatgactaaggatcagcaggaatggatgtcaggtgaatgttggcactactggatacaattgatatgctttatggattttttgtttcaatgtgattctgcatagatggcacctgtaattatgaccatttggatcatgtgaaaaatgataaattttcggtgaaagggaatggtgcttgatccttttctttgtctttgaactgtttagaaacactaaacttaactgataaaagtaagtgcaagatggccgggtgcggcggttcacacctataatcccagcactttgggaggctgagacaggtggatcacttaaggtgaggagtttgtgaccagtctggccaacatggtaaaaccccgtctctactaaaaatacaaaaattagctgggtgtggtggcgcatgcctgtaatcccagctacttgggaggctgaggcaggagaatcacttgaacccaggagatgaaggttgcagtgagccaaggttgcaccactgcactccagcctgggtgacagagtgagatcctgcctcaaaaaaaaaaaaaagtgtgtgtgtgtatatatatatatatatatatatataaaaaataaaaaataaacaaaaattaaaaagtaagtgcaagacatcttagaagtattgcagttttttaaagctcttgacagagtaactttattcatgcaggtaaattctagctcttttgagcaatatgttaataagtcactgctaatggcctaatagtttttaacttacaattaaagacccatgatggaaactggcagcaatttcataacccaccagtctaattgtttcacagtgaacaattatttgccttgcgaatacttacagtaaacatttctgtaaagtttatctttgtttcctaaacagtgatatttgttttgtacattctgtagatggaatatattctgcagtttggtttttctgctgcttagttgctgagaattgactgtgttgttgcacatagctgtaatgcattcattttcactgccctgtagtgttccattgtatgaatatactatggtttacatataccttgtattgatggacagtggacatacaggttgtttccatttttgatttgttagaaatagtgctgtatgactgttcttttatgtgtctcctggcacatatccttgaaatttacttagcattagaattgcttgggtttagggtatgcacataaggaacattactagataacgctaagttgatttcaaaattaattgtaccaatttccactctaactagcagtgtagaattgttgccatcgtttccacattttcatgaatactcttatcatacttcatatgaaataatcttgtgcacatgtgtatgtgtgtgtgttcaacagcctcattgtggttttaatttgaatttttctgccctggtttcctcttctgagcatgttcttttgggttttttaatctatgtctttattttaatgttgaactttttcttattcagttataagagtgctttatatattttgatcactattcctttgtgaataatgtgtgttccaaaacatttcctaagttatggtttatcagcgcattctgtttatggtgtcttgtgataaaaagttcttaatgatagaatagttgagtttatcaaacttttcctgtatagtttgagtcttgttttgagaattcatccctactctgaggtcataaaagcattcttacatgttgttttctaaaagtgttctagttttatcttttacacttaattcattgctttatctggaattaatcttcatgtatgatgtgaggtaaggtaagggttcaactttatttttctccatatggacaagcaactataataccattaccataatatattttaaaagtttcttcatctctcagtgatctgatggaccaactgtcataaattatgcctccaaatttgcctaggtttatttctgagttttctctttcatttgtttgctaatttatataacaacacaacactgttgaaattattacaacttttaattattgcttgatattttaaaattcagtctccctcccccacctcttattatttttcaggtacacattggtgactcttgtcttactactcttccgtgtaaattttagaatcaactcatcaagtttcatattctcaaaaaagtgaaattttcattggaattgcattgtttattggataatttagaaggaattggcatctttatgatattgattcttctagtccttgaatataatatttatctttatttatttaaatcttttttctccttccggaaaattttatggtttttctctatatgttttttttattacctatttgcaaatttctattagatttgttcccaggtacttgattttttttggtcctattataaatggtgtcttgaaaaaccatgttagcagcagttctcgttcttcgtatatacccaaaatcattcatagcagggactcaaacagatatttgttcaccaatgttcatagcagcactattcagaatagtcaaaaggtagaaataactcacatatccattgactgataaaaggataaacaaaatgtagtatatttatacaatggaatattattcagccttagaaaggaaggaaatgttgacccatgctacaatatagatgaactttgaagacattatggtaagtgacacaagtcagtcactaaaagaatactgtataatttcacttatatccagtgcctaccactgtcaaagtcatagagacagaaagtagaatggtgattgtcagaggctggtgggaagagggaatgggctcttattgtttaacaggtatgaggtttcagtttgggaagatgaaaaaatttctggagctggatggtggtgataattgaacaatattatgatataattaatactattaagctacacacttaatggttaaaatggtaaatttcattttaatgtatattttaccacaataaaaattatgtgttctaaaatttactgctggtgtatagaaatacacttgatttttgtatattgattttgaatctagcaaccttgccaaacttaccagttatagtaagttttttgcagctcgtctagatttctgtatatgcagtaatgtcataatgagcattttgtttcatcttttccaatcttcatacttttatttatttatcttgggttatccagttacctatgacattcaataatgtcaaatagaataataatagcaggatttcttgccttgatcttaaaagaagcgcttagaatgtttcccattaaatatggtattttgttttgttttgtttttaggtagcttttatcagattaaggaagttcccttcatttctagtttgctgagatttaatttttatcatgaatgactgtcagatgatttattgaaatgatgatgtgattttcttctaatctgttagtgtgataaactacagtaattgattttccaatgttaaatcaatctgtaattcgggggttaaacacaaattgattatgacatattatgcctttcacacaatgctagattcagtttgctgacattttacttaggatttttcatccaagttcatgagtccagttgtcttgtagtgtttttctcaaatcatcattttgaggattggtatcaagattctcccacctcagccttcctagtagctgggactacaggcacccactaccacgcccagctaatttttgtatttttagtaaagatgttcagtaaaaaaacatcattttgccatgttggccagattggcctcaaactcctgacctcaagtgatctgcctgcctcgacctcccaaagtgctgagattacaggcatgagccaccgtgcccagccatgtctctgtgttttaggtatgtttcttataggtactatatagattgattttttttaaaatttttttctcagacctcacagggatgaagatgttttaaaaagctcttctgaccagataatatttgtctgttaaatggagctttttgtctatttataattatagatcagttagaatttattttgtgcattctatttttgccctttctacattttttttctgatttcctgcttttctttgaattgtttcttcttacttcatttttttcttctgcaatttcagaaattctgtaaaccattttcattcttttggttgttactctagaaatttaataaaaacatttcaaagtctaaagttactcaggaggaaaggaaagataatgatgaatacagggacttttgaacactttaattcccatcagtttgttatcatttaccttaattctgttgtatacacccagcagatgatattgttcagaattaaccacatattttcccatgttctactcttcatttttattgctttcagaccattcatgttggatcacttttattctagataaattatattttttagagaatttttactatggaaagatactttttactctatgatattttaagttaacaagtttcactttgaatattgaagatgtcattctagtgtcttcaagattctacactgttactattgaaatataaggtgttatttaattgttgcttcctttaatgtaatttgttctttttctggctgcttttaagtctttcttttgtctttggtgttctgcagtttaaggtgcatttaggttgaaattattttttgcgtaacctgcttaggatttgttgtcttctttttttaattttaaattacgttttatttaacccggtaggtccaaaatatcatttcaatatgtgtcatcaaccacgctgcaagccctcaaaagccacatgtggccagtggctaccacactggaaaccatatgggacagttctatagaatggagtttagtgcgcattagaataaatgggaaatcttacttaaatgcaagctcctggggcgcgttcttagaggctatgattcagtaggtcagcaaagagaccctgggatcttcatttttaacaagtttccccaagtgactccaatgagagtggtctgcagaacactctttgagaaacactgatgtaggagattgttcagggcaaagcagaaggttcacctgactctcagggaaccagaataacctagtaaccatgggatcattgttacaggatccacatccctaagaggatgttccactgcagttttcatttttctctgactcaaactcagtaagtggattagatacatgcaggtgatgatgcaggtgcccatatgggacataaaaatttcaagttgggtccatttgttcttgcatcaaattatgttttaagtaaaatattaatattttaagtaaaatattttaagtaaaatattaatattttaagtaaaattttattttacttttaaaatattaattttttacttaaaacattaatttacttaaaatattaatattttacttaaaacataatttgatgcaagaacaaaatattaatattttacttaaaacatttaatattaagtaaagtattaatgatcctaataaatggggaaggagctcagacagaaccccattcccttcaaagcaagacaactttgaatagctgtgaatcttcataatggcttctctttatgaagccattgttttattcaaggatctactaattgggtaacaccatctcctatgcacaaacatgccctaaacttggactcagttacaaatagggatgaaggtaagaatggtcagactgtctggattttccttctcttagtgtttctcaaagcatggtctaaggaccagatagggccatgataccagacatgcaatagacagacctgcacatttgcagcattctcctccagagacagattcacatggtcaggtacagacccagaatctgcaaggtctgccacccacctccattctctgcccctggataattctgatacaggggattagggtgaaactagtggaacccatatataccacgctgttctcatcagaatgaaactacaaaattcactaacatctctcttgtttttaattttaattatacatgtactatttacaatagcaaagaaatggaatccacccaaatgcccatcagtggtagactggacaaagcaaacatggtacatatacatcatggaacaccatgcagccactaaagaatgagatcataccctttgcagcaacattgacagaggtagaggtcaccatcctaggcagaccaacacaggaacagaaaaccaaatactgcaagttctcacctatgagtgggagctaaacaacaacaacacacagacactaggaggggaataacagacactggggcctacttgagggtggagggtggtaggagggagaggatcaaaaaactatcaggtactatgcttattacccaggtgacaaaattatctgtacaccaaacctctgtggcacgcagcttacccatataacaaacctgcacatgtacccctgaacccaaaacaaaaattaaaaaagtatacatgtcatatgaataaatttccagttataaaatatttctttttttttttgttgagacggagtctcactctgtcgcttgggctggagtgcactggcacaatcttggctcactgcaacctctgcctcccaggttcatacagttctcctgcctcggcctcccaagtagctgggattacaggcgcctgccactacacacagctaattttttgtatttttagtaaagagagtgtttcaccatgttggccaggctggtcttgaactcctgacctcatgatttgcccacttcggcctccaaagtgctgggattacaggcgtgaaccaccacacccggccaatataaaatatttcaacaaatacaagtaaattaagtaaaaagttccctcacctcttctctaaatgtactcttcccccggggtgaccacttttatcagttaaatttaaggatttcttgtcttcttgtatctttggattgatatttttcatcagttttggaaaattgtctattcagtttcttttcaagtattgccaactcctcattctctctttcccttcctcttctctgggaactaagattatatgtttgttagaccttctttctcactgtctcttccttgactgtcataatttctgtactacattccagatgatgttttattttagcttccagtttgcttgttggctcttcaccagtacctaatctattgttaattctgattactgagattttcaattttgattaatatagtttttgtttttataatttttttaaatttaactttttatttggaagtgatttcaaatttgaaaatcattgtaaggtcagaaactgtgtgaataataccatataccctttacctagagcctctgattcttatttcactccatttgatttataatttgttttttctctctcggatatatttttttctgaccatttaaagataaatttcatacattatgacctttttcactaaataatttaggttatatatttcttaataggcatattctcttacctgattacagtatagttatcaactgtgaatattgctgcaacgaacatgagaatatagctacctctttggcatactgatttcagtttctttgaatttatatcagaagtaagactactggatgataatgtaattctatttttaattttctgaggaactttcatactgttttccttcatggctgtattaagttacattcccatgaacaatgcacaagggttctcatttctccacaccactgccaacccttacctttcatccttttgatatctcattgtggctttaactttaatttccctgttgatcagtgatgatgagcattttttcatatgtctgatggccatttgtatgccttctttggagaagtatctatttaggccctttgcccattttttgactgggttatttgttttattgctattgagttatttgagttccttatatattttggatattaaccccatattaaatatatggtttgcaaatattttctcccaatctgcaagctatttcttaactctgctaatcgcttttttttgccatgaagaagatttttagtttgatacaatcccacttgttaatttttgcttttgtagtcatattcaagaaatcttttcctagaccaatgttgtggaacgttttcctatgtttttttccagtagttttacagtttcagatcttacatttaagttttcagtccattttgagtttatttttgtaaaaggtgtgaagtaagcatccagtttcattgttctgcttgtggatatccaattttcccaataccagttattaaagagactatcttttctccattgtgtgctattggcatctttgtagaaaatcagctaaccaaaagtgtgtgggtttatgtctgtgttctctatcctgtttcattggtaatttgtctttctgccagtaccatacctttatgatcactgtagctttgtgatagatcttgaagtctaggtaacgtgatgtttctttttcattttttctttatgtagtcaatttatgaattcctattttcctaagcagtcttgaattcattactaaataattttagtactcatttcatatttggccagtggtgtccacatctaaaatggctcctgtaacctagtgatgtgctcatgtcattgatttgagcagttgtttatgttatggcataacaagatgtcattttgtatctactctgccttagtcctggaatggaaaaaagaaattttttgaattcaaaactgttgattctttatttaaaatctttaactctgttagtacatactaggtggtgttgattttttttgagactgttattcttcttgagacattacatatacttagcgtgtctgaaatttcaatgtctgaagcatttccaatgatttatgtatctgattgttgttatctgccagctttcactcatccttttgcctttccttacttgtttggtaatttttactgtgaattgcttatttccctgagaactttgtgtgagtattgcttgtttttcctggaatttttaggaattctttgacacctgggagaaggtggtttttaccagatatttgattatttcatgcctctagtgaaactacctgtgtgagaccatcttatattctcagggtgaggtttttcttttcagaccattttatgtaaattaaggctttaaaactctatgagagtcagcttgtcattatgcattatcagaagagattttttttttctgccggcaatactatttgagatgagaaattttcattgcaatttacttgagggagagggtagtttatttttagttcatctagcactgaatgtgtagtaggtcttttgtgtatagctctgttgggatcttctactagatgtcttacctggggtgggggccatgtgctatgctcttgatccctggatttgtgaagacttgaagccaaagctgaagttctaactagtttgggaaatattcataagaggaaacaaaaactaaattttttttcttctctttgctttatttttgacctgagtattgcttactttctgtctagctcatggatgtagattagaataatattttaaacttcattctgtttagtttttaaatcgttttcagtggaagtatcagtcttagtacctaatctcccatggcataaggctggaaatagccatgatcctgccaaacacggacactctgcaacctggaacaaaatattctactctaaaaatcaagtaattatgtcttttttcaataaaatataaagtataatcattaatgtaatttacttctttcattccagtcttcactcatgctttcaaacatagattatattattccaacccttcttaagtggaattagtatttcattattccataaggttctacaaatacctacaaagaccatcatgaattccaggtgctctgtaacctgatcaggttggagaactgctgatgcaaccaaatttaatcacttaatgttcttactaagcactcatttgtttttctgcttctatgacttgctctcactgcttgctatcccaaacactgtccgtttgtacatgttccaatgtcaccattcctttttcgggcaaatgcttcaaaagctactgtttctataaaactttcctttacccttctcttttgacttgttatgagctccttttgtagtttgtaatctccttaagagcaaatttcacaaatgttatatttgtaatatcttatgtagcagagtattctcacagtctagaacagatggttcttctgtatctgttgaaagaaatgggaagatagcaaagcaacataataggataattttatttttgcctactagactatctcaggatgtatgtgttttaaatcctaaaactggttagtggtatttcagttgaaaaggtcttgaccctttcccttctaacataacaatcctcatcataagtgagagagaagattgggtgagtagggctcagtgggggaagctggttcctttcacccaccttcagaaatccaggtatggaatacaggggttgttctggacctcaaaattacctttttttttttttttttttgacggagtctcactctgtcgcccaggctggagtacaatggtatgatcttggctcactgcaacctatgcctcctgggttcaggggattctcctgcctcagcctcccgagtagtggggattacagggatgtgccaccacgcctggctaatttttgtatttttagtagagacagggtttcaccatgttggtcaggctggtctcgaactcctgacctcgttatccgcccgcctcagcctcccaaagtgccgggattataggcgtgagccaccacgcccagccacgaaattacctttaaaaaggtggtctttaaaaggcaaatagggagatactaattgcaaaaaaaaataatgatgaaataagttatctttctgttttccactttttctgtggtgttccttttgacatttgcattccaaaccagagccccacaaataactgagtttgcactcttttggcaagcaaggactgctctcagatgtattttataacttcagcttatatgggaagaacttttctttccagagacggtttcatagtaatatccttcaaaagctcacattgtagaatatgacttttttttttctttgttgttatgtttgctttgttttggtgggttttattcatcatttcagccagcttatagaaagagatagaacttttgttggatactaaatcatgtctatcaaaagcactattgaccttgtgttgttaaaactaaaaatgtaagaacaaaccattttctaaggtttttaattatatgcactaaaacagagtaaggcctagatttattaatcattgggttatggtttgatgtggaaagaaccagcctataacttttccctttgtttaacaacgttattgctgaaaactttaatagacttaagtgtactggaactagggagtgaaatcttatctttccctgaacaccagggctgctttgttatggtgtttccatttgtggcataatgaatgtgtaggacgctaatgatgtggtctctaggtgttctcctactacacagagcactgataatgagctgcgagtaatctagtacgagtccctgaagatgaatcctgattaccttcatggggccattccgctctgctcccttcctccttgatgtttctgtaaagagcatttggattttgaagagagtattgtgtatttgacttttaattagatttgcagtgtgttgggttaataaactagggcttcttcttcttcagtttcctctaaagggatgtgtgtaaatgttgcacagtgggccaagagaacagagggtcataacaggcagcaatggtggtgtcgcccacttcatgccccagtcctgaaaagaaggcttatagtggctgaaggttgatttcatcccatggtccatagttacaaatggcttccaagctgccaaggacctgctaaacctattgcatctgttctgtacgaggaagcagtctcagaatgaaatatgacagttgtctgtcagggctgccccagagtcctgcaagttggtattatctgcttgcgttcagaaaacacatcaccgtggctgaccacagctttgtacttactgtgatcttagggctcgcatttttagggacaacttgccctttatgcctttggtccctttctgccttctgcttttgtttttctgccagttgggttcatttatcttctttcctgtgtgttttgccatgcttttcttattatagctttcagattcatcatggacagagatagaaagtactctagtgtctttatcccacctcagctctcagtctggtgtagagctaagggaaggagaattgccttcacagtcaactttcagtgtggtccctgaactttttattttgttcagtgaatccagcacatctcatattgtgccccagctataatgggtagtcctttcctgatcttctaagaaaattagatgcctggcttctgccttgctcttcattgttttttaagcatagtccttacatgatggtccgggccttccttacaggtctaattgtgtggctgggccttccttctgcatgcctattctgttttttagtttttgtttttcttttaagaattggggtctcactctattacccaggctggagatcagtggcataatcataactcattgcaacctcgacctcctggactcaagagatcctgccacttcagcctctcaagtagctgggactacaggcacacgccaccacacccagttcattttgaattttgtttttgttgttgttttgagacagagtcttgctctgtccccctggctggagtgcagtggcacaatctcggctcactgcaatctccgcctcccgggttcaagccattttcccacctaagccttcttagtagctgggattacaggcacatgctaccatgccgagctaatttttgtattttaagtagagaagagatttcggcatgttggccaggctggtcttgaactcctgacctcaagtgagccgaccgcctcgacctgccaaagtgctgggattacaggtgtgagccactgtgcctggcctgaagttttttttttttttttgtagagacggggcctcactgtgttacccaggctggtctcaaacttctgggcctgagcgatcctcccaccttggcctctcaaagtgctgggattacaggagtgagccatcatgcccagcctgcctatcctattttattctgaggctactactactccttatgggtagatccaaggatctgacatcattttcatacatcctgttcagtgtgtgagtatagaattgaggtaggctgacaacacaaaagtgggcagaggtttcccactcatccccgacagggattctctgttggcataggtgggctctggtccaactcctggccgacatgagcatggacaatgtggcacagttgtggctctgcatcttgtgtgtgactgctgccctgtttttgtttagcaagctgctgtgccaatttactatgcatgttgttacatattctgctctaatttgactgccattttgcttcagcgagacgatgattgtttatggcagggctgtaatgtgttgtcagcacaggttactcgctacttgttggcaatggcctaacattgcctgagacatggtgtcactgtgaaatggtttgacaatgttgagactgtagttatgttgagcagtaacaactgtagaggtcaagaaagggcatctaagaggaactgtgttcataggggaaagatggagaaggaatactaagtaggacagtagcaaatgtcatcaaagagcttcattttcacgcaattttcataattcagtctgttttctgtgaacagtgttggttcagctgttgctcgggagtagaagcacatttctgagttagaaatgaattgtgctgatcatgaccctatcattttcttctttgaacatttttagaaagttatccagcttgctgaagaatgcactagatccttgtccatgtgtgaggcaagggactcattgggccaccttcacagggtttcatttttggaacatttatctaaggactatcttactaccctgagagaccaagatgtaggctaccttaagtcgtatgaggctgctgtgaaaatggcatttgtttttttggctctaagaaattttcaggacctagtcaagcatgtgacaacaaatatttaatgatagtggacaaggtaaacttcaaaagtgactagaaacccttgtggaatctaagacagagggactctaacaagcttgatgacattttgaatacgttttgtattgattactgactcttttcccaataatctgtgaagctggctttctgtttggcaaggcagccccaaaaggaaccttcatcccatacctccatgcaggagtagcacagaacagcacccagcatcgggccctccagagtctgggagggttcggttgtctcatgaattatgtggtgcccttcaggaactcactttgacctctgatgcctttcctttcaagcaagtggtgtggaaaaatattaaaactctcagtaatgacagtttccagatatgcatatctttgagtggacaatgaaggcaacatttatattctgtccacgatgcgagcatggtatgcattctgcagctgtcacagagccttccttctggtaccaaataccttacttcctgacaggtatgacctctgagacctccctaacccctttctttcatttcatacaaaaatctagagcttggcttttttttttttccttctttttttgtaaaaagaggtttttccattttaaaaagccttttcagttcttaaacttgatcattgatatgttccacctcatcaaaaagaggagtgcagctaaactgacaatcagttcatgccattggcctcactcatcatcatgtcaaggacctggcatgcccattgagaagggcctctgtgcattctgtcctcaccaagcctaattccttcccctgttgatggttttgccagattctttgcctgttgatgcccatgccagggccacggtgcttatgccaaagcctttgacagaatgagtcaaatctggtgccagtcacccttggcatatgccaccttgttcttgaccacttcctaccagggatgggctgaaaagaatagtgtctgctaagagcttgtagaggacttttctgttaagtgctaagtgttgacattactccagtttgaatcagatcatttggaactcttgcttggatctctcaaagctgttgactcatttgtatcttggcctcacattagtggggtagataggagccaaaaagtttgagtgaagtcagaataaatatattttaagtgtggatctgtggagaagaaagaggtcccaagagcataatgaaaactgtggttaaaactgtgaatcaagaggtttgttttaatttgccattttcttacgaagttttaaaatattttctaataaagcttcttatttattgccttagtacattttctgttacttataacagaatacctaaaactagataatttatggccaggcgcggtggctcacacctgtaatcccagcactttgggaggctgcagcaggcggatcatgaggtcaggagatcaagaccatcctggccaatatggtgaaaccctgtctctactaaaaatacaaaaaaattagccaggcgtggtgttgcgcacctgtggtcccagctactcgggaggctgagacaggagaattatgtgaacccaggaggtggagcttgcagtgagctgagatcacgccactgtactcctgcctgggtgacagagcaagactccatctcaaaaaaaaagaaaaaatactagatagtttataaagaatgggaatttatttctgcagttatggaggctgaaaagtctaaggtagaggggctggggctgcatctggtgagaggcttcttggtggtggggactttctgaacagctccaaggcagcacagggtgtcacatggtgagggggtgagcatgctaacatgctagctcagttctcttccttttcttataaagctacctgtctctcaatattgctgcattggagattaagtttcaacacgagttttggagggggcatttaaacgatagcatatatatagtgcagcagtcccactcctaggtatttacccaagagaaatggaactatatgcttacacaaagacctgtaccctttttacactttttttttttttaagacagagtctcactctgtcgccctggctagagtgcagtggtgcaatctcggctcactgcaacctccgcctcccgggttcaagcgattctactgcctcagcctcctgagtagctgggactacaggcacgtgccaccacagctggctaatttttgtatttttagtagagacaggtttcaccatgttggccaggatggtctcgatcccctaaccttgtgatccacccgcctcgggctcccaaagtgctgggattacaggtgtgagccaccgcgcccggccaacctgtacactttttgtaatagccaaaaactggaaagaagcagtatacattactaggtgaaaattacagcatatagagataatggttatttctaagcacaaaaaagaatcaaactgatattcctaacaacatggatgaatttcagaaacattgtgctaagtaagagaaggcacacacaaaaaggtacatacttaataattccacttgtgttaaattctagaaccaacaaaacttatctgtagtaacaaaaagtagttccatgttcacctgggtgcaggggtgggaacactggctacagagttgcatgagggaacattgtgggtgatggaaatgttgtttcttgattgtggtggcagttatatagatacagacatatttgtccaaactcatcaaactgtatacttcaagtgggtacattttttcttttatgtgtattatacctcaagtataatgaagttgattttaaaaatatatttgttgtaatcccacttttgccacataaacagggtccagagaaatattaggtattccttctctctctctcatgtatatcctgatcaaaacatttatatgaacatattgaaatcagatttaaatatcagtttccctaatggactcagctggactcaagttaattgacttaataaaatttcgaatctcatttgttcctattttctcctccctacagttgttatctttactgttatttgaaggacttgaataagtgaattttgaattcagataatacactatagggagtaggaaagcagacccctggcctcaggagcgcctctttgatcatgaatgtctatgactgccattttgttctctagattcatgtctttatattgtctatttggcttatagttttttctatcaccatttttgttttcaactgttttttcactaaaagacaaaatttgattttcatgctattaatttcgtactaaaaagagcacagcaggcataattaaagcattttaagatgtagtaatttgatttaaaatattttactaagcgatatattacaaaaagttatttaattatctgtaaactttaaaagcaggtattagcattctatggctattgtctttaataattacattttaattttaattttagttttttaaatgtatgtttctttttgttgttgttgttctgagatggagtctcgctctgtcacccaggctggagtgcagtggtgcgatcttggctcactgcaacctctgcctcctgggttcaagcaattctcctgcctcagtctccggagtagctgggattacaggcacctgccaccacacccaaccaatttttgtatttttactagagacgaggtttcaccatgttagaaaggcttgtctcaaactcctgacgtcaagtgatccacccccctccgccttttaaagacctgacatcttagttgttactgtgaaattgattttcttgttttctcctcatcttaaccttgttttatatatcaaagtaaagaagaggaactgttaaaacttatatgaagtatggctgaatcttcaaaaagatatcaaatatttagaaactaattttaagctgcatatgttttatgaatggtagcaatacaatttataactgtcatttctgaaatctccggatttaggtctccattgccaaaaaatgtaaaaaatagaattatgacaagtgatctcttgaattaaaaccaaatgtttttgtattacaatacctgtgatgatgattccaaacaggcttctctttaataagtggccacagtagagtcatgatgttagcccttatatttataatgaggacaattctgggtcaccaagggcctggatatgggacccttggggcccactgtgatatttatggacatgaaatacagtcataggccatttatcagatttatcaaatttggaaacttccaaataaattaatttgacaaatatacataaacttcagtaaattttattagttttattttttgccctgtgtatttgcataaatgttactaggaaatatatttaataaaagtagaaggattttttttttttgcgtgatactcagctatattcttccaatagttgtggaacagcttagtgccttcagcagtggcagtctcctaaaacgattgtctatcagttaaaggttaactgagtatttggaccaagtagcaaactagaattcttttcatctaatctctgtttaatatagggatatccaatataacatccttgggtcagtgtagtacatcttacgttaagttttgtctctaatgaatatttatattacataaatgggaaaattggtgggttcccttggtagaaacatgatattggtatttttaaagtaaacttaaataggtcagaatttttatcctctagagaaaatttcacgtctgattaaatagtttacataaacttaatctttttctgctagatgcattataatctcagatattattcatgtagctattcctctgtgaaccataaaatgttcatttcttcaaaatgaatatgaagctcaaagcattagtggtcttaagagcataaaaactttattactttgtgcttcacatttttcaagtgactttggaaagccgaaacaaattttgcatttagattaatggaagatgttttccatgtgaaggaactggcaagggagcaacaataacaaaaatcccccaaggttaaaaatgtagtgcttttgattcttcccagaactgtgttagcagaacaatcatttctcagcatggaaaggtatcataattggtctatacagtggcaatactgaaaacgagtatgcttcagagaaagctaatatgactctacttaataatttccttcaagagcctgaatttgaatgtatgttccacccagcttgaggcaaacaatttgttcctataagttctagtggaagttaccggggggtcatgtaatttatttttgtcttgaagttttcaaaactgtgtagaaataaagacacgtttacttgcattgttccactagtaatttgatccaattggcaatgctcctttctcttcttctcaattctattatgttggaagagtggaagcgttcataaaatgttgtgacaaacaattcttcctagagacgtttcctctttctgtttgaacctctgatccacttgcgaatgttagcattctttttgtttgtttgtttgtttttgagatggagtcttgttctgttgccagactgcagtacagtggcacgatcttggctcactgcaaccttcacctcctgggttcaagcgatcctcctgcctcagcctcccgagtagctgtgactacaggcatgcaccactacacccagctagttgttgtatttttagtagagagagggtttcaccatgttggccaggatggtcttgatctcttgacctcgtgatctgcctgcctcagcctcccaaaatgctgggattacaggcatgagccactgcacccagccaaatgtttgcattatttagtaagtggttttttattatgggtctttacttacatgtgctgttattgtccttttcactgggattatctaggttttcaatctgtttctttgtattaattttttggctatgggactagttttaaagccctaccacagaagtagagggtctgtagttggagtacggtgagtaacatgagagaatgtttcctttttttccttgaagaatggatagttttaggggaatgtgtgcagatgtcagaagatggctacatagagaatgaagcatcagaaggtagacacaggtctctgcattgcaaatatcagtaacagggatgaagaaagaacagcaaaatttttagaaaaagtgtaaaggatggttagacacttagaccctctcttttataagtttgattgtgtacttctaagaagcagcaataagttgaaggtaaagttatctcaatactctgataagatgtggtctctggattcataccaaacattagagttcaaggcattccccttcagtttattttatattcctcaaatgtatctaattccttaggattaatgatttgtttctcttaaaaacagcatttattgctttaatctgagaaaaaaataagacttccagtgtttatatctacaaacacaaggattgaaaaaaattttataatcagcctcgctgctaattcttataggtgaagcaatgacttagaagaatggggagactggagtacatgatagttttgtagacagccacagttggcaaaagatggtggtgaggctgtccccgttgtaaatcctttatctccatgagagcaactgttgctggctagtttcttgtgaattaagtatgcagtttgtcttttttttaatgtgataaatgaacgtattttctaactggctatttgcttaataaaaatgagtaatataataaggaattaggggagcattggaaagataatcactgggaggtgagaaaaaaagttatctctctgcttcagtcccttattctcatctttatagatcagttctcccagtgagaagccaaatgggatgtcattctttgtttgtttgtttcattaattctttgcaatctatagtaggactgttgaggagaatgtataaactgcaggttaccagcaggtggaaggaggggaatgagggcaggtggtccataagcagaaatattaattcttgactgattgggacagtgaatattgaccaacattgaaaacattatattatggtcttatttaggcctgaacactgacagccagttgacaagtctaattttttataacttaaatgtggttcatttaggaaaaactgccatcaagggcaattcaattctattatgacaattaactctgactttgaagtaagtagaataaatcagtttatttctcagtaaggcccaaataaactgagattgttgtgaaaattatgcagtttgtgactacagtgtggatgttgtgtgttgggttgtgcagtgtacaacctgcaaagctgtatgaggcaacctggacattctactcctagctatatacccaaaagaaaatacatgtttctacaaaaccttgtacagaatgtttatagtaccatcattcataatagctaaaaagtgaaaacaacccaaatgttcataaactaataagtggataaacaaaatgtggtgtatccataaagtagaatattatgtagccataagaaagaatggagtaccacacgtgctacagcatggctgaaccttggaaacattatgctaagtgaaagaagccagacaccaaacggcacatactgattgtatgagtacatttagatatgaaatatctaaaataggtaaatccattgccagtggctgaaatggggagtgattgcttaatgggtatagggttttcctttgggggtgatgaaatgttctggaatcagacagtggtggggttgcacaaccttgaaaactactgaaaaccctgtgaaatgtacagtttaaaatggttaaaatgatacattttatgttgcataaaagaacatttaaaaaaattaatccagtggggtctgatggcaaattgacatgagggaacttttttgagggtgatggaagtgttatcaatctagattagagtgatggttgcacaactgtataaatttataaaaactcatcaaactgtactcttaaaatgtgggtgtattttatggtatgcaattatacctcaataaagctgtttaaaaaaaaccctctctgagtcattactgaaatcagtgccattttctgaatttcagaaatatcaaaggagagctttcctagtgtgaatttatcataaataatgtttggtattttttttcctttgacttaacgagagcctgagatgcagaaacaaatctgcacttccatgttgtgttacccgctttgggccatggcccatttgccagttgcagattgcctccttgtctgaaaatgggtgtgtttcttcatagtaactctcaattctattgttggtgacagcgcaataatggaactttcttctgtgtggataagccccttcagtgatatttgcaaatcaaatcatatctgctttttgtgctacattgtcctcaaaatcttctgattggtttggttatagacatccctatatcagctttcctgttctctttcagtttaaatatctgtatgctgtagcaaattgcattatgaaatcctctcacatttatcgctgtttagtgcatggaaatggcatttcctcattaccagtcaaagataaactctaaatgtttctttttttttttttcctgaagtatcaaattatgtattcaaaaaacttttctctatagcattatttctctgagctgtttcttttttccctcctgaatgctgacaccagatgcagtctgcatggacattagtcccagggaaatcttgtcttctacccaggacaaggagattataggaagcaatgctgactcttgttgtagattcacaatgtgctgacacgataataggacatgaatgggcttttggaatgccttttcctttgagctgggctgagagggggacagaggcagacagctccatggcctgaatttcgttagctgtgtgacaatgggagagataagtagatgtgacagttatgaatgatcctctgtcatgcactttcacgttcagattcagataaactgacactgctgtcaaacacaagctatggagagctgagacctctgatgaaccttctaatatggtaaatgggagtcttaattcttcattaactgaaaaaaggagatttggccatgtaattttctccttgctgcctgttttaaagattccaataacccagcatttacagttgactaggcagggattgcttttccccccctacacttgcaacatgcagactgtgaaatctgaggaaacgctgcttaaacccagacttattgccttggttatctttaatgactttgaaatgtattggcctcattatggaacagtgcagttatcaattcctctaattaggtgatgtgctcccataagaaatttaacattaaagcacaaaaatgaactcgttagaggcatctattgctgggaacttcagtatcaatggtgaattgaagatactgtgtttcgttaccaactcttctgcaccatacatctgactcctccttgaagactagagcatgggcatttttttctttttccttaagggtttaatcctcatatagcacctctaacacctttgatgacattttagtgcttctggatagtaaactgtgtgcctttgactaaatcgactaggagtctagggaagggaggaggtgagcagtttacatttaaatgctccacatatcagcccatctttctttcttggaatttaacccatggctatttactctttcttatgtaagtccaataaacttcctttctataagtagcttagtacagtctttgtttttatcacgatagggaccattatttgtttattaaatagtgatgctgtttcactcataaatatttcagctgtatttctagagaagtaggatggggtttctgggtttaggcttcagtgaagggactttaagtctcttaacccttctttacctcaatcatccatctgaacaaaaaaaatcattatagcctcccctttggggaaactacatagtttaattagtgttttctaataacttacaaatccttagagaaaagttatagtagaagcataagaaattatctttggggttagtttattattattgctattattatcattattactatatgggactagttgtttttttaaattggctacttgaaaatgtgtttcagatctcatggagtgaaatttacctttcatttaccttagggctcaaataagagtatactgaatataaaaatatggaacactaatttctttaaaatacctgaacctattaatagccaggagtgttaacttcgtcacctggaagaagatcctgtcctaacttgaaaatgttagaatgaaaaccttaatcgtctcctctcaaagggtcattgaggaagctgggcttgagtctgtgcagctgttcttcaataatgttatatcattctgaaccaattatcatccttaacccagatttgctttgaatctctgtggcatcttgactactgtctataacaacggtgattgccagacactgcctgatgctcaggtttctatcaatcctcttcttctcctcacagcaggtaggagcttcttggtgttccgctccttacccaggcttgaggaatagtcctactttttgccatgatgccttgctgcagttctggctcttcccttgtgctgttgttctctttgtcatgcaggtttcccagtatcttagtagaagccttgaacaattcctattaccttttcagaccttccttccaagaactgggggatgggggtgttctggtcttgtcacaggtgggtgccacatgtaaggacccactggttcatgggattctttgagagagtctgacgctcacttgtctgggttaaaagtctggtgctgacacctgctttctgaatgactttaagcaagttatttgacttctctttgcctcagtttcctgcctacaaaatgaagataatagcgcctgtcttatcaaggttcttagagaagattagatgcattaacacatgtaaagcacttagaacgctttaagtcacatagtaagcattaataaatatcagttgctaacagcttttgcttctgctctgttaccattttactatctcacctctctcatagcccataacagcaaaccaaactctttggctcttggtagatatattattcttaatgtttgagccctactatttgctattgcttccttttttactcctataatgtgtgaaattgaaataaaaaacagaattgaggccaggcacagcagcttgttcctataattccagtgctttgggaggccaaagtggaaggatcgcttaagcataggagtttgaggctgcagtgggctatgatagcaccactgtactccagcttaggtgacagagcgggaccttgtctcaaaaaaaacaaacaaaaacagaattggtcaccatgatattaaagagccatgaaatatattagcatgtcttttttctgcctatcccctctatcctaaacattccatgtagtcttgggaaataaattctttaaggtaggccagttattatgaatataacatgattatctattgtgttatgtttactgggttgatgccaaggaaaaatgaatatggcaggtcccagcaaataacaacaacaacaaaaatagtattgtctactatttcacagagggtgtggagttagtattgggttttgaaggatgaataggagtttatcagatgaggaggattgagaagagcattcagggcaaaggtatgtggaaaaattggtgtggtagtacacgccaatcctgggaccttcaagttgaacatttaggagtgtagtgtttatgtttcagaagcagaggatgagtggagagggcagcaatagaatggcattaagacccttgtacagtatactaaggagtttggacttaatcctgtgggcatgcaggaccctttgaaagatttgcagtgggaaagtgatcggatctgatttgctaactcattgcaatggctctgtggaagaatatcttggagaggggttcaagacttgagccaggggacatatcaagtagtgtttcaaatgctaactaccccctcctgcttctcacattgctaaatagagtgcagcagaatgaggtgtacttctgaagacaggtttttgaatcagctttccagcagtcccttgagtacattgagagggtgcatggagggaagacatatcatctttaccctgccctctccccatgttaatctattaaaagagatgggagcaaagctgctatcacattgggcttgactgaagacagaagtccttgagcatccttcccctgagtgcgggcaagcctcgtgcttgcagaggagaggagattagaataacatcttcactcttcggtgagagggcaggcagaccctcacactagatggttccaccccggagttcaggcttctcctgacaagtgttgcgagcatctgatgtccttggcctctcttctgcactgcttaccttacagcagttaagcatgagggcattctgtgtcttcctttctttcccttcagttgcttaaagaagatgagaatttgctttaaagaaaaatattaataaatctttataaaatggcattaaatagaaaatctcacactcttttcttcagaatgcttttcttcaattgccattgtatctttttgccccttccaaagtcttaccaattattattaatatatattatcataattacttgtagaaaatcaatagaattgcttgtctttatcagcagtgctacctttctacctctctctcccttttcatcctctcttcgtctcttgcgaattgttgtttctgggggtattattattgtaattacggaaattgataaaaataccatgacaatttcatgcctcagaattattacacagggtttataaaaaaagattattatacatcaatgcagtatttgttattcctaaatgattattccagaaatactaatcaaaaacatctccctgcagaatagtactgtggctttaatatcagctgctgtttctttgaatggggttgcccaatctttcatcaaagaaacacatcacccatatccctgtctttaaaaacagcaattatgtgtaaatgcctcctgatttatttgagccagggccactggccagtatgagtcaccacaatttattgctaaccgtcacttttacatgataggtctgtaacaaatatctgccgcatattgttaaattaatcttccatttaaaattaatggagttagactccccaggttcaatgtaatttcatgttcacgggcagggagggatgtgtgctgcatacaaaatgagacaaggcccaacgccctaatctttcatcaccttgaacctggagactaggacgcgtctcagcaccaactaatgagattgagcctgcgtctctcctgaggatgccggctcaaagaggcttttctgctcagaaatagcaggctctgtcttattttaataattcctcagatatgacaagtctgatgttatgtatgaaagagccaggcttgaaaaagagataaaatgaattttatatcattacttcaaaaccaaaccaagggaagtgtgttgtagttaaattaaaaaaaaaaaaagataggacacattttagtcatgaaatatactgactgtaaaccaggagtcatcctttcatttattttaatgcacaatcaccttagatttctcttctgtaatttttaaacctattcatgcgttaatcaaaataatgtggatgaaagcaggagcttgttcaataaacatttagatgaaaatatcagaggggacatgtaattcctgatggggtatgtcatactgaacctctgaagtcccatcgcttcttttggtggcatcttttgaaaatgcatcttttttctgtgtaccactaacctattactgtttagtctcttagactttaaaaatgcctaagccaaattactcaggggtattgggttctctcgtttttttttctgtctttttcacaaaccaggtaactattttgcatccatggaaaagaaggttttacagaacagatttcggctctcatacatctatagtacttctggcaaatggttgctgtttttttgtttgtttgtttgtttgttttaattcttagggaggactgagccccagagacaatgggacccttttcctaggtaaagaaaacgtctctagaaagacactaagttaagagccaggcaaggtggtgcacacttgtagtcccagctacttggaaggctgtgacagagaattgcttgagcctaggagttcaagaccaatctagacaaacatagcaagacctccagataaggtaaacttcctggtttttaaaaattctgtgagttgagttctgcttcctcagaggggaattctaagtatctgcactttgtgtctgatttatttattttatttttttgagacagggtctcactctgtctcccagtctggagtgcagtggcacgatcttggctcactgcaacctccacctcctaggctcaaacaatcctcccacctcaggagggagctgggactacaggtgcctgccacaacacctggctaattttatatgtttttgtagagacaggatttcatcatgttgcccaggctggtcttgaattcctgggttcaagcaatctgccggcctcagccactgtgcctggcctgtgtctgatttataatacaacatatgattgattttaaagctcttttttgtgatttgttgtaatttgggaccacaataattttttttccaaccccttcttcagacatacataataaaatttctaaagaagtagtattggtattatactacctatagcttttattattattattattattattttactggcattctataacttagaattctattttcttacaatctttgtatatttaaatgaacattagggatagaaaaaatgtaaactctaatacaagaatcaagtatagtcacttaattgacacgtgcagttttaaaaattatagtcaccccttggtatactgagggaattggttccagtaccccctcaccttcacccccatatatattcaagtcctgcagtgggtcctgcagagccctgtgtatgaaaagtcggccctctgtatgtgtgggttttgcatcttttgaatactgtattttaaatctgcatttggttgaaaaaagtctgcatgtaagtggatcaaaacccatgtggttcaagggtcaactgtgtatcactttgataggctatttataagagaagattttaaaaatattgctccatgtctgtacttgaataagatttagaaaatcttaggggtattttagaaccagataaattagtaaaaataatgatactgtaaattggaaaataaatgaataatagtagggcatctttctccatgaacctgaattgctttgctttcctctcttttgatgtctgtaagctgttgcgttttgtacagtgggcctcagggtgcttcgtgagtcccaaataccagatttctttttctctcttctacttatagtatatttgccttaagttcttgatattttcttctgccctcttttcttcttttaatatcttcagcatttttcttcttttttctttctctccctctttccttcccttaaaagggcttctttattttatatagaaactcatctttttttgttttgagacagggtcttgctttgttgctcaggctagagtgcagtagtatgaatcatgactctactgcagtctaaacctccctggctcaagcgatcctcccacctcagcctccaaagtagcctggacctcaggcatgcaccaccatgcccagctaacttttgtatttttttagagacagggttttgccatattgcccaggctggtcttgaactgagctcaagcaatctgcctgcctcagcctcccaaagggctggggttacaggaataagacactgtgcccagccttcaatttttttgttattgttgtgagtgagtgagtgagaaagagagagagagcgcaggttgatatgctcaagcttaaggtctgtaatgggtttaaagctccaagttttataatcggaatggtagagacggaaaggatctctgatctaatccatcctccatttcataggtaatgccatggaggcctgaaaaggttaaggttctcaaagatcaaaaatgtatccttttggaaagtattatagtggttcctcaaaaaaatttaacagataattaccatatatgattcagcagtcacacttctgggtatataatcggaattaaaaacagggacttggacagatacttatattccaatgttcatagaagcattattcataatagctaaaaagtggaaacagtccacatgtatatcagtttgtaaatgaataaataaaatgtggtatatccatagaacagaatattgttgttacttttgtttttgagttgcattttattctgtcactggggctgaagtacagtggcacaatcacacctcgctgcagcctcaaactatggggctcaagaagtcctcctgcctggtactacagacatgagctaccatgctcagcctggaacattattacctagccttaaaaaggatgataattctgacagtctgcaatacgaatgaatcaatgtaatttgaaaacattatgctgattgaaataaactacacacaaaaggataaatattgtgggatttcactgctatgaggtacctagagtagtcaaactcacagagacaaaaagtcaccaggaactgggaagaacagtgggatagggagttacccattcatgggcacaaggtttcattttgggatgatgaaaaagttctgcaaatgaatgttggtgatgattaataatgtgaatactcttaatgccactgaccatatacttaaaaatggttagaatggtaaaaaaaaatttgtatatttgccacaataaaatacacagacactggtatgatttggctctgtccccacccaagtcttatctcaaattttagttcccataatccccatgtgttgtgggagggatctggtggagagaattgaatcatgggggcagtttcccccattctgttcttgtgatagtgagtactcacaaggtctaatcattttataaggggcttttttcttctctgggcactcattcttctctctcctgccaccttgtaaaaaaggatgtgtttgcttccccttctgccatgatcgtaagtttcctgaggcctccccagccatgcagaactgtgagtcacttaagcctctttcctttataaattacccagtcttgggcagttctttatagcagcatgagaacgtattaatacagacacgcacacattcttttattacctgagaaaatttctggcaattagtatgtctgtcctcctctgcctccatctctgtagctaacatttggacattcctctgtttcagtttcagatttgctctcataatgtttttgaatgttacatctttccctttcttatttcagttttctttttttctgacattgagtacgtgctttgtgatagtcactagagatacaaatagctcagaatcaaagaaagagtgtacatgaagtattttcaagaatatgcctataaaatattcaacgatttctcagaaaatatcaattgtaaaataaataaaatacaacaaaactttcttatttgcacaaatgcgtaaagtacatgtagtctaatttaagtagtttttattttttttctctaaagtaaattttgtgactttttttttttttttgagatggagtcttgctctgtcacccaggctggagtgcaatggtgtgtgtgatttcggctcactgcaacctctgcctcccgggttcaagtgattctcccacctcagcctcccgagtagctgggattagaggtcccagctaccacacccaactaatttttgtatttttagtagagatagggttttgccatgttggccaggctggtccctaactcctgaattcaggtgacctgcctgcctcagcctgccaaggtgctgggattacaggtgtgagccactgtgcctggcccaattttgtgaccatttcatataatattataagtattcctttactaaggcaacctgttaatataggtctctcagttgcaggcttttcttattctatggattgactaagaagcccccaaaaatccttatgaggaaagatagagtcatgtgtcataagagaaggctagtaataggcttgagtttcaaagaaaagagtttatcagactgaggagtaaagaacgttggtaactggccttcaaaagatagttaagattgcatccggaaagatgtggggaaggggatgtaaaatggatagcaaggcaggatagcaacagggcattcttggaatagacaaccatccatttgttctcagtgtgaaatatacatggttttgtaatgggaattaaggccgaaatggcatgtcaaggccagtagttgagagctttgtaggtcacattgaagagtttgtatttggagtttgatggactcctaggatggatctgtccagtggacaactggatttcagacctaggagagcctctatagaggtattaattgaagcctttggatgatcgagattgtgaagatagaatataagacagagcctcttgagcatttctcccttagtgagaagaaggtggtgatacacagaaggaaccttcagcaaggtgagaatgatagataaaggatggactttccccaagaaacctggcaagggagtgatcaggagtgttaatactgtcacagagactttaaagaggatcacaaatgaggggaaaccttggattttaatcttgactcttagtactcaaggaaactgcatgttaagatgtggtaattaaagtattaaaatattctaagggtcccttgcactctccctttctgtgcccattgtgacagcatggtcacatcattgcttgaggcatgcaagagtgctttattgaagatagtattacggggggagattttattttgatagagagtaacaaatagactaataatctatcttaaagtaagtatcttaaagtcagtaggcaaaggagaaaaaaagatattgataaggaaagcatctgcaggacagattctagatttctgttttttgttgttgtgtatgtcagggcccagactatgtaaatgatagggcaaaatgtgagtagcaacatagtcttattagaaacctaaatatctacaaagagagcaaaaaactatcaagtcaagaatatgttacccattttagtaaaaaggttagatttcatttgccttgtgtatttgtgtgtgtgtgtgtgtgtgtgtatgtatgtatgtgtgtgtgtgtgtgtgtgtgtgtatgacagtactgtattaggaatgcttagtaggcatttggagaagttttgggtgattggtaacatgaaccattcttccctttaatctggtgcatctgaacatattcctgggcagaaggtatacctgtgcacattacagacgtttgtgggtacttttatttcattatcctcaagcaagaatacgagattgctatattctacattagaccaacttgttcttagcaagcacagaataataacctttcagtgtgaatgtttgtacataatagtagtaggatgtattttgtggtattttttaaatgaggattcattttaggcttggcacagtggctcacgcctataatcccagcactttgggaggctgaggcaggaggatcgcttgattgagcccaggagtttgaagccagcctgggcaacatagtaaaacttcatctctacgaaaagtacaaaaattagctgggtgtagtggcacatacctgtggtcccagctacttgggaggctgaggtgggaggcttgagcctgggtggtggaggctgagtgagtgagagtgtgtcactgcactccagcctgggtgacagagtaagacagtctctcaaaaacatacatacatacatacatacatacatacatacatacatacatatgtacatgcatacatacatgcatacaaatgaggattcactttaaaaagcattgaaatgtaaatatcagctatacctgaatgtttataatttaaaggtaagattgtcattaaaggaaaccttaggaatttctcagacatactgaaaatcagcccgaaagtgttttctgttgtttggttgttgtcgttcttttaggattttatggagtactctcattacttatcacttagaccaaaagagaatgtcaaactgccaacaaagttgttttttctacatttctactaaataatgttaagtagtcaggttcatctttggaaggaagattcttaagtgctttggcctccagtagtttagatgagacttcttaaaactcaaaatcattttattggaaaatgctttattttctgtctttgtgaattatatttataataatgcatttaatttaggccttgggattttgtatacctttgggtgggcctcttcctcttctccccctgcatctctaataagcactgaatatcaaattgaaaccatgatattctgaaatcggaaagtttctgccttttgcagcttatttgatgggaataaaaatgactgatggcactctctcttggacccttttgttcaactcacctatgattatggagcctattagctggagttacaacctatttaagagcagtgcttaccagtaatgggggccaaatgattttggaaagttcagatgtactggactccctgcagaaatgaattcagcactgaacatattgatgcagaacccgaacgaggctactccagtgggacaaagagaattgtgagctctgcaagaaatgagtgggtagtagaattaaagatcagatagatgttcggctcaagggcagtctcagctcttaagttcatcacagcaatttaatcaggcccaaatgagcgttgcccagaaaggaatcagccttcggtgtgacaggaaatggagtttatttaaaagattctttgtttctagtaattgtgtgttaaggttttccaagtctacactaaaattacggaactactacatttgataggtgatagcactttggtttaccttggttcagaagatgtactgttgagaagatttatacaagtcatgatcttgtccagaaggagcctgccacctcaaaagttccagctctatcgtcttttggattaagtaggccagagtgcatctttggctatagctatctgatgcccccttccattgtaaaattattttcacaaaaatatatttgtctacagtaagagttatataatatagcagtaaagaccacaaactttagaatgaggcacacctgggttggaatcccacctcctccacttgttagctatatgaccttgagcaaattacaactgtagttgaacacatagttctttacttacgaaatgagaataataattcctgcctcacaagattatggggagaggtcaattaaatgatgtagtatgtatcagttgcttcacaatgtctgcacataataagggctcaataaatagtagttacagctctagagctctctcatcttgtccctcacctcatttgcccactcctctactctcttcatgagccagagtgttcactgctttaggaataagtgagggaaactttttttttcttttttctttctttcttttttttttttttttccgagacagagtctcgctctgtccccaggctggagtgcagtggcacgatgtcagctcactgcaacttctgcctcccgggttcaagcgattctcatgcctcagcctcctgagtagctgggattataggtgcccgccaccatgcccggctgatttttttttttttttttttgtatttttagcagagacagggtttcaccatgttggtcaggctagtctcgatcttttgaccttgtgatccacctgcctcggcctcgtaaagtgctgggattacaggcgtgagccactgtgcccggccaaataagggaaactttttagaggatctttggcttcagtcatggagaaaaagaagaaactataaacacttggaggtctgaacagttcattgattgttaagaacccaaacaaaaacactccgtccccaaccccgacacaacaatacagtggggtattttggattgacacattattagcctggaaacctatattgacagccaggttatgattttacacatgtaataagaagagtctattggtttttcttctttgttgctcactagttcttaagtttgctcactaatgtataggtatttttgtctaacactgacaaaatttgaaaagaagtataataaatttattaggattttacttctctccttcatggacctggcaaatagtgtatctatgtctccatacccatatccacgttcttattttttttatctgtatctattatctgtctctgtgtgtgtggaaagtgataatgaatgaatgaatgaatgataaaagatccaaactatgaactttatggatatcggggtaaacatccaacaatcccttaaatttggtgcactcaagtaaaagctgaactggagagagttgaccagatcctcttaaagttaagctttttatccctctgcccataatttgtaccttgagatcctatagggatgtgcctaggcctgtgtgaatggcagcctcatctatgctgtacctgcagtacagaccagcctcatctgtgctttacctgtaatacagagcgaaacatatctagagaaagagattagtttgcaattagggggatcccacccattccacagcttggcccagtggaggttccctgctttgatcgtctcttggtgaagagaagaagagacagcaagtgctgtagaaagttttcttctttgtagttaaagtgatagggtggaaacaggagcatagaaaagacattcagagaatagaaagtgaccaaccatttgaaaacctaaaggaagacctgggttcaaacatttgttaacatacagagaagaaaaatatgatctgtttggggtattacaatccagtgtgtattttctatcatacttaccaaatgtacttacttgttgtaaacatttaatatttgtttagtgctttgaagattcggagtaatgtttcagatctacatattgtatcaataagcaaataacatatgctaagcacttaaaggctattgtcattctccagctagtacagagcaaatgtgaaagggtaaagactatgtaatttcaggtgcggtttcagtgaggaagccagaacagcagtctactcttatctgctgctttcttccaccccaaccccctgacccataacaacaaaaatcaaacccagaacaaaccgcatagattgatcaaagagcataacatgcattgttaggatttcagatatgtagacagaaagtcagattaagctttaatgataattttgagttcttggagcaatgctcattgattacaatgtgtgtgtgctggggagcaatatttggggtacccataccttccctgggcatgttaaccttgtggggcttgccttgtttcagaacatgtttcctattaaaaaaagatgactgtaaaatcgtaggccttttctagcatgcacctcaaaactcttccagcctctacccatcacccagttccaaagccacttctgcttccacattttagttatttgttacagcagtaccctcccttcttggtaccagtttttgtcttagtccactcaggctgctataacaaaataccaaaaactaggtagcttataaacaacagaaatttatttctgacagttgtggaggctgggaattacaagatcaagatgctggcaggttcactgtcttgtgaggcctagtttctggttgtagatggcaccttctagctgtgtcctttacatggtagaaggggtacacgagctcctagggccttttttctaaaggcactaattcactcatgaaggcttcaccctcatgacctaaccacctccactaaaggcccacctcctaataccatcaccttggtagttaggatttcaacatgtagattttgagtggacataaacattcagaccacagtccctgtgaagaaggtatttgttattctggcagtgcaggagcaagctagcacacttgccatatttagctgatagaagtaatgtgaaatgaaccgttaggaggagggattttgtggaagaaggaatggcggactgagcaagataaaatatggagaattgctccctcttcaagaaacgcctccatcctgatgtatatcagctttcatatccccatggatattttacaggcattgctacctctttaaacatttatgctattaaaaaaatcagaccaattgttgacataaagctaacatagcagcttctatatagacagaatatgaattttttatgctgttgatgagaagtttatgtcatttatatactatagtagggtagaagatggatttggaatcctgaaaaagctactgtttgtaccattcagaatattagcttgtgctttgaatcgaaatattaagatacctgtattgtcaatgtgagtgtttctgtgcaaagtggcttacatatgggtggaatgggagaaattgctctacctggagaaaatagcaatagttttctttcgtttatgttttgttttgtgaaaggaagggttaatagcatttaatacctgatttatctgtgcttctctgcaccattaaaagaatgaactgttgtggtaataaaaccatatttcattgaattaaaagtgccatcacttgcaagatgcaacattattttatgtacctctaaaaaactacactaacaaactgacatgtcaaactgacatgccattgatgttaagatgcattccaatttcagagatgtaaatatactttaaaatgtatatcttggaatcaatgaaatactgcatatagttcttttgtggtatgtgtatatatgtatgtatacacacacatatatacatatgccacaagagaataaagtatacttctatttggttatagtctataatattttgaatcattttactgagttaggttttacttattttttaaagttgctgttgacatctgtttgataccattcatttaacatggcatgaatttagaatctctacttagaatagtcctttggaagccctagtttgttgagttttcaaaagaaaaaagagtctggtgcaaggaggcagactgacattcaagtcagatcattttttaaaaaaggaaagaaaggagggagggaggaaggaagaaaggaaggaagaggttcatcctgtcagttaggaaccagctatcttacttttcaaagacaaaatcagatcatactagtatatcacaatcccgtagtttatctaattgcatatttataattcttcttggatggtgtctctcatcttggattacctctctcacccaaaatcatattttattttgttttgtcattataaaatttactatatgatcattgcaaaacaaaaacaaaaaattaccagtacatataacaatactggatgtcatatattaagttcacaataaattatggcgatttttccacatcaataccttatcttcatgtttcacatcaatacataatcttaatttttagtgactgcatattatatcattgtatagtaaaacataatttttaaccatttccctattgatggacatttagattggttgcagtttatcactttaatggcatggctgccatgtactttctttttgtcacacttacccagtgatcattttaggatcaattcctagcaatttctggattgctggatcaaaggctctgtcttcatgttattatgtgttgggaagggaccatttcctcatctgttcaccaatacaggatatcagccatctcccaccccaccccatctttacctacttgattggttaaaaaaaaaatctatttttgtttttattagcatttttaaaattgtagttgaggttgaacaccttttcatatgttttggccttttcagagtggttcttgataatagaaagcacagcaggtcagagagcaaaaggtcttaatgaacttccattctgcttcacagaagcctatgaggttttgaggtaactttctcaagttcgttataaagaagatgaaactgatagaaaataactgtgatgtagagatggggtctggcccactttcagctggtctactctccagcactggaaaggaagactgagcatcagaaagccagggaagatccctccagaggtccaggattgttctgaggaatactgaaatcaaaaactctagactccttcctgctttctgagatgcagggatttgacagagaggtcaaaaaagggcccctttcctctgcatgtgcagcttttatttactattgtttcctttttgttgtattgaaatgtcttcattgcttgcctttatggatacaaataaccggatactgtaatttgaaagtagttaacaatgaaactgcatagtatgagccatgctgatttttttttttagtgggcaaatggggtgatttctctatgagcctctctgctgtcagaagctcttaacatttgagtcaacatgggaattatatttggaataaattagtaaattcccattcagcatgcctataccatgtaatcttcaggaaccgtaatgactgtgtagtagagtatatttccaacttggtatttataaaacacatttgctctgagaaacccttcagtatttgttcctcaaggcccagccctcatgctgcctcctttgttagtcagtgtttattttgtaatagttgggacagtgttgtacagtggaaacccatttgtctttggagttagcccagacataaatggactcttaggcctgctatttactagcagtattctcatgtttggaaatcaggagcaatgtaattgttgagacaatttattttaatgagagtaagtcatgcagtaagcatcaatcttagcacatatacatgttgtctttttttgtctccctgaaatcttcttcagctgcttccatgtactgatatcttcttccaaattccttaagagccttcatctgggtcatacattgacatttatttgatacttaatattgatagttatctcttgatgtttgtgtatgtctttgtatccataggatcctccattagcacatgtattcattcatcaaatatttattgagccacttctgtatattaggcatagagtaagatgctggaatatgttaatgaacaggagatgtggtcactgtgccctcctaatgcttacatcccagcaggcaagacctatatgaaacaaagtttgaattactaaatgaaagacatggcagttgctattagcaatgttgtaaggggctgtgaatgtagactagcttgtacatgacatttgagctgatatctattggctgagtaagagttagccaggtagaggtgggagtgataagtctttaggcagagaaagcagcacgttcaaagactctgaaacaggaaaggacttgtttcagtggtgcaatagaggatgagcaaaatgttctcagagaatggagtgcagaaagcaggccttcagagaggtcattggcagcgtaaaaatggggtaagaacggcaaccttgtgcagggtcttgaaggccaggtgtaggttccagtctgtcacctgagagcaacaggaagatactgaagggttaaaggtttacctgtggaagagtatcagtaaaacataaatggatagattctaagtgagtctactttaagctggagtttggagtcgcagggtcctgcgtgtgtaccaccatactctctacacttttaaaactaaaacagaaagtattctaaaacataaaacaaaactggattgtattttcaactgttccttcaactctgaaatactatgattatgctagagtatgagaaattttattttccaaacaaatataaagatgtatttctgatgaaaaacattttcaacctaagctaaaaggaaatctaatgaaaactttaaggatcctttaaaatactaatattgtgtttaaagagaaaatgatacttgtctttaaaatgttttaaaacatttaaaatatgctactgaatataagtgaagagtggtagatcctaaagtagtatttcttagaagagtagaataggttatttccaaaatctttttcatggaattttagtgaaagctaccatagggatcatgttgtccagcctctttgtccttataaaaacatcaatatcttcataaatcaagaaaatgagtcccaaaattggacacatgagctacccattttctaagattttgctgaacggaactttgatcataggggtctctttctaaggcaacgtattagaaactcccagcatcactgtattccttataagaatcatattttttacattaatctccagaatcaaactacaagacaattaagttgttgcttttaccaggttgaaacttgccttgatttactatgaatgttggttgccttgatttcttctactttttgtctcagttctacatgttgttgttcttctggttttgctccttatgagattcgctggatctctgtatctcttcaactgtggtgagtttcatggacagggtcagaacttagggaaatgttgagaatagggtgtggtcctatgatgggtcctcctcttcttacaccttcgactgttgtaccactctttgatgttacaaagatgaatgacttgtggtccttggcccagagtttcatattctggataaattattatttatttgtagtgtacttctatatttttacatgctgtcagaatattagaaatacagtgtttcctgtcagaaatgccagctgagcaaaagccagtaagtcagatactaatgaatggattagcaaattatagggactaatgaaattaaataaagattattcaactaaactagtggctcctcccagtagtttagagcgttgctgaccaccttctttttgtccactcacatattagaattaaaaatgtcaaagtaaaattaaaataacattctcacctacaagaggtagggagaaggaaagtaatatttatctttaatgttattttcagttgtgcatttattatgtatatttttgcataaaataacttgtagtttttgtttggacaagccaatcaaatgagtctttaagatgaagaaggagagcgaacccacaagagatgagtttcgtatgtcttctcaaaaaaaaaaaaaaatttttttttagctcaccaaaaaatgttatgaaatgagaattttgaaaccttacctgtggaaatcacagtggtaatacttatatttcagcccttagatattcccagtggtgttttgatcttagatattcccccaaaggtgttgattagattctggctacagctgaaggaagagaatttttgctttttagctgaatagtaaaacaagcctctaaagatatgaggcatgggggaaaaaaactaaaggcttcttcaaggtggtgtaagggcataatttttgtcatctttattttaagagctctaccaggccagacgcggtgactcacgcctgtaatcccagcactttgggaggccgaggcgagtggatcacgaggtcaggatattgagaccacggtgaaaccccatctctactaaaaatacaaaaaaaattagccaggcatggtggcgggtgcctgtagtcccagctactcaggaggctgaggcaggaaaatggcgtgaacccgggaggcggaggttgcagtgagcccagatcgtgccactgcactccagcctgggcgacagagcaagactccgtctcaaaaaacaaaaaaaaagctttgccaaaggtttccccttagtaaagaatttaatacttgaagtcatcagattagatttcagacttcatttacccgctctatgcatttttttcgtcttcctgggtttggtctgcctgtgcttcttagtctacaggtgtcttttctctgtactgccaacctctaattggagatttattaggtgctcttaagtaagagaggaggaaggccaaaggagacagaaaatggagaagcaagaagaaactgatcaaggcaggagagggaggaactggagaggatggagataaaagatgtataaatgaagacaaatggaagaacaatgagatagagaggcctgaatggtagaaaaattctaaaactgagctagtgagaatgcatataaaataggggtctggtagaagaacttcagcaaaagtggtgtaaatcaatgatgagtaaattaatagggcaattgtgcaaatgggactcactcatttatactaagcgtaatacatcatgaatgatttagagataatgcaacccgtagggcataccttttaatctacccaggacccggtagagaatgctgtcacttcaagagtaaaaaggcagaggatcagaatattgggtgtgtctcttcattctaacagtgttaatgagatagattctgagcaacatgaaaattaaccagactcacaagcttagtttgtgatttatagattgaaaagaagcttaatatattccaaacatcttcctacaaacccaaaatatttaagtgttttgaaagtattcatttgaataggttaacatgtgtgattgccatggatggaaatgaaagtaaaatgagtcactgcacatatgatccaaggaacatctgagtgttaagtgggttgtaactgcataagaatccagtgctattggaagatgcatcagagtattctgagaccagggaataaaattctcttccatgtgctcccttctctttcattcgtgtgcctattcactcaccattcaataggtgtctatcgacagccttctgtgtggaaggtactgaggaatgtcctatgggttgctgcttctacctgaaacagaaacataagatttacatccctcaggccctcttaccagtatttttatgggaggatattgaggaagggaagggagaaagtgaatataagaagtggagagaagtcttggtttatagagctgttagggttccaagtctgctgttctttcttgattcagaaatggaagctcacaaaggttgtgtctggaccaaagacccaagatagttggagtgttgaggattagatgattttgggcttcccttctagttcattcttagaatttattcccagtttttgtgtttatgaaagttagagatacagtcttcaaccattaggagttagaggtgaaaataatagtaattggatgttaccaagtatgtaaacacttgtagggaagggaaatacataaataactaaattctctattaaattctgattctgaaaacttcaaaacagacctaatttagtaagaggggctgcatttttatatgtgatcccacagaatgcttctagacttctgtcactgatggggaaaaatcaaattattcaaagtcttgcaccatataacaaaaaagctaaactaagacgagatttcagggagtatagaaaccagcaatttgtgaaaaatcttgtgtatgaagagtcatgatgtagaacattcaaacaaatggatcacaagagatttctcaaagcatgtcttagaggtgagcaggcaggcatcaattttaaaattctctgttataaatgatcataagcttatgtttttctgtgtaaaggagaaataatttcccaattttataaaacaaattaccaatgatgtaaaaaaaacatttagcacagtattatatcagagggcatttaacattcttttgaatcatttgagattttcatgtttccatttcagagatcagggaagatgtgccttggagaggaagcatgtcttaaatctggaaatgatatgaagagggatgtcagcaacacttcatcctgggccagtaatagggagagtttcttttctctcgtcaaattgcttaaaggattctagttccgtttggtgtggtcactcacatttgaattctaatactctatgtgatatagattctgttgactactgttagcgtgaccccaatgagaaattaaacacttccctccttttca

SEQ ID NO: 565 - DNA, 581065 bp, Homo sapiens
cgcccagcagcgcctcaagcccgtggtggcggcggggctgtctctttaagcgctccggaggggctggggcgggagggcggcgagcgcgtttccatggcaccggggctgcgggggctgctgggccactgggctcactcggtttcagttgctcccggcggagcaggggcatgcagctcagcggccaccgagcctctggggctcgcccggccgctcctcgcgctcccagacgcctgtgacgcctgttggggccaagctgctgccgttccctccgcagacagacgcgccgcgccagcctcacgagccctgcaccaacttctgcccgacaagcccaacttctgcgccgggttcggacttgcggagccggaacggcgcaccgcgcgcagcccgggcggcggccagggcggatcagcctcgccgagatgtcctcgcgactgtggctctggtgcttctgcctgggcggttgccggctggccgccaggaagcgccctacagctccggctgggcatgtaagtggcgcccgcgcgctccggaacgcttggagagagcagacaacagtatgccccgccccacctcggacctggtgcggacaccgcggcccgagcccgggaagggatggggggcaggaggtggggacagacacctgcgggggctgcgggctgtcccgggcggagcgcggcggaacgcagtccccagctagtccttggggagcgccagcccgggagcggagaccgcgaccggggcgggtgtgctctccacccggtacttcctcagcgcctgacagatttttgtcccccgcccccaggtttgggtgtgtgcgcgcgtggtatgtgtgtgttttcgttatttttctgttttaagagtaattggctaatgactaccactttgtgacagggttgtgaatgaaatcctgtcgaacaccgagtttgacatttttttctttgtagagaccaatgagttcgtgcacatgtattctttctttttttgggggaagtatcgccgagtcggacggagtggtttattccacaggtttgaccagaggcaaatcctggctcgtctgccgaagtgaggagctggggagatgagtatatgaaggattgagtgctcggccacttagctgctagtccccttattagagaactgaagagttagtaggaaggtgactcaaacgcatcgtctcaggatgggcatggtttcattccggattagaaatcatgaaagctaggagataattcttgtcaccgtgtcaaccattagcgaggagctcacgggaagtctaagtctttacaaattgcctagtcctcttgactggctggagaagtttcacctgaattctgtagcctcagcggaatcatcatcgaaccacctgagagagaaaacagatctaattctgcttttcgatttctgctcctgggcggttatgaatagacaccagaatattttgaacatgtaaacatttttgccattttgctcctactctgcttcacctttgcctttctgaaatgtgaatactttattatagaaaaatggcttagataagtacacaaagccatccatagatctctgaggctttactttttcctgtaagaaaaattcgatttcagggttcaaattacatttccatatttcatttctttcatgtgagattcaatcttgacacatggccagggtgtcagtggcatctcagaacttcttgcctacatagtttgtagatatgtatttggcaaaaatgccacgtttctgggtatgtgatttctcttgaattgatgtgtcttgtttattttgaagagaaggttgatttagacttttcttcttcagtttatctcagaaaacacatccgactttggatagcttgtgcatgcgtaagcctgcacttcttagaaactgtcttttagaaagcttgcagagtagccatgctcttacctttacaagtgcctttatttaagtggatcctaggttggctaattagccacgaaatcacccatgcacactgagacagaacagtccctttggagaggaactgagaaataacagaaatacctacatcacttttgaccttgtttggctgttttacctcaggtttcaatattgactcttttgttgaaaaggctggagggatgacactgcatttttttttcttttaaggatactgctactgcagctcatttatttatcaagtgagatgagatcagatattaaaaaatatatgaattcttaagtgtttaatacagatgctttttccaggatgtcattgaggatgttttccaggatgtactttctgaaatcttgatgggaaaaatccaaattttgtagttctccttggtattagacataatggtggtttcttcagcaggaatcgtgttgggatttagtgctaggtttcttcagatgcctttgcaattgttgtaggcatgtgaaatgtagccacatatagatagcacttggcttccgcatacctgcctatctattaaattaaagagaattcttcctgagatttgtattgacctctgatgtccattatcagtgagagcaggcttctaatgaggtgaagaccactaatgagaatgcatcatcttactgactggcacttataggtcattaacacaggtaaaagtttgatgtagctaaacttgtacttgagaaaattttggagctggggtgacaagtgaaaataagaaacaactgtgcagctaaccagcagtcattgtgtttatggtgtattcctctgaaggtaagctcatttccaaagaaattttttttaagaaagcaaaagatgaaatatgaatattccaactctaatgataattgatctgtctgatgaccttgtcttaccacatttaggaaatcttgaataactaatattaggcagattcataaaatcagcatttggaagagtgcctaagtacctattacgtacagaggcattagaaatcacaggcaacaattaatccgtttgaattcttacatgccaggcaaatttctagctactttacatgtattatttcatttaatcctggaaatgccctatgaggtaggcacattatcataccattttatgacaaagaaagagacacagtaaggttaagttacattccagaaattcagaagatctgggcctaggcagttggattccagagctgaagttcttaacacatgcagtccatttaagaacgctcaggcccagcctctgtttttaagaagttctttttaatcacttcaatgcgttttcagtgggagtagagctggtaccttctacctagtggttgagatacctgtgccaccttttttgattgttgccatagttatatggttctgttggcattctgtggtgggtatggagagaggttggcatgctaattgtgctgctatgggtaggatagttcctcacaaggaagatctgatttatctcctccttattgagactcttcataggaaattatcctcctctctcatggctgtaagtacttgagtattaaaatgagggggtaggtttaaactggatattatacagtgggagtagttatctgaggcaagtgcattaaaaattagagagttgtaactggtaacggcattttgataaagggatattgaagagtttacttatgttaatggtattctgcaaatgttttctgaaggattaaataggaggaaataaactctactctggatctttgagacatcaaaggaaaatgattggctgtaatgcactctattaaaatttatcttttgtaatgtactcttgtaaacacttgcataattattttatgcatcctaatgaaaagtagtaaacatgggagtgttgcagatatcatagcaggcataaatgaataaaggaagatgaagtagcttaagctcctgggacatgtgatacttggatttctctgatatctggtgggaatttttaaacaacatggccactttgtgactcagcagtagtctaaactgtgtaggacatttcacttccatcccctaagatagtacaggcagttttgacatacagatcccaagtatggctgatatgaaactgtctacccctctcccatgacacacatacatagaactatgtttcacctcttagttacaggcttaatacaggcttctgtagttaatgtggaaacttagggtcagtcagagagagagtgacagtgacttagattttatgaagaaccaatggatttggaaatagagccagtcaataatctatgataataatttggaatagtgaaggagagatgacagagttgtctgttgtcccccacacatgctggaatttgtttctttttattattattatttaaacttttgatattatacagcctgaaattgagctgtcttagttcgttcgggctggtgtaacaaaataccataaactaggtgggttttaaacaacaaacatttatttcttatggttctggtgattgagaaatccaagatttctcagaatcttggattttcatagatctgatgtcttgtagaacctgtttactggttcacagatataggtttgtcctcaggtggtgcaaggggtaaaggagctcccttgggcatacattaatttcagtcatgagggctctaccctcgtgatgtaatcacttctcaaaggccacatttcctactaccatcacattgggagttagggtttcagcacaggaatttcaggaggaaacaaacattcagaccatatcatgagtgaactagagatatgtggggctaataataatcccttatttatttacttacttacttagttgcttttgaaacagagtctcactctgtcagccaggctggagtacagtggtgtgatctgggctcacagcaacctctgcctcctgggttcaagcgattctcatgcctcagcctcttgagtagctgagactacaggcacatgccaaccacattcagctattttttgtatttttagtagagacagggtttacatgttggtcaggctggtcttgaattcctgacctcaagtgatccgcccacctcagcctcccaaagtgctgggattacaggcatgagccaccacaccaggccaataatccccttaaacttagaaataatttaaacatagtctgggtttactcattaatttaaattaattggaaaagagtttttttcttttgaggtcaggcacattaaatgagcagaaaatgaatttgagaagagaaggctgtgtgcattctctatgggtaaaacattttttagcagtttgtatattaatatcttcaatcctaacaacaatcatatgaggtagataacaccatcatctttttcagatgaggtcactgaggcacagagaggtgtattagtccattttcacactactgtagagaactacctgagactgggtaatgtataaaggaaagaggtttaattgactcaaagttctgcatggctggggtgacctcaggaaacttacaatcatggcagaaggtgaaggggaagaaaggcatgtcttacatggtgtcaggagagagagagagagagaacaaggcgggaactgccaaacacttaaattatcagatctcatgagaactcactcactatcatgagaacagcatggaggaaactgctcccatgatctaatcacgtcccaccaggtccatccctcaacacatggggatgacaatttgagatgagatttgggtggggacataaagccaaactgtataattctgcccctgttccctcacaaatctcatgtccttcttacatttcaaaacataatcttgctttcccaacagtccctcaaaatctaaactcactccaacattaattcagaagtccaagtttaaagtctcacctgacacaaggcagttccttccacatatgagcctgtaaagtcaaaggcaagttagttacttccaagatacagtgggggtgtaggcattgggtaaatgttcccatttcaaatgggagaagttggccaaaacaaaggattacaggcctcatgcatatccaaaacccaaaaaagcagttgttaaattttaaagctccaaaatcatctcctttaactccatgtctcatatccagagcatgctgacacaagagatgggctcccaaggccttgggcagctctgcctctgtggctctgcagggtgcagcccctgtggctgctttcatgggctggtgtgagtgcctgcagtctttccaggtgcatggtgcatgctgttggtgatgcaccattctagggtctggaggacagtggccctcttctcaaagctccactaagcagtgccccagtagggactctgtgtgggggcaccaaccccacattttccctcttgactcccctaatggaggttctccatgagggctgtgcccctgtagcagacttctgcctggacatccaagtgtttccatacatcctctgaaatccaggcagaggttcccaaacatcaactcttctgtgcaccctcaggcccaacaccatgtggaagcttccaaggcttggggcttgcattctctaaaaccatggcacaagctgtaccttggtcccttttacccatggctggagcaggagtggctgggactcagagctctgtgtctcaaggatgcacagagcagcagggccctggtcctggcccaggaaaccattcttccctccttgacctctgggcctgtgataggaggggctgccataaacatctctgcaatgccctggagacattttctgcttcactttacttatgcaaatttctgcagccacagcttgaatttctccctagaaaatgggtttctctgttctacttgtggttggtctgcagattttccaaatttatatgctgtggttcccttttaaacataagttctgatttcagatcatctctttgtgaatgcatatgactgtaagcttttagaaaaagccaggttatatcttgaacactttgctgcttagaaatttcttctgccagataccttaaatcatctctctcaagttcaaagttccacagatatctagggcaagggcaaaatgccccagagatttgagcatttttgctaaagcatagcaagctaaagcatagcaagagtgacctgtgctccagttcccaataagttcctcatctccatctgagaccacctcagcctggacttcattgtccatatcactatcagcattttggataagaccattcaacaagtctctaggaagtttcaaactttcccagattttcctgtcttcttctgagccctccaaactattctaagctctgcctgttactcagttccaaagttgcttccgcattttcaggctatttttatagcagtaccccactatcctggtaccagttttctgtattcgtctgttttcacattgctgtaaagaatgacctgagactgggtgatttataaaggagagaggtttaattgactcacagttctgtatggctggggagacctcaggaaacttacaatcatggcagaaagtgaaggggaaccaaggcacatcttacatggtggcaggagagagagagcaagtagaaaactgtcaaacactttaaaaccatcagatctcatgagaactctcactgtcatgagaacagcatggaggaacaaccctcatgatctagtcacctcccaccaagtccctctctcgacacatgtggattacaatttgagatgagatttgggtggagacacacagccaaaccatatcaagaggttaggcaactatcatgaagtttcatagctgagaagtggtagaatggggtatagacccatcctgtctagctccagagctctgttcataatcaccatactccgtgctgttccctttacctttggcttttccttcatatgctctcaaactatgagactctgatctttttactcagtctggatctgtttacctaaattcagcagtagctgctcttgctcctattctccccaagtagattcaaacctttgccctttagttttagtagtcaattccagttcatactttattgatgatattgacattttattatatggattttctcagtgtccctgtcctcagttttaatattatttacatatgtttacttttcttctttcttctgtgtttcatagaaatacatttaccactcttgtttcaaggtaatccctccctgtatgttccagatcccatttaaaaaatattttctctgtcatttctttttttatcattcattcccatctctttccattctactgttttttctctttttccaatcatattcaagtcttgcattctacatctgtctctactgtatgtctataagatgttttgtctatatacaggtctgtgttgactttgcttcttctctccttcaccttccattgctgaaaaacagctcattaatgctgcttcctttgtttttttctaatcatcagtcatttaacccattgcactgtggcctcctctgctgaatgtccttttcagaggctaccctcttttcagaatttgcctaacccttatttttctgtagcatgtgacattactaattcctattttctactttttttacatctcgtacttttcctttgtacatgtagtatcatctgtagttctcctcctccattggtgcctgcattctccccttctatctttatttctctttccattctttatacattaactggtttatctcttcccactggcttccatcatatgtgctatttttatgagacccagatctgtacatccagccccagtctctttggagctatagacttgcattttcaactatagatttatcatctccatggatttcagactcaaaatgttcttagatcatctctagtcattattgtctccttctatatcttcttctcaggtactttgtctgtcttctcctttgtcttatttgaattttttttaaatctctgttacttgtctcccagtttacattgttgttttattatgagctttaggtaagatggttgtgaaaaggcttttgtttatggcaattcgataaatataagttaatatttatattcctatcagttgccaaattctgtcaacacctacaacaaaatatctgttgaattagttcctattcctgatgccaacacttaagcctgttatgctatttttactcctaggctactacagttatctctttgttgatcttctctttcatatcctctcaatcctctttattttattatatatactacttagtttttatctagattggtttttaaagcaaagatctagtgacatcatttcctttcttaagaactctgattatccatgaaatcagctcagggattcataatattgttcttaaatagcacttattatgtgccaggaataatttaagtactttgcatattttaactcatttaattcttacagcaaccctatcagaaggtaatgtttgtatcaacatttatgatgaagaaattgaagtccagggaagttaaggttttctggagaaactacatataacagtatgaagctcaggggagaggtcatgtaattaataagtaataaagctagggtataaacccaggctgtctgactctagaatctgagcacttaattaccacactgtattcaaggccttatctttttggtattatttaattttataaacatttattgagtacatagttatttttatttattatttatttattttttgctttttgtttttttaaatttgcctgtagtccccttctgctactcaagatctgtgatgcgtctaagattttactttaccttcaagataatgagttagtctgccacagttcatagttgctgctagaagacatgagattcctgggcaaagacaaatgactttattagttccttagtctgtagcaggcagcatgagcttcatgtttgcatcagttatcttgcccttgcctccttgctaagttccatgaaggcaatgaggagtggctccaatggatactgtgcataccatgagtttgtgtcacagatagggaacctggagcttagacaaccttcagtcttctaaggggactgctagcaaacctgccaacccttgccgttagagggagaatgaactttattatcttgctcaggaagcaactctgccctcagttctggcagaagacactctcttcatcttccaagattgttttttatagaaacatccttccagaaaaaagctgtcaaggctttttcacaagcagaaatgcaagagaccttgaagaattgtctcccaacatccctaacatgttgctttcccattttagtagcataggttttgctatggcttaaatctagtattttttctcttttgttgaatccagtgcttgattttcccattcttttaaaatagataggaacatattaaaactagacgaacacaaaggtttaatgagcttacttaaggggctgtgttcaaattccaagcacttgtcttttctccactgatgctgaaatcaaattactaacccagttgctgaatatgtagttgatttcttttctttttatttccatttagcaaagatttattcattgtcaagtactttgctaggcattggggatacagaaggaagtaaggtgattcctttctttaagcaactcatagatcaggagggagatcagcacacagactagagcctaccaatacaaaattggcagagatggtacatgtaacccaactataagaagaaagaatacaggacctcagggtaggttttcaagttattgactctgagtagaggttggatgagtggtaaagatggtgatggtggtggtcgtttccagttggtgaaaagaatatgtgcaagaaggcagcaagatctccccattaggaaaaccataaatcatgttcttaacagtatgactggggagaataatctgtatgaggctacagtaaaagataagtttagggctgttgagtccagagagaagcggtgtgagtctaataaccaaaagaaatagtggtggtaataaaacaagggaacagatctgaaagataaatagcaataggagttgatgaatgcatggaggtaagagagaaagacagacttgatggggcctctgggtaatggagaatatcagaaacacaagagaaaggagccttatgggagaagaagatgatgaattcagcagtgactgactatgtgggcatttctgtgtctgtgggatctcagctggagacgttctagagaaatccactaaaggggcctgaggctcaggaaggtgatctgggctggagctatatttggctgttgaagtggtaggaaacaagtgtatataaaaaagtgaggaaaaaagattattgaggaaggaaacctggatattttaatataagaacagaggacagatgaaaaagggcctaaggaggaagttaagaaactgcctgagaggaaggaaagaaagagtggtatatgctatggaaggcctcagggaagttaaataaagtagaaacttgtatagttaaaagtgtcactactaaaaaatgattgacttagagctacataaatagaacatcactggaagaacatcattctagttgagaacttcgctgtcatagccatcacttttggtcatgatgacaagaagtggaaactcctgtggagtgctcttatattgacaggctgtgtttttgcctggctaaacatttactctgtatctgccatcattctgagctcattattactatggccagaaatgactgtagaaagaaagtcctgctactccagcagaattaattacagatggggcacaattcaggatcaattcacaatcatcaaggcatttttctaggttcttctgtagaggtgggtaagatagagtctccacccccagggagcttataagcaagtattatgttctttgttgataggatagtcaagtaccttaaaggagttaaaactcaagtagtactttaagaaaggagaaaataaatttgtgagaggaaatcatgggaagctttctggaagtggtggcatttgtaggcaaggtaggattggggtcagaagtgcattcattgtaggaagagagcagagcgtgcaaggccttggaggttgttggaagggcagtgtctcctggggccaatatacactgtggcatcttttgtcaccatcattggctccatgcatttgcagctctttcctctccaaatacctagcgtccccaaatgcccttcacatttttctgccatggtgcctttcctctcagcaaactccctgccttctcttctcttccaggccaatctctaaggcccagcacaaaagtcacctatttcacaaatacttccaggtccctcagataggattaattacatgtttgtctgtttcagcaatcttaactgatatttttgtctgacataggtatctggagatctatagtttcttttaaaaaatctatttgtgataaccatgtgataacagcgaaaacgtgtttggaattagtaaaggcacttccagacgattctgttaaatcaactccttgtagtatataaattatgtggcttgtcaactgatgatctggaaaatgttttctgtcattcttcagtggacagttttcagtggtgtttaatgttcctcctcactgatatggttaattaagaattgacagtaattctgagctttagtgagttttactcttgagagaagaagcaatcccaggagacttgaggttttgtttctctgaattattatgaaaactattttcatgagtgaatgtagtggatgccaagcaagagaaagtaactgaattttgaatagtttttcctttctgaagggcaaaatactaatattaagttgccgaacctgcagatttttgttatgctgtgaaggcttttgttataaacaaaagtatatgtggggatctaatgtacggcatagtctgtagttagcaatactgtattgtgtacttgaaatttgctaagagagatcttaaatgttctcaccatgggggaagagaggtaactaggtgagatgatagatgtgccaactaacttgattgtggtaatcatttgacaatgcagtgtacatgtatatcagatcatcatgttatacaccttaaatttgtgcagttttatttgtcaatcatacctcaataaagctggagaaaagaacatgataataaaataagtcaaattatattgcttatttattatgaagtttaaataaaatttgctgttccagcttacaaagtccaaaagataagaaaaaaattctcagcatgaataaactgggaatgtatcttcacatcaaaaattcatttttcaatgcatttaatggtttactcatgctgagaactacttcttatcttttgaacttttgaaccctgtatgtatggagatgagcaaaaatgtatatgagtttcttttaaatgtactggaataccacatgtaaaacaaaacaagtagaaaactcaagacccagcaatacacattgatcaattatgtgataacataataatatttgtactgggctttaggcatgttatatgcaatactgaaatgaattttgctatgagaaatatcataggcatcagccattgaaaggtatgcctaacatcttttgtaaagcaaatcttgcttgaatttaactaacagtcacaagtctgggccagtaagcaacacagtcagtgtcccctccacccttcataaatctatttgcagtagaaatctcattaacattttaattgttttgtatctaaagttgctctcagtgccacatttaaagggctcaggctcattaaaatttaaggaccagagagctcatagtctactctaatgacctagtgatggttgtaaaggctctaaatattttttggttctttgaataactgaggaattccttgtagtggctaagtatgcctgaagataggttgttgcattgcccaatttcaatcccatcagaaagctctctccctcttttccctcatctaaatcctagggtctcttaaagtccctttcaacattttctgtcaacttttatttcattgcccacattatttctttagctagattctaatttaattgagggaaaagaattaaaatttgtcactgagaatctaccttctgtttgtgtttctccactccccacactgacccccgtcccattaaaaaactatctatcccaaacttaaattaattgtaagcattagaagttcttattctggctttgctacacgttagctaatgagactacaacacaccttctggactcagtgttctcatttgtctgctaaaactttggtatatgtttcatgacattgtttttgttctaaaatacatgtcttcaaggattaattagccttacttacagtctgtttccaatactactgttatatacagttattaacatttatcatttaaatgtagaggattgtcaacccaacgtaacagtcttttgttttgctccagttttggttaagcccgtcctggtaagaggtgattaaataatattttttctttgaagactatttctggttgataataatgacaccctatcattatacccaaatattatcaagaaaatatttaattttctatgagaaaacagagaaagaagtaaaaactaacatcaaattggcctgaaggtttataccatcaaagtgtattgaaaaccagaaagacccaagattattgcactagaaattgttatggggagagggtaaatgatctacttttaatcctgggatgtgacagtgataataggatgcagattatacaaaaacagtaataactgggagtatgcattcacttaccctttttaaaatcatgtgttttctatacacttataaacatgcagcatgaggtaaaatatgtttctgtggttgtcagtttctggaaatgcctcttatgggttttgcccataacgtatgttccgtttaaaggctctactttgccttaaaaaatgcggctttggctgggcacggtgactcatgcctgtaatcccagcactttgggaggccgagggggtgcagatcacctgaggttgggagtttgagaccagcctgaccaacatggagaaaccccatctctactaaaaatacaaaaaattagctgggcatggtgacgcatgcctgtaatcccaactacttgggaagctgaggtaggagaatcgcttgaatctgggaggcagaggtttcagtgagtgagattgtgccattgtactccagcctgggcaacaagagcaaaactctgtctggaaaaaaaaaaaagtggctttggcctcatggccagaagattttggatggggatagaaaataatcagagcagatttgaaggtaccttacaccaagacggtcattttacaggctacatctgccctagaggcccctgaaatcctttttgttttaggggacacatgcttcagtttcaccatctttaatttttttaattgtataaaaaaagacataaaatttaccattgtaaccgctgaaaaatgtacagttcattaatgttaactatttgtattggcgtgtagcagatcttgagaactttttctcttgcaaaactgaaactctatagcccttgagcaactccctatcttcccctctcccagccccttgcaaccaccattctagtttctaactgagtttaactattttagataccacatcttagtggaatcatatagatttgtctttattattactggcttatttcacttagcatgatgtccacaaggttcatcattgttgtttcatgtggtaagatttccttattttttgaatttttttcaacgtttaggttcaggggtacatgtgcaggtttgttataaaggtatactgtgtgtcatgggggtttggtatacagataattttgtcccctgggtccttcttttttaaggctggataatatttcattgaatgtaaatactacattttctgtatctattcattcactgatggacatttgggttgcttactactcttggctattggtgtgcaaatatctcttccagatcctatactttaaatttttttttaattcctctggatatatacccagaagttggattatgggatcatatggtagttctatttttaatttaaaggaacttccatactgtttaccatagtagctgtaccatttcatattctcacagcaatgcacaaagattccaattactccacatccttgcaaacatttgttatttctaaatttttttaattgatgaataaaaattgtgtatgtctatggtgtataacatgatattttgaaatatgtacacattgtggaaaagctaaatcaagccaattaacatatgcattatcttaaatacttatcagttttttgttcaccagatttttgtctttcggttttcataaaagttatttctatttccagtgatgttttatctacgtgacatcagcatacaagctacactttttctttcttagattattttattctacttaaatttatatagtagactgatttacctgacagtatgtgttcaaataaaaaataatttcataatcccttatccataattttgaaatccaaaagctccaaacactggcaggtactttttattgttatttgttgcacaaactaatttggttgcaaaatctacagtgatctggtatgagtttaattgtagaccttatttatatttaatatgaaaattgttaggattccctgaaaaaatattaatgagtttgattagcgtgtgactctccagacacttctggacatatatgtatcatattgcctctctaagatctgaaaaattctgaatgccaaacaatttggccccagggatttagataattctaatctgtgtttgtcaatataatatttgaataatatactgctctttaaacagtaatttagatttttaagagtttgctactttgaacagaattcttttataaaatgagaaatcacttttttttgagacagggtcttgctctgtcacccagactggagtgcagtggcacaatcacggctcactgaaggcttgatgtcctgggctcaagcaatcctcccacctcagccttccgaatagctgggaccacaggtgcacactaccatgcccggctaatttttgtatttcttttttgtagagacagagttttgccatgctgcccaggctggtcttgaactcctgcgctcaagcgatctgcctgcctcggcctccctgagtgctgggattgcaggtgtgagccactgcgcctggcagataaactagttttaagcaaagaagcacctacctgtttttgtttgtttaaattctggatgttgattggtataaagcaagggaggttcagctttatgtgttcttaaaaaaaaaaagagatttatcataatattgatgaatgtctttgaaatttcaatattttataacataccttgtcaaaagcataattaaaagaaaaataaattgtctttcatcattaaaagacgttaacatcttacaccagtcaggatggcttttattacaaagtttaaaagcaacaggtgatggcaaggatgtggaaaaaagagaacacatacaacaatttacattgttggtgagaatgtaaattagtacaacctttatgtaaaacaatatagagatgtcttaaaagaactaaaaataaaactaccattcaatctagcagtctggctactgggtatatacacaaagagaaatcattataaaataccacctgcccttttatgattatcacagcactgttcatgatagcaaagtaatagaaccaacataagcgtccatcaatggatacttgagtaaaatgtgattgaaatatatatatatatttattatatacacacatatatatgtatgtgtacaccgtggaatactactcagacataaaaaagaatcaaaatcatgtctgttgcaggagcatggatggaataactcagaaacagaaattgaaacaccacatgttttcacttacaagtgggagctaaacaaaaggtaaacattcacatagaactggaggccattatcctaagtgaataactcagaaacagaaattgaaataccacatgttttcacttgtaagtgggagctaaacaaaaggtaaacattgacatagagagtagaataatagacactggagactacaaaaggtgagagggtgggtggtgggtgagagttgaaaaattatctgttgggtacaatgttcactcttccagtgatggatacactgacagccccgtctccaccactatttaaatatatgcatgtaagaaatctgtacttgtctctccctaagtcaataaaaagaaaaataaagttcctattttaatgataagaaaataaaaattagatgattcattaagtgtaatgcataaaaacaagttctgttgtcattctattaagccctgtataaaagccctgtataagcttctgtataaaataaacagagccagttgacatctattggatctcgatgccaggcagcattacaaggactgtctatattattgcatttattttatctgaacaacaaagactgtgcaattgtactatgcctctgatattgaaatgttattatttagggatagagataaagcaaaaaataccatgtgctataatttagatatttatttaatccaattgcattttatttgcagtgggaataagcctttattagtcccactcttcgttacttcttatgatgtctacctccagagagtgtgctaatcttttgaagtgtaaaatggtctgattatggttagtcagctggagagtgaagtctctttatttattttttttttgagacagagtctccctctgtcacccaggctggagtgcaatggcacgatcttggctcactgcaacctccacctctcaggttcaagcaattctactgcctcagcctcctgagtagctgggattataggcatgcaccaccatgcctggctaattttttgtatttttagtagagatggggtttcaccatgttagccaggatggtctcgaactcctgacctcgtgatctgcccacctcagcctcccaaagtgctgggattacaggcgtgagccaccgtgcctggccgagagtgaagtctttcactctcttctgcttcacaaactttcctgttttattttttcgataaattttattctatttttcttttgaagtccctattttgaccctaataagctgttatacttttactttagattgcatttgtgatagctctctatatatttagattgataaattattaggttccaagaaaagtcaactgaagtgcctagctcactctcctttagtttttgtatttcatattaaatatgcttataatattctcttttgtatgtgaaatctgcatgatcacacgttgcattattaatagcctcgccgaggctttgcttcttgctgttactacttctattatctcagtgtttaagctcttcatctaatgacataggtggaacatttatgtttctctcatgactttctagtgtagagaaagaggcctgttctgaaggaaatagagcccttcttacggtggggtggagtcctttgatagggagttttggtccctgtggagacagatacttcaagagtcgtaagggactgggaataaaagttaattctaaagaaccccagaaactcagggaaggcatctttgcatctgacagactggccaataattgaactggaagaagaggtaaatattctcacaaaggagaaggattacacatggggaggattgtaagtgagtctccctgcctctattcagtctggcaacaagagatagtagggcttttgacctacagacaaattaaatgccacctgtcaaaaaagtgagctttatggctcagtctttgcaattgtgtgagatggaaaacacatttgtgaggaagcagctaggaatggaaagcctgaattaaaatgaattattgcttgaaggacagataaatgcctgttctgattgaacctgaggctagcagtgaatccactgcaccaacgtatcatcactgtctgtttcactgagtacatcatttgcctacgaaataaacttgttttcttttgaaaaacatctttaaaatttctgtgtgtgagcaacaacaacaaaatttggacatagcctaaatattcaagaatgaggaaacatctaggtaaattatggtatagccttacaatggaacatttatgcagctttttaaaacgatgcttacgaagaattttaatgccctataaaatgcttatattataataagtcaaaaaagaggcaggatacaaatgcctataacagcatgattttatatataaatgtataaatataaagacaataagcacaaaaggaaggaaatgtatcaaaatatcttaataatgtttatctcctggtggtgagttatgtataatttttattctctcatctacagttatgtttttgctaacttttctgtaatgaacatctattacttttttcttagaaaaaatactttgaaaaaagttgttaacctgtaatgtgttattgacaaatgccacttgaagacaactttgtaagacctcttttgagccaccagtgcaactaagctttatttcccctaagaaccattatggttcatttgtatttcagtaaaatgtttcattgtatacttctatccgggccactattatttagtattccagtgatggtgaaataaaagataaaacatttcctatgtttaaagatttctgatcagataagaagacctctttctaccacatggtttccaatcttgtaaccttgctccaaattaacagacataagcgtattcaaaacaagtagatcataagcgtggcttcttcagatttatagttagtggttcagagctgtagtcttatgtcatgtttctccttgtatatgtagcatccactcaaaattattttctcagataatttactgggtattagttgaactgtaaattgctaaaaactttaacacatttatcatctggtttttctactcctaagggtaagattatcctgacttggctttctaggtgactcttctgtaaccagttgcttacatataaaaatactttgcttacctagaactcagttatctgacaacctttatacagttggctctttgtatctgtggactctacatcccatgaatataaccaactgcagatgagaaataatcagaaaggaaacccaattaaaaaaacaataaaatttaaaaactacagaataacaagtgtttacatagcatttacattgttttatgtattataagtaatctaaagatgatttagaggacacaggaggatgtacctatgttgtatgcaaatattgcaccattttgtataggggactgaaacatttgcagatttcggtatccatgggagtcatggaaccagttccctgggatgccaagggatgactatgtctgagaaataactgagaagcaataagtaaaccataataacaacataagtaacaacagctaccacttactgggtacttgctatgtttttttaattctgagtactgtcctcattatctcatttaatcattataaccctctgcaatggttattgctctccttatttatagaggagaaaactgaggcttataaaaattgaatcacttgtccaaggtcacagtgctcattattgtgaagctaggagctgaaccatattccaaagtccaaatatactcataactattaccataaataaaaattgaaaacagatgtcacagtgtctgtattctacaaatgcttaacattacacttcaagatcccaagaaaggatcactctattttacaaaatgaattcagccaatttacaaatacaatatttgaaaaagggaaaagagggcttctagaagtaggaattgataacgaaaaagaaggtatggctgtaaactgatagaggggcttagagaatatattcccaagaaatctgaaagcataatattctggattggttcactaaaaacatcttttacactgtatagtttctaactttatcaatataataaatatggagcttcatcatggtagatttatcttgtcaataaaatattaaaatgaatatagtcttaattttaaaaacatttttataacaatttatacattttattttagaatgattagagaatataggtcagataaaataacaaaataaaaaaatctcataattttacagccagagatattaactgttaacattttagaagaactacataatataaatacaaatgtaaacataaatgtatacgtttacgttttaacaaaatagggccatggtttacttttaaaaaattaccttcagttacaatctgtgtgcacatttaaaaagattatttgattatcaaggtagagaagtatataacatacttaagactgattttcttccagtaagtataacaacatgcacacacattaatctgctgctttaaggcaaaatacatattaatccagaaaattattttatgtgaatcagctcattgatgctacatcaatgaggcactactgtactttggctatctttatgccatgtaactttcattattcttctctatacatttgaaagaaaacttgattttttaaaggagaaagaatcaataatgagcgggaaagtttaagggtgttttgaaaggaaaagtgtacctatactctatattccctggctggagctgatgtgatttaaagccatctgtttctttcacttgaaatgcagttagctttgtattcatcagcctacttaattcaggagaaagggagggccaacttccaaaagctgagtttttatttgctatgtcagtttacaaagatttattgagcacctttttgtgtgggtcttgtattagatagttatttactgcaaagacgtgtaagatgtgctctctgtactcaaaaaaagtccagtcaattgatctaaaaaatataaatagttaattacaattcagcatggtgggtacaaagagtgaagtgaggtttaggggctataggagcacatgggaagtaagaaaagctatctggctgtagagattccaaagtggacatgtagagagaaagtgggtggctaaggaaaggggggtgatgcagtatgtttcagatagaggagctgcatgtacaaaggttcaggggttagacaatgagcatgctgtgtttagtgtcatggagattagggtaggaagtggaaaaagggctgacaagcaagtattcagggcctatcaaggaggcatcctgtgtcatgctgaggaattgggattttatccttaagcaaagatgagtcattcattggaaatactgtcagagaagccatgaatagaataactatggttcagagaaatcagtctagtgctatgtgaagaggccctaagttgtacggagacaagatcaggatctgagctaaagtattaaagaggaagaagttgatctggtgaacttgctgattgttggatgtgggaggtaagagagtgggtgaggaaacatgacatcattatctctgggttaggttactgggtgcatggtaatgtcttctgcaaatgaagaagtttccaaagaaaagaagattgagaggatatttcaaagatgatgaatttattctgtatgtgttcagttggatatgtagaacttgagcttaacgaaagcagtgactagaacaatagatttgggaggtatctgaatatacaagtatgaaaaccagagaagggagtaagaacccccaggtaatatctgtggattcagagggacccttgaggaccaccatcattttaagactcagtatagaatagtagtgaagcaatgggctctgctgtctggattcaaatcctagttatacctcttattaggtcatgctatcaattctctctgtccttcagtttcctcatctgtaacatggagatgacacatattttagtcataggctagttgtgaaccaaatgagttaatatcttaaagtatatattataggactggcctgtagtaaaagttaaacagatttagcttagctttactgtattatttaaacgattacggtaaatttggccaaataaataaagaaacagtgaagaatacagaataagtgttgtcaaagggttagaggaggacaactatgaggagcgtcataaaagccaagtcagaatttggaaagtgagctgtattgaatgttgaaggaagggaaagacaagcaagagataaaatgtatcttttctttttttgttaggagagtttgctggtcaccttggtaggatgggtccagggtccggatacagtggtctgataattggtggttataaagtatgagtgaatctgaggtattttatgtaagtgaggaaagaaccagcacagggaagggaaccaggcaatgaattgaaagaacccttcatgtatgcatcaaatatcctcagtatatcctgtctgacagtggaccatgaactgaataaactctccaggaactatactctgagactgtatacagagaaaggtggccattactcttccatccttttgttctggctgaccttgaaaagaaggtaggagaggaaccctacttctttgtgcctgagatcctctgagaagtgtattggtctgtgttaaatttggtaggatccctgggtgagagacagcacatgatgttgacatgaagtatctgaagtcatctcagtccacttctcagtccacatctcagtccacagcaggtcaaaccacagttcagggacccttctgagtaagggaaaccccctacaggtaggctcttactctgcagtcatgctgactgagctattctctgtgctgcttctggcaacaactttcattttggcaacaactttcatttggatgctttctctttcaaaggcagaatagtatattggaaggattatgaagctagatcacggaaaatttgtttcagtttccttcattcatttttcaaaaatatgctttgagcacctactatgtacgagacaatataccactggctgaagttggaattatagtggggtcaggacaggtagggcacttgtcagaaagagcttgcatgacagtgagagagataagctattttttaaaaaaggaaccattctctgaaagggagaatacaggtctacaactttgtccagtgaggtcagagcatcttcttgggggcaaaagtgatggcaaagctgggaactggaaggtaggttgagattggccatgtgcaggggacaggggagaagagttctctaaggagaggaaacagcatgggtgaaggctttggggttatgaaagaacctggtactttctaggacctaaaagaagtttgaatgggctggaatatcggggtgctgtccttttggctggctaaatgatactgggcatcaatgaatttgatattctgtctcattctccttaaggccagaagtgggcagaaggattcccttgttgtaggctgttgttcttagaatgcagagatagaagaaagatacgaaagaaatcactctgaggaccataagtagggtggattggggctcagggaaggcaagagagaaactagaatcaaggagatatgttgaaatgctaccagttgatgagattgcagtgctggaaatgggaacagagaaaggagttggctggaagaagaaacaagtttggtaaagaacaggaggtgctggcatgcacaattactggtaattcctggaaggtagttcatttgagagggaccaccatgaaatgatgaagattaacaatttttaaagagaaattttagagagcatagagcagcagacaggagctggaaagccaatgaagagagttaaaaatggaactgtactagaaagaagaatttcatgaatttgtgtcaaggaattttagaagacagcatttcaaaaaaatagatttaactctaacttagatttaactctaagtttctctttgataaatgctttaaaaaatctagttaattaggcaaattatagacttaacagttaaaaactcagaagtctcagtctgtgactggtcaaagcatacctgttaagttgtggatgctgctttttcagcagttttagagctgatgtagtctgtttcatttttgttgctagtttatgaatattacagttttttagagtttctaatattctttttggagtcatacagaagggaacagagaaaggagttggctggaagaaagaacaagtttagtaaagaacaggaggggctggcatgcacaattactggtaattcctggaaggtagttcatttgagaacgttcttaatagagttcttcctgaggaaaatcaggggagacttgattcttatgtgaaggtttttttttttttttttttttcaactatgtgaagtgaaagtatggaaatttaactctattgatgtgtgtttgaattctgaaagagatgaaggggtgctgtgaaaatgcactgcactgtgttaggaaatgggattgccccaaagagcatggccaatgcctgggacaattgcattcttgactcaccctcgtgaagagctaaggcccagctgggcaatcacaggcgctgggtggaggcttccccggtggcacccctctgtgctctgcactcttcttagaatttaacatttccttagcaactggatagggtgcataggttagcattaatactgtgaaagagaagaaacttggggcctttaaaagaatgccatcttgggttactatgctttcattttggttttatttttctcagtggtcaaaaactattgtttccagccagaatatcctttttatgtccttcaaaacactaatttttggttgctatgggaactggcttatcaaattttaaaaatttgtgtatttcagatccctggaaaacgtgtgtgtgtgtgtgtgtgtgtgtgtgtgtgtgtgtgtgtgtgtgtatgtaaagaaagaatcagatattattaaaatgaaacatatacctttgttaggtgaattgtggagtgtgtgaggtaacacttcattccaaacccatgagctctaccttaaaaaggtatccagactttgacactacttggcagctttactgtagtaaccttgttccaagccatctttatttcctacctggggttattggacggttccttaactggcccccctggtttctcttgtaccgtttccctaccctggctctgaagcgattctgttaaagtgtaagtcagattacgtcagcctcttttcaaaaccccctatcagctgccacttcactcagagtaaaaaccagtgtcttcaccatggcctgcaggccctatttggtcaagtccccatcctatccccaactgatctctctgaactcctctctgaccactctctggcaggttcagcctactgaagtcacactcagctcctcgcaaggaattctcctgcttcaggactctggagtttccttttccttcctccctaattagaatgcttttcctctagacagatatatggcccactctcttaccttgttcaggtctatactcaattgtcactttatcagtaaagcttttaattctccaagatcttggccctccctttcctcttctctagtcagtttttctacaacacttaacagtgatctcactagtgtatattttgctgatttatttatttattgtccatttcctgcatttggatgtaagcttcatgaaggcaggacgttttgtccattttgttcactgatgcatctgcagcatttagtacctagcatgttgtagttgctaataaatacatatggaataaatgaatgaatttaatattgctatattgctttgcatattctccctgaaatgatctatttcttttggaaatggctgttctgcacctatttaagtgtcgatgacatattaatcatggaatagcaggcatcaccccaggtgctagactgtgaagatgaataagaagcatgccctgtcttgcagagagcttacatttgaggaaggaatcaggcagttaagtgcatggaggtaagtgctgttggagaggaaaactcaggtagctttgggggaaagggacacacatttaaccagcttctgtgatataccaggcacctcacaattactactccatttttgtgatatgaaaactcagcttcagtgaggtaacatgaattgtccaaggtcatatgacctgcaggttaggaagttaagaccgactgggtctagttctaaagcccacatatggcagataccactttgcctccttatggggtaagggtggtgtgtttaactgtgtacaaacatctatttacttcttttctggtagtcctagatgcaagtgactatgtatattttaaggagacttaagcttaaaggctcttgaccttaatgagggaaaagattgtataaattcatataattattgctaattattaaatgttctgaaagtgtggcaaggccattgtgaatggggatattagggactcattcttcaagggcccttttctttgtgaaggtttctgtgaccccctaggaaaaatttaaatgctttcttttctgtgcacccatagtacttgcttgcatatccattcattatcaggtttgttgataaatgcatgacaatttagatattacctttatcagatggggaaacgccatgaaggtgaagaatttttgtcttgattatctctctgtgctcagtgcctctgaaaatgtttgttgaggaaacaaattcatagaaagaatccacaatttaaactacaaatctatagaaagcacctgcatgaatgaaactgtggtctcccttaattgacagctacatctttaaagttggggaacaaaggaaaactgtgtgacatttgcgaaccattagttcagagctggactgtaaagagatacaggaaaaaattgatttctaaagtagaaatgctgatggcatttggagaaagtcaaagaaatataatttatgattagaatccatatattgctttatgatttaccaagtgcattcataaacactatttaattatcacaaaactcagtgaggtagagaaatacaatcccattgtactgatcaggaaccatcagagaagtaaggataactttgaacttgatcaagtcacatggttatttatggagtccacatacaaacttaagatcttctgattccaaatcctggacattttccactaggccatgttccttccggaatactggacttttgtatcattatgagtatataggtctctgacttatgttttccattcatgatatctacaaaaatgaattgtatattttttgttttatatcggttttctctattgtaaagtactttggtttattatttaattgggccctaaaatacatgcttaactacattttatatattattcatctttcatctataaaatgggattatattccacctgccgagtatcttgatgtgcttcataaaatgcaaaatccagatgggaacaacaattttataaatcttgaacattgttttatgtttgtcttttgagttctatctttcatatcacgacctttcaaaagtttgtggttaaacccagagtaatacactcccaatgctatttactcaagaagttattagtatgagatttatatatgacagaaggtagatgtaatctttgtaggtgaatgctagtaatataaagtagcagatattaatatgaaaagcgacagcttctttaaaaaatatcaagtgaacttttgacttaaaaagttagtatggcaggcctacagggacagtacaaagtatataggaagtcacgtttcgcatttgcatactgaaagcatcgaagtctgatttccctccagcattaccaatttcattgattatagctcttacttgtctatgcacttcaaccaagtttttagacaattcaaagtggttagatgatcggtctgtgtatatttgctgattgattgcattcatcatataccgcaatggaaaagttgtcataaaagtctcgattaaataatatacaagctgctatgtataaacatctcatagttgaatttcggctgaatacactgggctgcaatttttcactttatattgattgaacagccaagtgattgcagataggggctgaaaatagttctgtagagaaattccatccttatagtgtatgtgcaagtatgtttatctgtgaagcaaggtgagagtgctgggaaggttcataaagtaactattgatctagaatctggaattcactcaggataatttttgaagagcataggagcctctgtaaagattaaaaaatgacataaactaaaacattgttatagatcatggtaaatagtaaccctggcttcatcagacaaccttgattaggaagagcagaattagatattgggttttttttcttcttatgtttaaaagagaagagcagcattcatgcccctttttgagtcagcactcattttttggggaagctcttctcatctaaaggaataatccaaaatatggggaaaactaattgcatgaatatgtaagacaaggtacatccatttgatagaatttttgtaggcactgaaagttgtccaagttgtccttgtgaagtcttagcaatatggaaactatgttgatatgataataggaaaaattattttatgcagataaaattgtagaaaacttactattatttctattataaatatgtatattaaaataaatttatagataaatagtaatcatttgattacttttattataaacattttatatgggaaaaccaaagttcagcactgttaagtaattttttaaggccatacagctaatcagtgatagaggctggacttgatctcatggttgtctgcctcctaagactatgccttttatattatattaaacttgtaatattgcttctgaattttaaatataaatatattttataagaaaaactaaggagaaatctagaattttaccataaaatgtgtttttgggacttaatttgttcacctttaattttcttttggtcttttattttttcctactcttcttcattgattcttccctttccttttctattcttttcttcttccccacattttcaattttcaaccaggaataatcatacttctagttagattgtgttttggtgaataatcaaatcactgcctcccgcaacctcacctgctgttcctgcctggtcttcttcccccatccttgaccattcctttttggatgcctctcacctctcttaggttattcctttttgattgagactactgaaaaaaaacaaaacaagacaaacaaggtaatcttcagactttcttttggggatgtccttcactaaatctcatatattttaaatctgagcaattggaaatttctactcctactcttttgctttcattttgaggtaatgactgtgtggagcaaatgttgactctttctggaggattaatactaatttggctctttaaaaattttaagcagaaagacgatttcccctgtcctcccaggaatagtgggtagaggtagaagatgctgatgtttttctcctgtttttaattaacatgtttgtttttagggtgtcttttcttctctgacatttttccctctggacttagcaagtttttgaatcactgtttctcctgccagagagaacatcctttgagagaggtcccagagatgttaagagaccctggagatctcaagagatgttaattagtagaagtaaataaatagcttgtttatttttatgcgcattttaatgctgtcctttacttttttaaattaagaagtagaaaatgtgcttgtgcttaaatgtagtgtaaagtttcccatattcctttgggtgctggtgtattttccccagttgcagaaaatatgttcagaagaattttacctgttgagactattccttctccattttattgctttttattgttactgtagccccctgcacaaaaatggcatatgaatagtaataatattttataatctgctacagtaaccatatttgcttatttgcaacaattacataggactggaattaaagatatagagacctgagaattgcccatcatttgcaaaaaactcttttcatgcaaaagtgaaaaatttacagtgacagagcaagaaggaacctttagaatgtcttccccattcttatcttaaggcagcctcacacttaagacagctcgagaaaatgacatgctgccctatttgggaagccattaaaattattttcagaactttggccagtatcatcttttcaaaatatagttaaatcctgctagaggagctgttttattaatattttacttaagcccttagagtagaattcaagcttagtatttcatatcctaatcaagagaagtaatatacaacagcagtgaagagtatgaaccctgcaaatagactccctgggttcacgttgtgactttgccacttaatgctgtgtgaccttgataagatatttaacttcacttcaccatactattctcatctttaaaactggataacactggttgtgaaaatttagtgatatgttgcatgtaagatacttagaatcgtaactggcacacagtaagcctaaatgattgtttttagattagatttatggttaaagagaaagacaatctacagattggaaaggttagaacaataagtgagaggggattgaatctcaaaatgtcagaagctagtaagaaagccccagttggaggtttccaatcctagactaattactaatttcacgtaactgagataacgtgcatattttgtgatagaaccatttttggttatcttcatgggagcttgatattttcaaaagctgtccaacaacacctaataatattgttgtggacatgatggaacaatattaccttgatcataatattattagctagatttacagatttggactcatataattatagtgctagttaatagatcatgaacagtattctgttagaaaattcaaggcatttacaatgagaatacctataatgaaaagataaattgtaaatataaatataaaagtggcattgtggagaagcagaacccaagtatgtcatccaaaggtttaacgtatatattaccattgaacttcaaatttggttctgaggatttttgcaaccaagatgacaaagaagatatgatcagttacattactattattatctaagagaagaaagtaaatcagttcctcaggaggaatttttcctagtacggatttgtaatggagattaatcacataggttcataaatgatcagcaccgatttaatagcaatttctttaataaatattttaaagcaaatgctcttttataatgaaactttgggaaagaagtataaaggttatgaagtgtcagttcagcaaagagaaatggtaggctaatgtcatctgtgtatgtgaacttcatgtgctctgagttgatccaaagtatagttgagagaacctaaactattggaagtacactctgttcttcagtaatgttatttcacgttgcttctctcagccagagtttgaggggagctgggtaatagggtctagttagaaaggcgtagaggcaggaataggactattttaaggttgtaagttttagcaggaacagtaggctttagaaatcagctaggaaactagtaaagttgacctcctccataaagtgtttctatatcatgtttcttgaggctctgagtttgttaggggtgcttggctggatgggtagtttggcgttaaggtatttgaggggcaaaattaagcagctcagttttacttacttttatatgttgagtttctgcaaaagtctttatgtgacaaacagtaaaaaaagttattttgcttaaaaatacgggaaaactgtttctgataaccctgattcttccagtgtaaaaaatgcaagttttatatacgtcaataattaaatgttcatatttttatcatgcatcttaggtcgtatctggttcctgtattagggttaaagacaatttgaggtggataaaaagccgtctttaatctgtcctgaaatggccaaatatatataaattgagataaggcctttctgtcaagccctcttctgtaattaaagtagagctttagtaaatctttggatcaaagaagactggtcatagatttgagaattttttttttttacctttcttcagacttttatgtctataatcctacaaattcatttaggtagggtcaccattaacttgttatgtaaatcaggacacttttgagcatggaagtggttcataacaggacaataagcactaacggagagcagtttcctgggcgtacttcctgcagggtctcccaaagtctgcatgtaaacaggtacaggagtctcagtgtcaagggttagggagatgggataatagttgattaaaattaataaaataaaacacattcatattgaccaattagaatataaattataaataaggaaatgtaaatcacttataaacctactttttagtgattacaattgttaatatttggttgagcgaatatccacctagaatttttatgagtaatagaaaacacatattttctttttccttctttaaaaaaaaacttgtgatatttaactacttttttatatttattgcttttatgtaacttttaatcattgtcatttttcaatgtcagatattatttgaaaatatgctctttaagggttgcaaagtattttatcttagagttgtactataatttattgatgcattcctatcattggtattttgagttgtttctatttttttactattataaaatacaatgaacatttttacatctccgtttttgagtggaagttttataatttcttgaggatgaattactggaagtggaattacagagtcaaatttttatggtttgtgtatgtatctacatctgtattcaaattgtccttctgcaaacatataccaatacaaaataccaccagcaatgtgttaggttgtttcaagtggttaatatttttcttattaacatctataatagctgtacctaaaatggaaaaaagaaatcctatgtgtatatgtacagtttcctctagacctgtctcacaaattgctatatggcaagtaagtagaaaataattacttcactgagatatcctttgccttatcacctttggagaaatcatgatatcttttatttttatctgttagtggttttttttctgttgttttttgagatagagtgtcaccctgtcacccaggctggagtgcagtagtacgatcttggctcactacaacctcctcctcctgggttcaagcaattctccctgcctcagtctcctgagtagctggtaacaagcacctgctaccacgcccagctaatatttgtattttttagtacagacggggtttcgccatgttgaccaggctggtcttgaactcctgacctcaggtcatccgcccgcctcggcctcccaaagtgctgggattacagttgtgagccactgctcctggccttaatattttttatgaaatgatgaacagtatgtctggggttggttatgaaaatataaaagtatactcaagttttttacatatttgagtgatttgaaaagctaaaggaaattaggcatctaaataagtgttcagttggtacctttgaaagtgccaattcggcagcggatgtgagatggtgtattaagtggagtatgtgaggcggggctttccacttggatggacattcaaatgaggtgagtgggcagtttgatgtttgagagcaacgttaagctagggagtcattcctttgcttacttgcagaagataaagcaggtatttttcaggagcttaagtctatcaaactggtggtgttctttattgagaaggtgaattgatgataggagttcatcctcagagggcggctatgatcaagatgcagcaagtgaataaaacatgtatactacttcattttaatggagctcaggagctataagcaggtcttaagctctgcccattaggacttttatttgtttttctgctttgttaatttatagcagttatcaacaaagtttcttctcactctattctaaataatctattgagaaaaatgccagtcctaaataaatttttcttgttccccaaatgaagggaagagagctgaatagtccactggtctaaaaggaacgttttgtagccatgccgtgttcaagtcacaagttacataaggcaaggaggcatctaggcctggttatagatcttctataatatttctcatggacttctctgagttcctcctctgaccttctgtctgtcttatgtgcatgtttcatgaggcctatacagtatctagggttgtctgggcagaatctatagactaaggtaagtgaactctgtattacggcttgtttggtttataatgtgagaccacagcactaattggacacttcatgtgtgctgttaatacatgtaagtcctctaagctaataagcttttttggatttccctgttgaaggggatttcacctatcttaaagggagtagaccacactaccatgttgtgtgggaggttagattagcaacctcaagttaccaaacttaaagttgaatatttcagtcctgcctaaacttttaagacagaaacgatcagcttacaaaatttaattttgcagccaggataaaataaataggatggcattggcagagacaaatttttctgatggataaatcacatgaaaggcaatattgtgtaagagaaaaaatagcaccaaaagagtttcttgggacttaccttaaaggtttcccccttctaattatacagagaaaaatcactctgctccacagtctccaagaatagaaaggaggggaaaatgtacttaaactgcagtgtgagaaagtaaggttggatatcagaaatcatattttggtagtattgttaaacattgtgaagagttacctgcaaaagaccccgtatccttaaaagaggggaggaggagttgcaagcacacctggcctctgaatgcattacaggcaaagtccttagaaagctgttggcaaaggttatggggaaagcagtagacaagcagtggctacaaagaatttactggaccatgttagaaagcaagaggaacagcaagtaattgctcctaggcctaaacaaaaacaacaacaacaaaatcatctcaaggacaatggaagagtggaagtgctaatacacatcaaaatgtgaaagaatcatgggaggaactgcctacacaagcagaactcattgtgaattaaaaaaaaagaggaattaaaatgtaagtttgctatgtttgtaggaaacagttaagtgattatgaaactgtttaggtttggtggctggaaaataggtataaaatgtaaatattgtgtttaaaacattttgaattattatctagaagagtattaaagagtgatagactcttaactgactgagatatttatgtgctttcagctagaaggataaaatcagtggtctcctagaatcaattcttatggtatgattctctgaaattatggagatttgttggcgctgagtatgtgttataaagttcagagtgcaaatgggtataattaaataaatgttcactaagcaactgctgtgaaaaaggcatgaagtacaaagttaaacaatatgtggcgcatttttaaaaaggtgcttgcaatatccacagagagattttgatggtaacagatctggtaagggctgcttgagaggtacacaggcatttttataagagaaaagaacaggcagaaatgagtttggactatgggagaacatataaagctttcctgtagagaaggcagttggtttgggccttaaaggagatatgaggtttttgaccaatgatgatgggaggaggaaagggaaccctgggcacggaaaagcgtacatggtagtacatataagctggaatacataatgtgtgtttggtgctttctcaaagtcaacaaaggcttctgaagaggaaagaacaccattagaactttaggagataaacttttgggaggagataacacaaaaagaccagttaggagctactgaattagcttagagaagaggtaataactgcttgttctaggtaagccagtaagaaaatgaagtaagctgctaaggaaactaagaaaagaagggaattatgagagataactagtgatgaaagacctgggtgggtgtagagggagaatcagaggtaacacaaagacaatagaatgattggttgaatattgaggccattgacaaaaactggagagaaggaaaaggatattgtgaagcaactccttggaatcaaagcttgcttctcttatgactgtttttctttctgccttcacatccttcctttcatctcctcagttcagtccctgctttgtgcctggttctgtgcaaggtaaagtaatgaaggtaaataaaaacacgcaaaagatatcccccggcccttaaaatgcttaccatccagtttgggtaatagaatctatccatatgtatgaaatccttagcacatatttagaccataactattgtgaggactgaaaggggaaaaataaggggttgggctgtccgtcctgcagaagtgaatcttagatacaaatatgcaaaacatactctagttgtatatcaggtaataaatggggtcaagcctattaatgctggttccggtttgatatgaacagatttgtcttttgggttttcttgaagatcttagcatgtctccatgtgttgtcacccttgtattcggagatcagacgaatattaaataagtttatgacaagctattcctcctttcttgttatttattgagattccttacccctaggaattactttgcagatgcttctttctttttgaaagctttcttgtatttcataattatttgttgaacaagtaaatatggtgactttttaaattaacttaaccccaacttggggtccgatttctcatggtaatgtcttggcataggattcaagcatctgatttcacatctaggagttgtgaactagaatacttaaacgcagctccacccaccccctttctttaaagacccagtgacttaagtagaagctgtaagtctttattttacccctgcactgtagctttcagaaatcttaaaagaatccaaaatgggctagttattttgcacttccctcttaatagcacctagggataattactggtatcttttgttgccatctgttttctagtttatagatctatttttatttcatgtttctattctgttaaaaattctgtttataaaaagtacatatagttggcaatatgagattttttggatcttcttgtagtttatgagaccaattaccagatcatttgtgaagacatagtgatttgtgaaatttgaacctgaaaaccaatagcaaagggaagaaaagcagttggagtatttgccagatgagggatgtcgcagtgctctttacaaagccagtggtgagggccacgtgaaaggaaaagcctcactatatctagtctttcagtatttactcagggcaaagacagacttcagaacagatattgtctttaggagtatcgtagtgatcactgagggacacttgaagacttttatttatttctttcctatttctactcttttggggctctgttctctaattaaaattggtgttttggaaaaagggaatgtgacttctgaatacagtaataaattatatccttgcctcagatggaattaaaatgactgcagacgtgaaatttccctgcttctgaaaacttaatttgatattttctcttacacaccaagcagtgatttgcagaggcacagactgtaagattaattgaggcagccatctcttctggcgcatctaatcttacatctaattatctgatcatctgaatcacaaatacagtagttaaagggtgtctgtttaaagggcacacttaaaatgtaaatattaaaaaggagctctctggttttccagagacagacatgcagacttgtaatggccattatgttattcatggcattaggtcagcaggccacatagaactgtggttacattgctctatcactaaaatgtgaagataattctgaagtctgtattaggcttgttttgacaattaacctccattagtattccagaacacataagagcaaaactcttaaaaggctttcttttcaagaatgcactgtcaaattgacttcatcatttaaataggactgtagtcacagtaaatgatgagttgatattcatacaaagcgtaaccttaattacaatattatgagcaattaaacccagtgttcacggaattattgtacatttatgtgtaacagaataaaaacattgcataggactgttaagctttttgtatgaatctaattaactttgacaggctttgagcttttctccttctttcagaagtgctgtagataaatgtacttgcatctggaaaacttcaaacagttttgatcagcatttcagatctgatttaaaatgaatgcattgaaacgctgtcttaaatacagagttgatagatgtgtggtgcacagtttcttgtagcaggaaggcagatgtggtagggagaacagctgtagactacagcagccagtggatattgtttttcgtcacaatctaatgtcaggcagctactgctgtgaacaggtctttatatatttggctctggttaatgctgcggatgtgaaaagctgaactcacactgattccttggaaggcaattaggagggagatatgtcttcttatgcttccatttctgtagcccttagggaacagagcaccatgagcaaaccaaggttcccaaggagtcccagtgactttttaagtttcataagtgaggaatagagtcctccttcaaacagtgaattatgacattgaggattttggagttactcttcttgattccctaaaatccaactattgattaggcttgagaggaagctaggaatttcatcatctaatttgcatggctcgatggtaacgacaaccaccaccactatcacaataatggttatattttactcagcaccaacaattttggtgattggcatacattattttatttaatctttaccccaactctatgaagtagacaccatcttcaatttattgatgaagaaactgagacttggagcatttattgtcatttttgaagtcacgtaactagaaagtgttagtgctattaaaacataagatagaaattgagtattaatgagataaaaattcattttaaaaatataataaaacaatatatataatatgggcctatttatgtaacaaacacaagagtatggtaatacatatataaatatatttgcactgatataaatgcagataaagagaagcagagttgagtacactagatggctgacagtggttattttgagatggttgagcagaaggaaggacaaagtagaaagatttttcaagttttgttcaataacttcttacgttgtttaaatctttaattcatgtgttgtttcagtaattacaattttaaagatcacaaaagtacttttgctgctaaagtaaacatctgaaaataaatcttcatcatagaaagtggtggtaggtttgatttcaactaggactctctgactataacatctgtgctttttccatgaagttatgtgtcctttaaaagtgtgtattaatgtttaaaaatctgatgtaaaaaggtagtgaatttcctagccttctcgttgtccttagaaaaccttgcttatactggctgggtgcagtggctcccagcattttgggaggccgaggtgggtggatcatttgaggtcaggagttcgagacaagcctgaccaacatggagaaaccccgtctctactaaaaatacaaaattagctgggcattgtggcccatgcctgtaatcccagctacttgggaggctgaagcaggagaatcgcttgaacccgggaggcagaggttgcagtgagccgagatcgagccattgcactccagcctaggcaacaagagcaaaactccatctcaaaaaaaaaaaaaaaaaaagaaaaagaaaaaaaagaaaaccttgcttatacttagatcacttggggatacatcagaattccattcttaatttaaaataaccaatatatttcaaatacctatgatgtaccagttgcactgtgaagccctgaggaggttgcagagatggaaaggacactggctctccccctaaggtgttatcagcatcgtgaacagacagactggtgcccacagagctgacacacaacgtggcaacagtggaagaaacaacatgccatgtagctttacagaggatacaagtatttctaaggttagggttcacataacaatttattcagtacctatgtggatgtttaggagccggacataatggaagatactaagatgtggcttctgtcctcaaagaccttgtattggtacagaaaagggagcattataacacaggaaaataagagagcaagaaaagccaggaatagcatataattgattgctaagtgatatagattaggccctaaatgaaatgggaattcagaaaaaattgtgatcactgtgggtaagaattgtagatttcataaagaaataaattatagtaccactatttttttttggcttaaaagaagggtggccaggaatcctttttttgtactttgaaattggcctttgagtagagtctctcattatctctgacagttgttagaaaaaggaacagaataacaattaaatccatccacagctgatgcatttatttgatatatatgtatatatatgtttgtgaatatatatatttgtgtgtgtgtgtgcgtatgtgtattggaagactaggcatgatagattatttttctctctctctcgttcccttcttcccttcctctcttttttccttccttttattaattatttctgctagtattactcagacatatgacatagaatcaggcatgcttgaaatatgcaagattttctgtctaaaaaaatagaatagaagcatagaggagctagctgtttagggagtttccctttaagaggcattatacctgagttctggacccttctaaatacgttaaaccataatcatatatctaaagtaccaaacacagtgctagcacatagtagatgctttgtaagcattacttctcttctctgccttcttcacaaaactttagtatccaatctaagagagaaaaagccacataggaggggggtgtgcaaaaataaaaaagactgagggttgcatatttggaagaaatttgattttcaacagccaattcttgaaaatgtctcaagattacagtgactgggtcagctattatggagcaactctgaacttggagagaagacaatatgagtatactaagaaatacataagcatctagggcaaatcacatatgctgttaagtatgtgggattttaaaaaatatgtatttctatgatatcagcttccttccactttttgtttttaataactttaaaccagataaaaatcttcacagccattcagactcagactaacttaactgaagactaaacttgagattcagccccaccgaattatgcatttttttaaaatgataattttcccaattatgtaagtatgcaaactcaccatggaaaatttgtaaaataaatgaaggaggtataaaacaaacaagcaaagatttgaaatcctgcatgcagaagaaaacttgatagcatttggttccaagttctcttggtgttttttttaatgcttatttattttgtaggtattacatatttgcttatgaccatattttgtcaatttaaaagttgcatattttgcagcgtgacccagtttgcaatcattgttcccttttacaatattggaggtggccctggggaaaaggcctgtctttgaacttgattgaacacgctgtctggggcctctctctttcttcattgtcatccccagagtgtggaagcctggagattagctggggagggcttctgctctgtgcctgggggagaagattgtgggggcatttgctcctctgaaaagagaacaagatagctggctgatacagaggatcttggatggctgactggatggggtcagaaataggaaacaaattgagttaatcagcatgtgtcttgagattcacgctccagcacagcagcaggttaggatctgatatgatgtgaaggtggtggaccgctaggccaggaacagaggcagggagagagaaaaaataccaagaacatctgtagatagagcattaaaccttcaacagtgtttctttcttcctgaaacttggtgggtattaaaaggactgaatgcatttatttatgcttgtccttggtgcccccaagcatctaggtatgaagggttagtagggtggcagcatgtttggaaagggagacaagatgtttatcctagaacttctttggtctgcttatgtttatttggggtagttttggagagtctggtggaaattgtagggggtaggattaaagtcttccttccccagtgacccctgatacttttactgattatttctttggagcctatgaaccactcttagttcagtagaactcttggagccctgtttcagtgatggttcttatcatgtgaactgactagggatgccatgcagtgtccctaagccatggtggcccaggaaagccatgtccttctatgttggataagtaaccacaatactcctttattcagtgtatgtttattaagtaccaagcatgtattagatactgtgcagaatactgtggattaaagactaatagaaatggcctttgtccccaggaaacacaatgtatggaaaggtagatttataaagagattattaatattaagtcttggaggtggaagtagggtcatgctgtttgtccagtcatgggaattaaataatgggtaggttctaatgaatgattgtccaatgattacatattatgtttacctacttaatatcatctttaatcaaaagcagaattttgtatgtaacttctattatgcaaagtttctcatgctagtatttctcataatattatttgtgtgttgaaatctgagcaacatgacttttctttcttgctgtttttacaatgagctttcattggaatagtccttttgacattattgtttttccttaattcaatattttatctcatttataatctagtaaaccgggaacttgacttaaaaagtttctgattttacaaatattagccagatgcggtgggatgcacctgtaatcccagctagttgggaggctgaggcatgagaatcgcttgaacctgggaggcggaggttgcagtgagccaagatcgcgccactacactccagcctgggcaacagaatgagactccgtctcaaaaaaaaaaaaaagtttctgattgtattatttatctaatgttctttagaggcaggtttcaggaatgtagcaacagtctctgagactctgagttgggtagactcattgagtaaaggttgttcaactttggtagaaggtgggtatgggtattggtagatttgtcaagctcctcagattatcagatacttatcagtttgagaatcattaggaacattgagctatgattatagactttctctgtgtcagttacaataaataggtaattcacaaattgcaaatttaacaacagtgagtctgccactgtagacaaaattgggtctggcttttgttgatctttttagagtgaaataaaattcttatatttatagaaatcagctaattctcttgattcctctctctcctctgtttctgcttgccttcttccccttctctctgttctgcttaatgtcgcttctctttcacctctaccctctccctctccccaacccctttacatgttgtgatcacacaggtaagatgatgtggtggtcaggggcagatttatgatcacagtgggaggatgtgtgtgcttctgacctggcttatcttcagtagatctctagggtgtagttctcaaactgtagcatgtattagaatcacttggagggccagttaaacccagattgctggattacatctctagtttccgattcagtacatgaaggtggggccccaaatttgcatttctaacaagttctcaggtgttgctgatgctgctagtccaggaaccacactttgagaaccactgatctaggagattcccttactatgtaaaaactattattactttttgaaaaagtaaatttggaaaaaaaatattggaggatgaattctcatttgaaatagaggaaaattttaaaatatgctctgtttttaagtgttttcttggagggatacaatagctttcctaataacttatttgaatagtttctcaatggataaaacatctattatatagcctttatctgaaatttaccttatctttgtcctacactttttgaccttggaaaggtgatgtcacgtggtaactgaagacaattatcagtcttctctatttccttccactccatatccccagtctaagagtatattactttaatacctcagtactgacattaatttaattttgataaatgaaaagatgctgaatgttgaggccaattatctttgatgaaagaaggctgaactgttttcatctgtacaaggaagattttacagaagacatccaagttcctggaaagaagtttatctgacccagacattaaaacattaaaggcagggtgactttagcatgcctttttaaaataagactttatgtcagagatttatttgggtacactttggtgccaattatgtccaattagtaaattaatggatcatgtgacacctagtctatagttgtacaattttttcttggacattaagggttaattccagcacagtgtttttttttttttaacttttgaatttttttggatttacttcttaattgaagttgttttatttcttaataaaagtacaacgtgttttgaaatatgtatacattgtggaatgttggtaaactgggctaatcgaggtatatgttaccttaaagacttttcattttttgggtgtggtgagaacacttaaaatctaccataatattttttaagaatataatacactgttttttactatagttaccttgttgtacaatagatctcttgaacttattcctcctatctaaataaaattttgtatcctttgaccaacatcttccgatccccacccccaatcctttaacccctggtaaccatcattctcctctctactatgagttcaattgtttacattccacatgtaaatgaaatcatgcagcatttgtctttctgtgcctggcttatttcacttatttccaggtttatctatgttgtcacaggtgacaggattttcttcttttttaaggctaagtaatatttagtaatatttcattgtgtatatatactagattttctttatccatttatccactgatggacatataggttgattccatatcttggctattatgaataatgctgcaataaacatggatgtataaatattttttgaaatcctacttttagtcttttgtttttttttttaagttttttttttcttttattattatactttaagttttagggtacatgtgcacattatgcaggttagttacatatgtatacatgtgccatgctggtgcgctgcacccactaacttgtcatctagcattaggtatatctcccaatgctatccctccctcctccccccaccccacaacagtccccagaatgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatattattccatggtgtatctgtgccacattttcttaatccagtctatcattgttggacatttgggttggttcgaagtctttgctatgaaatcctacttttagtacttttggatatacatccagaagtgaaattgcggcttatatgttgattttatatttaactttttgaggaacctctagactttttccatataggctatactaaattacattgctagcaacagtgtgcaagagtaccttttctccacatcctctccaacactttaaaaacctttcatcttcttgatagtagccattctaataggaatgaggtgctatctcattgtggctttaatttgcatttctctcatgattagtgatattgacaattttttcatgtacctgttagccatttatatgtcttcttttgagaagtgtttattcagatcacttgcccatttttaaactgatttgttttctactgttgagttgttagagttcctcatgttttggatattaaccccttatcacgtgcggtttgcaaatattttctcccatcctgtaggttttcttttcggtctgttgattgtttctttagttgtccagaaactttttagtttgatgtaatttcatttatctatgcttggcttttgttgcctgggcttttgggttcatccaagaaatcattgcctagatcaatgtcacggagcttttcccttatgttttcttatagtagttttacggtttcagattttacatttgagtattaaagtttttgagttaatttttgtttcttgtctgatataagagtctaatttgagtcttaaagtttttgagttaatttttgtttctggtctgttataagagtctaattttattcttctacatgtggatatccagcttttccaacaccatttatcaaagagacagtcttttcctcattatgtgttcttggcatctttgtcaaaaataaattgactgtaaatgcttggatttatctctgggttctctgttttgttcattggtctatgtatctgtttttagtctagtagcatcatgttttaattattatagctttgaagtatgtcttgaagtcaggtagtgtgatgcttctggctttgttctttttgctcaagattgctttggctattcagggtcttttgtggttccatagaaattttgcaattttttttctgtttctgtgaaacatgttattggaattttgatagggattgcatcaaatgtgcagattgctttggatagtatggttgttttgacaatactaactcttcctatccatgagcacattatatctttctacttatttgtgtcttcctcatttttttcatcaatgttttatggttttcagtgtacaggactttcatctctggggtaaagtaaatcctagttttatggagcccaagtcttataaaatctgatagggggagacctcttaaatagtaaaatatatcttatattttcaaattttacaaaacttatgttaatatgaaaataatatttccttgtattctaggcccctaatataattgcttatacattgtagatgtctcagaaagaattgtgaattaattaataagttcttcatcaaagtatcttcaaagcagtgtgatttccattatttttcttttcctttcttttgtttcttacaaaactgccacctgggctggagtacagtggcacaattttggctcactgcagcctcaatctcctgggctcgagcaatggctgggactacaggtggactctaccaggcccagctaatttttaatttcttgtagagatagagtttccctatgttgcccaggctgccctcaaactcctggcctcaagtgatcttctcactttggcctcccaatatgctgagattatgggtgtgagccaccatgcctggctgatttccattgtttctgagctacttggtgtcattatctatgacttgatattgaacatacattagcactataaaaacacagaaaccaaatcaaccagtgttttccgttgtaaaacaataacatattcataagagacttcctatgataagctaaagagatgaacagtaaagacaaaatgatgatgaatggcttaggccaaatagatgttagccagacagatctgacaaatggcacacaaggctgcttaggttagaattctgtaaaaaccgttattctatcttctaatttttagaggatagagggctggaaggttttgaatggtggataatttctggtagtgaagtcctcaaatcagaaagatattatggagctttgggaggtcaggtgatggtggactaagaagcaggagaaccatctgctgcagtctgatcctggagcatggtctgagtggtcagagttatttgtctcctttgctctcgagtatatgtgggcaggggaagactcacaagtgtttctgctttgagatggcaataaaaagcaagtgaagaataaatagttgctgctacctcttgattaagatcagtgcagtgccttaggtcttctcagagatcctgaaagaaaatataataaaagagataattaaggaggtgggcaaagcaatttaaagatattcacaaacactaaaaatgtttttcttatggtttgatttggaattgtgaggtgatcatttaaaagaaaagaggggtacggtattagcccattgtatccttgatcaatatagaccacccattccttttagtttctgcatcatagctaatagattgcccagggaaaacaaagtatcatttataattgttatttgaatattttatgtaaaacctaatctgaagacttagagaaatcattgtagattaagataagaaataaagatttgcatttatgagaaattaatgatagttctgaaattgaagaaccatttagttctgggagaaataaatacaaattataacatctagctgatggaattttgtttagattgcttctggtgataaaccatctataataatataaatcaagccctggtgtttgccataaatttgcaatgtttagcataatttttgtttgcatttcatactaaagtgacaccaagaaatatgagattaatagttattaagtgaaaatgactttcatgtctgtagtcatttttagaaacagttatgtgtaattcatttagggaccagaaaaaattaatttgcagttgtggtgggatctagcacattagaacaaagagggaagtcgcatataggaataaacttttgaaacataagggtggattcatttttaaccctgaattttgatttaatacctcaaggtacccttcagatcatcacacttttgtttgttgactgtagaatactaatagcttaaggaacagagaagttgttacctgttctcaaattatgtcataatcctggagagtagaagcttatccatacctgaggggacagagggtcagatagctgccactgcagtatagtgtcttttattaattttaattagtgttttcattaggaagtgtcatattagtttctgatttctaaaaaggacacattatttactttcatttgtttcactgcactataaatccgcagtggtgtagaagttaaattctatagaatttttgttttgttttttttttgtttttttttttagaaacctagcctcagaccttatgagtttaaaaaatatagttaatatttcctaagcatttattaagtgctagctgtgtgctaaatgctttatatatgttcagttatttgtgttatgttcattactagagcccttttcaggcaaagtcatacattcatttattcaggtgttatttactgaataccctctctgtgctagatgtgggaagcattaatgttttagaggaggttggaggaaaaagatgatatttaagagtttataaaaaggacatcaggacttttggtcaatatgatattgtaagttcatattttgaggctttactgctcaaaatacctattaaagacggataaagtatttttaaaacataataaaaccacattattgtgtgaaaatttaaaattagacctttagttgaaccgaaaatattcagaaatgccaagcagtggtgagttgggatgtgtgtgggcttgctaagtgctgggtctggaagcagaggaggctttgatttaaatggtgaggcttgacgtgttggagaagcataatagtgccttaaaaccaaactcatggctggttacagtagctcatgcctgtaatcccagcactttgggaggctgacacaggtggattgattaagcccagaagtctgagatcggcctgggcaacatggcaaaaccctacctctacaaaaaatacaaaaattagccgggtgtggtggtgtgcacctgtagtcccagctacatgggaagctgaggtgggaggatctcttgagcctggcttgttgaggctggtgtgaaccgtgatcataccactgcactccagcctgggagcgctgacagcatgagaccctgtctcaaaaacaaacatgcaaacaaacaaaaaaacccaaactcacaccatgaaactagaaactgtcccttcctacccatctcagcttcccttcaactggtgcttgggacactgaattccaggaagctgacacctggttctggattgggcactccacacgccaagtggagggaactatacgtcaactagtgatactggcttagaagaagtctcattgtgctgggatataacatggaactgtttattttttttcttccatccttacaacatatcactaatagattccaaagtttttcagtcacataaacttactaacttattttagcatagtttaaaacttatattttcaaaatctggctttttttttctgccatcacacactagaactagagccctggtagctggaaggaatcagtaagactgagggcacaggctggttgtggtctggttccaagatgccccctttttctcttatttcctctaacagccctagctgcttctgggttgagataggtagggaagaaggtgaaggacactaattttgttagtgatggaaatggtgcctgatgttgcttggattcggtctggttttgtctgaagttgttgccctttatcttaggtgctgtgccaggtttcttggggtaagtatttgcctcaactcagtctgtctctgaggatcatcacagagaggggaagtccactctccatttgactcctgccagtggtccacatgcctaacacttctttggttggatctgtgattgcttgatctagcagccctgtggctcaaggtcaacatatttattccctctcctcctttcccaagtcttttattttaaagggagaaagaattaaggagaaatggatgttgatagtagtaaggctggttttccagtatttaaaaacatcatgtggggagatgtcttacagctttttttggtgactctctttggagtgtttagtgcctttactttttatttctagtctctagacacaattcaaagtcaattggccaggcacagtggctttggcagggcgtggtggctcacgcctgtaatatcagcactttgagaggctgaggtgggtggatcacctgaggtcaggagttcaagaccagcctggccaatgtggtgaaaccctgtctctactgaaaatacaaaaattagctgggcatgatggcacatgcctgtaatcccagctactcaggaggctgagccatgatcactgcttgaatccaggaggcagaggttgcagtgagccgagactgtgtcactgcactctagcctgggcaacagagtgagactctgcatcaaaaacaacaacaacaacaacaaaacaacagcaaaaaaaccggccaggcatggtggctcacgactgtaatcccagcactttgagagactgaggcaggcaaatcacctgagatcagcagttcaagaccaggctggccaacgtggtgaaccttgtttctactaaaaataaaaattagccaggtgtggtggtgcacacctgtaattcccggctacttgctacttgggaggctgaggtgggagaatcacttgaacccaggggataaaggttgcagtgagccgagattgtgccactacactccatcctgggtgacagagctagactctgtctcaaaacaaaaaacaaaaaacaaaaaaaccccaaaaaacaaaaacataaaacaaacaaacaaaaaagcacacacacaaacaaacaagaaaaacaaagtcaacaagaaaatatctcctgaaaatcccgttacactagatagataaggagagaaagagtgaggaactttccaatcaagatagggcctgccaaccaaaattcaaaacaaataaaactaattccaaggaaggcagttatcaaaatcatagatcagactatcaattccagcagaaataaaaatatttaaaattattaaaaaatcaaacaaatgttaaatcctgaaagaaataaatgaaaggacacacacacacacacacacacacacacacacacatatatatataaataaaataaaatatgagatgtgtgcattgtaagaaagatgaacagggaatttggcaagatagattgatgatttaattattgactgttaaaaagtctcagtgtgtcatttggtagatgaaacatgctatatatttttttttcttgttcaaaggaataaacctaatgaatactctgttttaacacaactgtctgacatatactgggtatactgcaattcaaatctgacacaaactaccctggcattagcacagatctaatagattaaaggcacagtcctccaccagactgttcccacttcaggtgacgactgcaagtctcagggggagcccaggctacccatgcttctgactaactgtaaataaatttggtgcttttcatgaccttctcaagcttgaaaattctaataatttgccattatcaatattttattattacttgttattactcacagaattaagaaatgcattatatttgggattatagttttattgtaaaggatacacatactgatgaacagccaaatgaaaagatgtgcagggcaaggtctgagtggaagacagagcttctgtgtcctctccttgtggagtcaggacatgtcatcctcccagcacatcagtgtgtttactaaccagcaagctccgctgagcctcagtgtccagagtttttactggggtttcattacataggcaagattggttgaatcactggccacatgattgaacacaatctctagttcctttaccctccctggaggtcaggtagtaaagttctaacctgctaatcatatggttggtctttcgggtgaatggctcccatcatcaggctatccagggaccacagggatatgtcattagcgtaacaaacaattagttaccacattagcatatcactcaggatatttcaagggttttaggagccccatgccaggaacatgggacaaagaccaagtttttcattatatcacaatgaataactttctattccatcaaaaaaatagcatgtatttaggtataaaatacaaaaaagtaaaatattagaaatataatttagaactcgtccaaataacttctggaaaatggaatatagaaaatattttccatcaagtagacataagaaagaagaaaaaatacaaactgctagtaaacagaaactacaaaatgagatgatgaaataggtacagttatacttgtaatgaaaatgtgtgcaactctgtttacctattaaaagatggaagttaacaaattagatttttaaaaaatgcaactattgactcaaaaaactagcaagatttaaggtaacaggaccaaatataactaagaaattctaaccaaatgaaagaggatataaaaatgttaatatcagacaaatagattttatgataaaacagtacaaagtatgttataatgcgttagcagaaacattacataatgataaaagagcaattcaccaagtatatacaataatcatcaacttgtaaatccttaacaaaattgcctcaaaatatgtaaagaattaagttgccagaattgtaatgagtaaagtccaaaaataattagtgggaaatttcaaaatatatattccaaaatttttccaatgtatgtataccgatatatatgttccagcatttatcaggatccaaaacaaggcagagaaaaacatttggtaagtataaagacttatcaacaaaatgtacaagcttgaatatgtgtatgtatgtgtacacacaagttcacatatccatgttcctattaaagagtacatattaagtacacatgtatacaaaagttttaaacacacaactacatgatttttctgtatattgagtgatagattttttttattttaattgattttgaagaatcaatattatccagataatagtctttgacatctgtgttacctaattagaaatcagtaatacccagtttttcttttaacttttattttaagttcaggggtatatatgcttgtttgttatacaggtaaacttgtgtcatagggttttgttgtacacattatttcatcacacatatttagcctagtacctattagttatttttcctgttcctctccatccttcccagcctccaccctccgattcccagggatccccagtgtgtgtttttccctgctatgtgtccatgtgttctcatcatttagctcccattcgtatgtgagaacatatggtatttggttttctgttcctgcattagtttgctaaggataacggcctccagcttcagccatgttcctgcaaaggacatgatctcattctttttttatggctgcatagtattccatgatgtatatgtaccatattttctttattcagtctatcattgatgggcatttaggtcgatgccatgtctttgctattgtgaatagtgttgcaatgaacatacacatgcatgtgtctttataatagaatgatttgtattcctttgggtatatacccagtaatggaattgctgggtcaaattgtatttctgtttttaggtctttgaggaatcaccacactgtattccacaatggatgaactaattaaactcccagcaacagaatataagcattcctttttctctgcaactttgccagcctctgttttttactttttactagtagccattttaactggtatgagataataacctggttcttctctgtgttggagggaaaactttccctgtatcaacttaggtctgaatagttgggggcctttgaattaattgacaacaaacaaattaataggagaaaagtttaactcatgcatgcaatggtggcctatagggaataggtcatggaacagctaggggtgagggtttatatcccctcataataagagaggcatttaggacttcaaaggataggagattccgatgagggatgttaacacgaattctttctgaaatatcctggtgcccaaggtttgttccctccctgactgcagtcttttgggagtcaggaaggggagtaaggggatggtggtattgtggcagctgagtcttgtaaagctttgctgcagttggtatcaaagagagagagggagagtataatatatccatttccagatcctggctataggagacgtgtccagaaatgagtactctaaaagtctctgtggcttcctatgcactaagaataagataaaaactccttggcctggaaggcccttcctatcacaccaagcatctcatcattccagccactttgtccttccttcagatctgcaggaggccaagcttttttccctttttagaacctctgctcattctattccttctgtctgagtagcatccctggctcttccatggttgccttcttttcatccttcgggtcacagtgtcacctcttcactggagactttcctaattaatgaatctacgtaagcttctcttatctctattctagcaccttaattgcttccatcttagcatgccacattttatatctatttaggtgtttttttattttctctctcttctatttagattgtcaaatcaaagagaatatggattttctttttttctccttttttcttaattatactttaaattctggggtacatgtgcagaacatgcagttttgttgcatagatatacacgtgccatggtggtttgctgcacccatcaacccatcacctacattaggtatttctcctaatgctattcctcccccagccccacactccccgacaggccgcagtgtgtgatgcttgcctccctgtgtccatgtgttctcattgttcatctcccacttatgagtgagaacatgcagtgtttgattttctgttcttgtgttagttctttcatttgtaccacccgcagctgaaaccgtcagtgctgcacccaggtgccctctcctttactgctgcacacctgacaggcttccagctcccagcattgcatttctttgcttgaggacttactttggtttctggaagctgactctctctgctgtgctttgggcctgaaatactagggaggaagtagcttttaaccaatcactgacagaaattaatgtgtaaatgcccaggttccctcaccctccaacatctccaatgttggctggcttgataatgcatcttttatttgctaattctccttctttgtctaatttcatcactctctgaccagtgttttctgtacctcctaagtaaacaatgtatactcaaatcacatgtggggaaagcttctggcacaatgctttacacacataggcatacagtaagtatttgttggatggatagatggatgggtaggggtggatggatggatggatggatggttggatagatgaagattgcaatgtggagttcaaggttggatatggtgtaagaattcaaatgattgacaaaacaaaaaacaaacaacaacaacaacaaaaaacccaaagatgctgttagctctttctaattaatgctgttgcctcacaaaaaaatatagcacattgaaggtgtaggtatatcagtttacagataatctaatatggaaattttaaaagctatggttttctttaggaccattgtacaatgcttgatgattttatggatgcctgtcttatgagcagtttttacattccttgttttattacagtactgtatttacctaaagtattaaaatgtgctatgcaaactcataaataaagttcaacttgaacttcacttaatttaggtgaggttaatggtccaaacaatcagctttcagaaatatatctagaagtgagaattaggttgtgaaatcagatggtgagatttagaggcacagaaaacagtgttaacaaaaagggaatgcagtcacagagtgtgatgtaaaagatatgtagtgtgaaaagtactaagacgtttatcggtattattattgtgtcactggacaagttcacagagctattttggggatgactagagcttctgaatcagagctcatttctgttttcagaagattatgaatatggagactatgccagactgtgagcttcttgaaggcaggaacatcaaagtctgcatcatcttttatattcctagcagggtccgtgcatggcacgtaagtgatcttgaatgcaggaaaagcatgagtggttggcccaactggctattacaattagtgttgttttcacatgtaaaacaattcatatgaactagtaaatcattcatcactaagtaaagcattcctcaaatcacaaaagattattaaaaaaattgaattctggcattccaggctattagtgttagccttactcactgaaaaattaaagatagtgggtctaaattcctgtaaatctgtacaagctttctgtaaggaaatattaatataatgatggtggtggaaaaatacttgtgtttaaacaagaattactcgagaaacccaattaaacatgcagattgaaaatattgttcagaattaatttccagaaaaaatttaacttctcttgatgaactggcttgctttttcttcatgagtactgagaatcctgcaatttttttttcttttaaaattttggctaccaaagcactcagaacttaatttacaactcaatttttctaactttttgggaatttatgatgtttatatctatcttctaaatttcttctggtctttaaaatttattctgatttttctttttcctggtcctggtgttgtttttgtattgcttgtatttttctttcttactttatgtatttttcatgacatgtcaagctttttgtggaaaatggagaaatcaatgctccatatgtaaacgtatatattttgattagattgctattcttcttttattcaaggccaagtgtttgtgaagaacagcaagtgactgtggttggacttgcacacccatgtgtttgggcattcacacacattgtcaagctctgcaaacaaggctgtactggctcaagttggtatgtgagctatgaaagaaggtaagagtgcttctgtactctttgattattgaaaatcaacaccaaacacctcaaatgcacctacatattcatccaataaattttatgctcattaagtaaatgtgcataagatgtggccaccaagaacatttagagttatatatttttcttcagagacaagatatattattactttagacctcatttatgtctgaggtattttgggttagatgccactaattttacctcatggcatggtgtaccattgaaagctaaagatcagaaaactgacagaaacaaggaatattgtgttggtttgctaaatttagcacgacttggatccaggggatctacagttgtgaaccaatgtctgacctgcccttggtactcttgtaacactttgaaacctagagcttctttaacttttttatggcctttgaattaggattaactcggcgggctagaagaggagagaaaaagcaagtgtccacaatgctttctaggcgtcaaggcttcatgcagacttttttttcccttcaaagttttgaaatagttttacaaaatatctaagaacctcttaacacaaatagttgatgatgggttaaggatcaaaattcaggatacttaatgttaaaaaaaggtgtggtttcagattgacaaagaatttataattactactattattgctaacacaaagttggggacatttataaataactgggtttgccattgtataaaaatattggatcactaataatataggactaaataaaatataagactaaataatttataattgtggatgtttacatatgcattgtgtgtgtgtgggggggtgtatgttgaacctttagatgaatagtttttgtttttcgtctaaactcaggaattttgtggggtatttttagagatagggccttgctctgttacccaggctggagtatggtgccataatcatagctcactgcagtctcaaacacctgggctcaagtgatccttccacctcagcttcctgagtagccgggactaaaggtgtgtgccactgtgcgcagttaattttttaatttttatttttgtagagacaggggtcttgctatattgtccaggctcatttcgaactcctggcttcagatgatcctcccagcctttgctggggttataggtatgagcaactacactaggccaactcagaacttttaatggtgtttaaatcagaaaatttcccctggctcttcacagctgtgtggccttaggctaagttcctacatttctctgtgtcttagttgtagtgttaaaaaaaatgctgtacatggctattatgaagattaattgattaaatcttcatagataagatttaacacgtggcacaatgcttggtacacagtaggtactcaatatgtgttagatagtataatgctgtagcagaaaaatttattttcaaagaaattagaatggaaatcctatttatagggtatatgacgtgttcattagagtacttgttttgaaaatggctttttatttagactttttgtactcccccccatgagttttaatctttgttggtaatggaccgaatcaaataaaattcattaccttatagatacttgggaaaacaaatataaattagtaaaacaggttttatagttttattcttaagagattagtagttttgcacattctgtgtatgatactgagtttggagtagaggcagtgtttgaagatgttcagcatctttgccatgctcatatctgttttgtttgcatgtaagtatacaaacttatacttaagtcctgattgaagagacgcgtgaacaaaatattaggttacaattctagatggtgaataattgtcataaaaatggtacagccagtgagtccaatttttgagaaaagagaaagagcaatctacattggcttggtaggaaaagagaagttagaggaagtggaacttgaaattgaccttgaataatgaaagcaatttggactagaaatataggggtggcatatgaaagggagagaatatgttagtacttttggaataaaaaaaaatttaaaaatgacatcaacttgacagaaaggaaatcagcctgtctggagatatttggtattatgatctgctgataggtcagcaaaaataactcagtgttttcaaactttggtttagtattcccccctaaagagcctttttaaacaatttttttccctgaagcttccttctgcaccatgaaattttaacattacacatattctttatatccatttatgtactgtgttcctttgtaaggtcacacaccattgtatcaactaagattcttttcatcccccactcataacaataactaattgtcaccttcttgtgggtgatattaatacggttgagagtgcatgccgtagtggagccaacctatgaggagctttcaatatcaaattgaaaagcatgtacctcattatctttcaagatttcattattcttatcataattttgggttttattcttgatagcttgagcaatccttaggatattttataccatgggatatgggggtccctcttggttttcattaacctatacctataatgaatctgaattgcatatggagtgaggtatgtatgtgtgtgtgtgtgtataatatgtacaaattatacactatatgcacattggtacatttatctatatatacacatacacctatctctctgtctataaacacaaatatatatggcaggatttgaattggagagagaaatttctaatggatttgagatagctctgccttaagagggagcactatatctccctaatttagatccctgtatttgttaggcccggtactacaccatctatggacaggtgtacaacatggagcagcagcctgtctactggtgctgccctgtttggaaccagtgggatgatgaactgggatgcctacactgtaaattataattcttcttgtctaactctgttacgagaaggaatgatttcactttgtttttgacttcaatcatacttgtcaagtttttccgcatctttagtatcactgcagattcagagcatctctttgaactgaaaattcacacatgatgtgcaaaaatgcacaaaaaacttttctgttaagtgtttctaatgataggtcacaacgcaggacccatgaaagtgctgctttatattctctctttatttaaaagacagttgatttaaaaccagacagtttacaccttgacttccatctcctttttctgtttgcccctttcccatatcatcaaatttgtaatccacagttgattcaaaagtctggagggaaatcatcgtactaaatctaaatgggatttctcaacttacgcttgtcatgattaattgcagaacactggaggcagtttactttttaagatgaggtatgcaatcctttaacaaacctctggtgagagtatttcagaacctttggagtgtgtttgacagcactcaagtagcagaactagtggcattatatagtttattcacaccaggagaaatggttcagtttagcaaactcctttacctatattatgtatttatggttattgcaaagtcacttaaaatgcttcagtgtgttgcaatcaatgcagcaccacagcacaacaattcatctctcttgctattctgtaccttggggagtttgttggcgtcctgtttccttccccagtgtgctttctgcccttgaaacatcttagtgaagttatcacaggcttcccatgttaagcaggtttagtggtgaggggtgcaccaagggtcactgtgtatttgcatgcagtgctaggccacggccactgctttaagcttattgaaaacatctgttcacggtgttattagcttaaactggttaaacctcagtgaaaacatcttcccatgatgtcatcttaactatgttataaactcctggaaattaatgactatgagatgaattcttttttttttttttttttgagacggagtctcgctctgttgcccaggctggagtgcagtggcgcgatctcggctcactgcaagctccgcttcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccacctcggcctcccaaagtgctgggattacaggcgtgagccaccgcgcccggccgagatgaattctttatattgttgtatgacacctattagtccttattagcattttttgtttgatttttagattgttttgactacacattattatacatagaatttttttagaccaatatttctgaaatttgaatgtgaatacagatcatctggaatcttgttaaaatatggactccatattaggtctggggtgggcctgagttctgcatttttacaagcttggaggtgatacagttgcttccgcacagagttctgcaaggttttagacagtaaggccttaactcataatgaaaacattgtttaaccttgctgtggaagtgttggtggaaatttctagattggtgcctatagtgatgattttttttctttctctcaactctattctccccactcctcattcaaccttcttttagctatcgctgcagtgggaacttgtttcaatggaagaaaatgctcagatggtgaaggccagtagtgccagtgttcagagggatttcatggaccccactgtcaataacagtgagtcaccaacaagacaattttattatgatttggtgctgtttgctttgcttttaggggccagccaaatttgtcaattcagactaatggttaggtccttggcggggttggtgagcatttaaaattagccactgaggaaaacctctagcttatagtgtaatcaggcatcacaaaatatgctttgtagtttagttttaacgattcaccattagagttcaaaggggagcagtaagtacaaaacacttcattttgtaaaggaaatggaagcttaataataagtaaacctcattctgacctcagatgttagatccttcatggagccatagtttgaaattgctggtacggtttctctgagatctctgtggtatgtgaatgcacaaaatataattaacatgaagttgttgttaataaattcaatgaatttattaacaataaatttattagtaaatttataagtaaactaacttattagtagatttactacgttcatgccatttatttaaaaaacaaaaacaaaatacctgaaacttgcatgattatcaaagttccaatacttcataacctagttttcaaggttggaactttatcaactgtcaattgtggacaggtacatttaaggtgtttcttgtgcaggaagtttcccggatggccaataatttatcctttactgcatctgtcataagactgggtgatttcaaaaggctttgttttgacttactcatcagattctagtctccagagaatgagaatacatctgtatttatcttttcagagcaggaaaaacaaaataaaacctatcttatagaagttaaagaaatagatacgaaaagctaaccaaaatattgctttcattatcttctgctgacatgtttgctttctcgtatccattacttgaatctttgtaagtgaaattggaaggttgctgagagctcatcactcatgtccatttgtctcctctgcccttggcataaggttaagactcaggttttccatggtgacctcagagctattcttctaaattaatcctgataatctctttgggttgcttgctagtttttgctttttttttttaaacaaaattgtgaattaaaataaagctgatttttaacctcaatttattctttgactatggaatactgattctgaaagaggttagtggatgctttgagctctaaggtatactttccactattttcattatttttaagaagctaacaaaaatcatacattgatccatgttaacaaattgtttgcctttaaataaagtatttcaactacatgtgcaacactggttcccttatcttgatcaatagctgtaatgggcaattacacatatcactgattcattaggactttaaaaaattaattattactttataaattcatttgttttggtagagcacatcttgcaaaatatcaagtcctggaggggaaaggtaattaaagaggcatatggtaatgataaaggcctagaaattatacctggatttatttattctttatttcctacactagtagtcagatattttcattattccatttcttaacactttgtgtaccaaagtaattaaaatgttttttgaaattcaggtagctagtattcttatttttcagttttgggttggtgaaaatactagattattcgagacatattagtgtttcttttccccaagtttgtttgtataccctaaaattccggaagtcatgagagaagaccaatgatacaaaacacctttcaggactctgcattgcattttgcatattgttgttgcccaagtgtgtttacctttagattttggcaatatttcttcttttagtgtagctctcctattgaatttaaaaagaaatcgatgatatacaaaagaaattggtgatacattctgagggatatattacaacaataggaattcagacatttcctacatggtattgcatttcacctgtcaaaatgagatatcaaaaagtatgtaaatttcagaggtttttatgaatgaattttgaagacttcttaggaaatcattcaaacatttgggaaacaagtgaggaaccgagttaagaaatgacattagttgaatcttgaaagaaaattaaaaattaaaatcagcaaagactttaaaaaattattatagttgttagaatatgtagtctatcaaacaagttgattatagtctggtggtactgcctataacctagctcttatttcagtggctggatttgagttctgatatatgagtacataatcctcggtctggtctcgttctctctctctgtatatatatatatatatgtgtatgtctgtgtgtgtgtatgtgtatttatgtgtgtatatatatatacacacacacacatagtatatataatcacaatgagaataattttaattttgtgtttcaaatcatataaataataattgaggcaataaaaataatttaaatcaaacaattttaaattatgaaaaagcctattatatgcaataaaagacagtaaaaatgtacagtcctatcactttcagataactgtggtggtcatccttttatgcccatttatattcatacacacataaaatattacataaattagttcatatcctatatactgttttgtcatgaatgttcatgttttttttcttaccttcccttttcttcccttcttttcccctcaaacttctcctatgcccagtaaccaacctgttgaacactcttgtatctttctctgagcctatgtaatcatatacaaacagatgcacatttcatatcaatgtaccacagatttttgaccacctatttattgatggatatgtattttgttttcagttttttcgcacaataatcaatgttgcaataatgtggtgttttacattttgtgagacaaatttctagcagtgggattgttagtgtgaatgcatatgtgtatttttcattttaatatgctgcacttaagcatcaaaatattcctttaaattatttgtaagatgttttatggaccatggtaatggctttactagtttatttggttgggatggattaaaatctaggtaaatcccaattatttacttatttttaatatgctaatataatgaggaatcactgcatcttcatccaaatccagggatgtgtcacattaaattatctagggtcaggattattgtaaacatggattgctcttattattgggtaaacttgactttatttgagatacatagaaaaaagaagtctggaaaataaaccggatggccttttaaaaatggagaaaagactctagtcctagagagagaagggccatgctaataactgagataagtgcttgaagttaataatgattctaaaattgctgatctgcttaactcatttgaaaaatctgcctctaataaggaaaaatgaagaaaatgaatttggacaattaggaagtaatgaagagctttctaaaatagctattgattaaaggaatcaaaagaaatactttgaagatttgaacacatgcaaatcaggctagatggctggtggtgaaattttcttttttatttttacggatccaggcagaacaacgtggagcttcattaactggttaatatcacacacaaagtcacacctcttctcatcacttattcagttttccttttctctcttcagaagtcaagttaaataataatgtgcctggccaggcgtggtggctcacgcctgtaattccaacactttgggaggccgaggtgggtggatcacgaagtcaggagattgagaccaccctggcttacatggtgaaaccctgtctctagtaaaaatacaaaaaaattagctgggcgtggtggtgggcgcctgtagtcccagctacttgggaggctgaggcaggagaatggcgtgaacccaggaggcggagcttgcagtgaccagagattgcgccactgcactccagcttgggcaacagagcgattccgtctcaaaaaaaaaaaaacaatgtgcctaatggttggattctaagactctgaggtcttgtttctttttttcttttattctttattgtaattttttattcatctattcaatcttcctattagtcttccaattagttattaaatatttatataccaggctgtgtgctaggtacttcagagaccaaaacaaataaggtatccttaatgtagtgggaaatagagagcaggaaaccagtgattatgatatagcccacaaatagtatgatggagagagttcatctatgtcgtattgggaggtgatagaaggtttctcaaaagatttgaaaatacaaactacaagtaattcctaaacatgagcagaacaagaatatgaaattggtaagagagaatggtatattgcccagagacataaaatagctcatccagttcaaggaataataacaataatactggctgggtgcagtagctcacacctgtaatcccagcactttgggaggcagaggcgggcagatcatgaggtcaggagttcgagaccagcctgaccaatgtggtaaaaccccgtctttactaaaaatacaaaaattagccagacgcggtggcgggcgcctgtaatcccagctactaaggaggctgaggcaggagaatcacttggaactggaaggcaggggttgcagtgagccgaaatcgtgccactgcactccatcatgggtaacaagagcgaaactccgtctcaaaaaaaaaaaaaataacactaataatactagtagtagttctcttgactgcactaggagattcatgtggggcttgacaaaaaaaaaaaataataaaaatagaacttttttaaagtccaaggccagcaattccttagcctttcttggtccagccagaccagctatttcagaacattatgcagaggtgcctgagggattctgcaaggactttccttccctaagtccagttctctgaacaggaagtcctgcagttggagtatcttgagcattcaacagtgtatttgttcattctcatgctgctgtgaagaaatacccgaaaccgggtaatttaaaaagaaaagaggtttaattgactcacaactccgcatggctgggaggcttcaggaaacttacaatcatggcagaaggcacttcttcacagagcagcaggagagaaaatgagtgctgagtgaaggggaagccccttatggaaccatcagatcttctgagaactcactcactatcacgagaacaacatggcagaaaccgccccccatgattcaattatctccacctgatcctgcccttgacacatggggattattacaattcaaggtgagatttgggtgaggacatagagctaaaccacaccaaacagtactgtttggtactctactcttatgcctatggcagagtccccaaatgtctctgttacttcaaagcgtgatacttatgtacattaaaaatgggatattgctggaatgctgtctgatgacatgaaaagtcctcaggagttctggggttgagttcgggtctcaccaatgaccacctgcattatcttggagaagttattttatatccctagcttcagtatcatcatttataaaataatagctttaatttttctgagcactgactatgtaccagatactattttaaatgatttgcctgtaatacattattgttacagctagtttatgtgatgaatattcttacttgccccgcttttgtacccacccaaggcatgcaaattgttcacagtcaaacagctagaaagaaagggatctggatccatatcaatatattcgggccccagagcctgcaaagccatccatgatgactttataataatttctgacataatcttctgtcttccagatcgttatttatgagggttgtatgagataccacatgtgacttctaagctagaaagcattatctaagcattgcttcttgttcattgcaaattctctgagaatcacaaatgaagtacagaaagtaagagaagaaggaccccactgctgctttgtttcccactgtgtgggaaatctgaacaaaccttgagttttgggtcacaagtatgactttgagccaaccagtaggttctagtcaaggaatctagtaggctttctgcaggatccatctgttctgtgcagaaagaatgtttggtcaaaggatcttcttaaaatgacatgtctccaagagcactgttaatttgggatgtgttatgggttgagtcctgttcccccaaaattcatatgttgaagtcctaacccccagtacctcagaatgtgacctcatttggaaacagagttgtggaagatataattacttaagatgaggttgtactggagtagggtgggccctgaatccagtatgactggtctccttataaggagggaaaatttggatacagaggcatgccgacagcgagaatgccatgagaagatgaaggcacagatcaggatgatgcagccgcaaaccaaggaatgccaaagattgccatcaaaccaccagaagctaggtgataggaatggaaaattttccctcatagtgctcagaaaggaccaaccatgctgacaccttgattttagacttctagccttcagaactgtgagacagtatatttctgttgcttaacccactcgctttatggtaatttgttatggcaaacagatataggatgttgagaaaacatattctccttattcgcagcttcatttcagcagttggcctattgaaacaatgaaaatgggaagaaaatggcagggggtttataaagagcaaattatgctaagaaaacttgatggcttactttaattgaattataatattagtgtgagaaggagagttaatttagaaaaaatgcaaaaatcattaattgaacaagcttatgaatctgcaatcctaaatgagcgttactaggagatactatgaagtgaaatgcagcttttaacaggttgaacatttctttctttcttttttttttttgaggtggagtctcactctgttgcccaggctggagtacagtggtgcaatctcggctccctgcaacctccacctcccaggttcaagtgactctcctgcctcagcctcctgagtagctgggaatataggtgcgccaccacacctggccaatttttgcatttttagtagagactgggtttcaccatgttggccaggctggtctcgaactcctgacctcatgatccttccacttcggcctcccaaagtgctgggattacagaagtgagccaccgtgcccggcccaggttgaacatttctaattagaaaatctgaaatctctaatgccccaaaatctgaaactttttgagtactgacatgatgccacaagttacactgaacccattattttttcactttattaatgatatgttgtattttttactgttaagtacttatgtgtgaataatttaagaaaattacttatgggtagcgtataaattcagtcaggaatgatgatggtgccaaacaaccacagattgtccccaagagtggttgagatagtgacactttgctttgtgatagttcaatgtacacaaacttttttaatccaaaaagttattgaaaatcttatgtaaaattaccttcagattacatgtataaggtgtatataaaacataaatgaattttatgtttagacttgatatttcattatgtatgtataaatattcatccccatcccaagataattatgtatgtgtaaatattccaaaatcctagaaaatatatttcattatgtatatgtaaatgctctaaaatccccccaaaatctgaaattggaaacacttctgatcccaagcattttggataagggatactcaacctgtatcatctagatatattgatatatgttcttagcgtgagctgacagtgttaaatccagtgttactttgttcatcacataaggatgcattggattagagctcctatcagggttgtagcaagtctataataaggcaactatattctgctttatgtaacttgacagaaagtatggcagattgatgggaattggagcaaacataaaaaagggatggatagactgtttatgaggaagtggagtagtaactatctgacatcttcctgtgtgcccagtaaaggagcatcctgtcatttagaatctacgcagaagatttacttccctgacattgatttgaaaatagaagctttggaagtgtttttactaacacactcttttaggtatactttgcatggccagtgttagcaccatgagaagtagtttaaaaaagacttcatgagaattccctgatattgcaaatatgataactttagagaatgacctagcactatccagggtaatttgattctacacagtataatgggtggtgaactagaacatgtttaatgtggatgatagtgacactagtagctaactcataaatcatgctttctacatgctaagtactgtcctaagcgctttacacgttggcttatttaatatttagaacaacccataatgtaagtgctgttaatagtcttcttttacagatgacatgctgaggtgaagagaagttaagtaacttatctgagatcatacaggtggcaaatgatgaagccaaggtgtgaagtcaggcaatctggctcccaagttcatccttgcaaccactgtgcaatgctgtttcattaacatggaagaacgtgtttgttatgaaaaacaaaactgatatcatttctctgaaagggatataagagattttatactttatttttagtgtttgaacccagtcagtattcttaggaaacagtattcctgtagaaagtatgagctaaatgattatcttcatttaaacttttgctcattatacatacacatcattgagtgattatttaggacctgtgtaaggtgtacctaactccagtattgaaaagcctaaattcccgttatggggacaggaaaacaaattgtaaagtgatgaatggcatttcaggaatacattcagcttgacacaggaacgaggtcgtggtggggaacgggacttgccaagttgtggctcatatagctggatgttaatattatgacacacattattgccatgccaaatagtttggatctcaactccttgtatgtgtaatgccactgaagattttaagtatattttaaagatgtagctgtaatagaatagaaaggggatgaagtcccaaaggaaaagaaaatgttatataattcaaatggccaaatctagcatgtatagtagtcactccttattcaagggggatacattccaagaccctcagtgggtgcctgaaaccaccgatagtactgaaccctatatatatatatatatatatacacacacacacacacacacactatgttttttcctataaatgatgcatacctaggataaagtttaatttataaattaggtacagtaagagattaaaaataacatattaaaatacaacaattaatataccagaataaaagttatgtgattgtggtctctgtttctaaatatctctgaaagatatttgggattaaatattatactgcacttaccctttcacttcctgcgatgatgtaaaatgataaaatgcttatgtgctaagatgaagtgagatgaatgactgtggccttagcttttgcagttagaggtgcaagaacaaaactagcacaaatttcttcttccttcttcctagtttcacagaagattcattcttactgtagatcttagcaacctcggtatatgatttttctttctttccttaagtcaaaaaatctcaccttttacttagatgaagcactttatgatgtcacttcagcatatttaaattgccagcatcactactcttgcaccttggggacattattaagtaaaagaagggttacttgaacacaagcactgagataccatgacagaagatctgttaggagagatgcctattaagtgaccaatggacaggtagtaaatatcgtgtggatacactggatgattcctgtctcaagcagaatgaagaggactggcatgtgatttcatcatgctactcagaatgctgtgtaatttaaaatttataaattgtttatttttggaattttccatttaatattttcagacctcagttgactgcgggtaactgaaacctcagaaagtgcaatgttgttgcttgcagccaacagtttttcttttcttgcttgtttttttggtgttcaaaaatcaaacttctcctgttctatgaggtacaaaataagattttaaaataccctttttagtttgtcaactgcaaatttaaatctcattttctcttaaaggaacttgataaaaagtttgaaatgaaattctgagtaagaaaggtaatgtgcttttactgcagaagccaatattctgcacttgctatttcttgtaataatatatcttccttgccatttgaatttgaagtatatgatacctgtgtgcacttgtgtgcttgtgcaattttactcattcttatttatttctgggtattgtgcaccagaaatacactaacaatattaccaacaacaaagaccattgtgatttatcacttggtttggtaggggtaatttcacttattagttatttttgtaactaaattccttattttttcataaaagcctactaataatggttgtagctataatggaacattctactattctctattggagtttaggctagtcaatgttagaaactacgaacatgataatcaatcattaaaattcccttaagtgattagagtattttatgttgggtaaagaagatgaaacttgctcccaaagttctctgctctcaggtcagtctggtgagtctggcatttgaagggtagaggtagaagataggaggaagcagctgatgggcctgccaccaatgggttatttttcagataggagggtcctaggaacccagataacctggtcagacttttttgagggtaatttaataatacacttcctgagagaggcaaattagaagaacagagaagacaaagccaaaaattgaatcctacataagacaaagggaggagagtagtgacagtcaagagaatagagaaactcaaaagatattaaaggtacaaatgtagctgcacaggttaggatctcggtctcaacaggagctggacactctattggtcaagaacagtaaaaagttggatgtgcaggacatgatgcattattattatatatttttgaacatgaataatctgctctaatgtactatatttctcaaaatttattctctggatcgctgcttccgttgtattttaagaagtgttacatgaagtaaagtttttgtgttcaaataagtttggaaaatgctttgttaagtaacctaacatactattcattcttgtaaggactttccagagtctttaatatgctaatgtatatttttactcccatagaagggcatatagatttctgtgtattcaaacccatttgactctgtagcctttctaatggggatatcttgagtattattatttcatataggaccaacatgctctggagaatacacacacacacacacacacctatacatattatatgtaatatacacattatatatcatagctcttaaattattatatgcatatataattataaatttttttcaaaatgctcaactaatagtaacatatatgtatagtagttaaaaaaaaaacatttaacaaggtgctttcctgtatgttacctcatttaagctcacacccactctgtgagggagctcatattctcaaattagagatgaggtaacagagacccagaaagcttaattgatttggccaagtcacagcttgtgagtagctgagccaagacttcaactaagatctttaactctaatgatttatggttttgtcccacagctacctagggataaacagggcttgcaatgggcccttccttgcctttttaaaaaaattttattttatttaccatcctgtgcactgttctggctgagaaacagaggaagcagagtggagttggggatgcctttctcatctttctccatttgtgttctcatacagttttcataattcatatttttgttcttccttcccttcaccaataaaactttacttccatcacttttcccaataagcaacttcaaactaaagcattcatagatactactggttgaacatatttgcgttttaatgggggcctctgaaaacacaaaactttacctgcatggtgacagagctctggcagtcatcaggagggagatcctgctgggtaggggagctttaggaatctctctacatgtggtgtgcaggctgctgttcatgttgtttctatcttgaggctcagaactggctgtgtctgtcccctcccaggcaggtgctagaggttggtggcagtccattcctttgtaattgccagtcaacctgagagctcctgctgtatttgccccaaggacataatgccaaggtctggatctctgaccaagcatctttctgcatttcatactcatcatcactccttcctttgcccccacacatatcctcctataaactagctttcttaacatccgttttattaaataggtctcctttgaccttccaaattcctaaggccatagttacaatcataacaagtgtgtttaccattaagataagcatcctaaataaaagtcttaagagaaaatgaaggtgtgcagtagaatttaactttactccaaaatagttctctttgacctagattctaggaagtaatctctaagcctttggacatcatacctgataagagcatctttgtttgcctggagacattagatcaacagatattctaataatattatttgtggtgggggctcgacacacacttatagtcttatattgggtcttgctatgccagaaagaccaacactgtgattgagggtagggctttggctcatgccctgattgccagaaatggagactgaaataaaccacatcaatagtcaatcaatcatgcgtatgtaatggagcctcagcaaaaactcaacaatagagtttgggtaaagtttgctggttggcaatagtctatgcatactgtcacatattgttaccaaaaaagtaatgcattctgtctccatgggacagacggacaggatgatggaagttccacttttggtagttgctgtattctaccctatgcacttcttcccttggaggattttaatatgaccttttagtgagttctatgagtctgtctagcaaattattgaaattgagggctgttttgggaatgcccaatcttgcagttggtgtcagaagtgagggttgtctcttttgggaactcttccctctaatttctcagttgatccaaactctcacagaatgaaagtccctacacgtttttcttctccttcaagattaaagtgctttgagtctctgttttgtttccttgtgagtatggaacgcagagaaaattaagtagcactctgtggctgatcacctgttcaggatgatactagatgagggctttcctcattattggtgaagaacaacagtgtctggactgcctcaatagtttgaaagtaatggcttaacacacccatttattgaatccgatggcaaaccacagaagacaagcaaaaaacattgttattataatctgttattgctgaagaacactggagataggggggtgtgggggagtaggagaataaagcacatgagatctgaagttttaagatcctgcctgcatcttgagtgaacatttgttgaagtcattgtaatggtttaaaaatggttctcagactatatgctaaagaatatttaacaactggaaatgtagttatgtaacttaactaaaggctatttttttacattttgacagaaaagatgatatgttttgttctgttgcaagttctagtgacccctgcttagctttcatttatcacaagtaatcttctcccggatactgcaattgctgcaatgttgagatgcttatattacatcaaccttggagaggggtcaaaataaatctgtgaattaagcaagaatacattacagctggctgaaaagtgtgtcaagaataccctgaagagaaaaataaaactatttttttccctgtgtacaagttgttgtggctccttgtctatctacttggagtttagtaaagaaattctgttcttcatcttaattctaatgtgggtaagtagagtagataaagcatatggttgcagctgctctggagttacttgcatatactaaggaaggactactcagataaagcatcggctgtgataatctccatttacacagaaacaaaaacatacaacgaaaacctcagatagcttgactacataaatatatgattggcagtgggttcgagagaattctgaacatcaggtaaacccaatggtgacttcattgttaatttagggaattatggataaatgtggatggcacctatagagaaagtcatgttgcaaaaggatacaagaaaaggaatgagcaagatggacattaaaattgaaaggaagcaaatcacgcagagagtttatattcaaggaaatgaatagaaataaaaactaagacaaaatgtgccaatataagaaatataaaagttgatatatttgtcatatcttgaaaaatgtgattcaaagtctctgttttgatatttttctcatttagatagttttattttatgactatggacaattaaagaaggatgaagtattttctgtgagtaatttctcaatagtttttttatcacaagctgtgattaaaattttatatatacattagggaaaatactatactttagggtgaagaatcctttttcatggctaattaacaaacaagaaaagttagttatgtaacaaaaaattaaagctggaaaaatctaatagtttaataaacatgaaattataggtgatgttttgcatgattcagagtcacttatgtactaaaaaggaatgaagaagcctttaatgaagtagacaaaataaactaggaatggactgcttagtcactgacaagattatacttgaacaaagggtagctctactgctctttgaagatgctacatgctcatttatttatacatcaatgcattcagtttattcattaatttaacaaatcattgtgccagacacttgcctagatcttttgatcacaaaagtgaggtgctcttaatggttataagaaattttcttgatggttaacagaaatggttaaatgccttctgaagctttattattttgtttggcataagctaggagtaaatattttattaccttttaaaatattttgaagtacttctaaaatatttgtgaccttaaggttatcgtatttttcagagaataggaatattcttcagacattctggatcaattgtgttttactacaagggaataataaagattaaattcaagaaaagtagtgatgacagcaagcaaacaacttttcaaaaatcaaggcaagatggttcccattgttactatactatggacccaaaggtccatatactatactatactataccatataccatactatactgtggacccaaaagtccattgttactatactaaaaaattttcctgtttaaaaagatattgtcatgttttcctacctgttatgtggaaatgtagtgtatcctatcttggccctgttaagtcctggaaaaaagtaatcaggttggacagaaaacaggcttctaagacatttctgtgtttcaactgcatgatggttcttctggctgcagtttatctcttttgtaacatactgcctgtgagaatcatctggggatcaataagtgagactcaatattgtgatttaaagcagccctttacattaaaggcagtattttgatatctaaccattaacaacatgactgcatatggaccatttacctggttataaaaccatttttgctgagcgaaaagaaaatggatggaattcagtttcggaggcttaattaatgtggctacttcttcaatttatttgtttatttatttatttattgggatgatattgagccctactttatttgtaccctttttaaaccaaaaaaataactttcttcctaaggaagttggtttcttttcttcactgaagatgtacagccagattatgaatgaccacgtggtaggagtggcttaaaggaggttgcaatattagaatgaatagtaggaaaaaaataacttttaagacctcttcaaagtctaagggtctatgatctctggattgtgattttgagggcaggactgaatcttagcatctccatctctagcccctggcaagggacctaaaacaaactgagctttaaatatgtgtgttgaatgagtgaattaatggattaatcagaatttcatttaacttgtttattgattatcgtgcagctttaagtttcagactgtaaaggtgggcttaaaaggcattttatttttccttgagccatcatatcggtggtttgggttgttgtctcacaatgaacaggactgtagggctgtgactgtctgagcagctcagctgggctttttccagggatagatagcttagtttcacatcataccaccaaactcaatcaataacgttaacttttgagaaataaacctttttatttaaataaaacatttatataaaccagtgactaacattggcatatgtttttaaaaataccaaagctcaagagcacaaaacaaaacaaaaaccctgaagaaatataaatatttagcttcaaattaaatgccatcactaaatttcagaggaaactaatcactacctaatctcactcctgtatcctcccagagattaagtaaccaatttattccaaaattttttcggagttaacaatcttcccagctgcattcatggctccacagtgctttggggctacagagcaacttgggcatcaaagcttttgtatcagactttgatccttctcttcaggttagacctttttctgtctgcttgcaatttctcaaagagaaggcattaataatttgctgttggaagacttccaatgttgttgtcttgtttctttgtctactctgcaacttttgttttctcacaacaagaaaaagcctgttttgacaccatgtgcttggctttagcagcttggaggaggattacagaagcgctcctgccgccttctctagcatgacttccctgtgttcgcattctcactccacttgacctgtttctcttacctaattcctaacccctgtagccagcagttgtgaagttactttgcattgaattaagactgtatttttttttttttttgttaacaattcttgcatgttttcagcagttgtcagggacagtttttcaagttggaactttaaacaaaaaaaaaagaagaagaagtctgattttccttttgcctataaacattttaagcagaatataactaagttttataatgtagatctagtaggttactaaatggtaattctggatgatgcttccttcgctgtggacctcagtgtgtatttattgttgagtaaaaactgagagtgagaatctcagatgcttgcctaatttctttttactgattttagagtgaaactattgggttgaaagaagggaataatatgtatttatggcttatggttcttttgtattcttccaaaaatgatcttggtacttagatggaattgtaatgggcatatgaaaatgagatctttttccacgttgccttatttcagactgaaaatagttggatgcaaatcttcttagtataaatttgcctttgatgtcattgtttcatagtctagatgtgtccttttcacattacgtcttccggcacactggtgtttggaaagatattttcatttcctgagctggtttgagtagaggactctggtctaccagatgcccctgctccacagttgcttacaaaatgcctgtatgttttgaatgtgtgtgtctgtattctcaggcacagactttggaaagcatctctgttctgaccaccctgcagcattcattattttcagttctgccccttttggaggtcttgccacaaagaggcatatgtataaaacgtttgctagttaactgttgacaatttgaatgtatgccaaagttctgtaattgaagtatttcttgaattctatggtgtatggaaaacatgacttatccaacactgcaaacataattttatatttgaaaacaagagggaagcagacatattttgaaggtgagatgttttaaaaagatgaaccaagagatttatttgaaaaagttagtcaaggatatgaaaggaaaaagtctgccaattttgtttgtggttcttcaaagctatttttcctggctggatgcaattgcaaaaggattgattaaaatcatgctgagtggttttatattttctgtatttaaatgggtgagtaccaggcataagcttaagaacagatataatagagccagcccattgctgtagtttattttaatctaaacccccacgtagcctccaatttcatgtataatagttaaaatatatcagttgtttactaggtgccacacaatatgatagtgttttagaagacagtagtgcatttttcttctaatcaaagagagcatttttcttctaatcaaatggaaaagagatactgagtgtgatattagtgtatttactccttatagcagctctatgaaaaatgtatttgttcatcattcctatttcagagatgagaaggtggaggcaaggggcaattaaataaattgcccaaggtcagtataagtgtgggtaatgagactcaaatggagatcccatgatcttatcatttttgtgcctctttgacctgaggctgtgtgaattggaatttgcaattgacactgttatatttcctgtcccagagtgctcctgtcattcatcttgttagaggtcccatgtttcactggataatgcaaattcaccttttctcttgtttctggcttttaaaatgacacccagccaacaggaatatcttctatagactggaagagctgtttcagggtttttttttcacgttataaatcatagtgccatttatcagaaatagttttattgcttgaaagtgcacttgccacagattcaaatgctttatgggacctgtttacaagtgaggatcttctgtcatttttcactctctttaaaaaggaaacggaaaaatggtgattgaaaaatcatcagccagttaagttccggtggtaatagtccatcttgaagaagcactcacaagtttctgaaacttctgcagctgtccattcaaagatgcagggagatagacagtgcacaaaatagcaaacaaaggcactgctgcctgctggagaattgggatttcattgtgtgtgtcaaaagtaaatgaattcaagaataaccacttgaaaaggaattctcccttaatgtctttggtgcaaaaatgtgctcagattgtactggctctgaagagtgagactcaaagaagtaaattactttctagctactagttttcaattgctactggctcaaagtgctagctaaccttgcaaaagtggagcagagaagaaagcagtttgcatttttctcctaatcaaaatggaagagagtgagtgagataccatagtgtcacagagatttctgatggcagaagtttataaatagtcataaacatctcattgcaagtctcaacaagaaccacttaaatgtcctgtatacatttttcaggcaatttttatttggaataaagggtctaggaaatggttttgaggtgtgaaaactgatgtttatagagagtaaactgttttctttgaaggcctttcaagtatatattcagcagtcatgtaattatgtaaatttgtcttggacagttaaggcagttagaagctagtactaatgaaatgctcagttatagattcaaccctggtctgggccagtgtgtttcagccaaagagaagcctttagcaaggcccaggaagcatctctgaggcatccctgcaatttgttgagcttctttggtcacaaggggactgaggacataaaaatcaaggcttttcccagaaaacctgcctgaactgcatggcagttgcatcctctgtgtctcaaatggatagaactgaatatactacacattttggaatgaagagggctgttgtttttttcaccagtgaatctgagtatggtagaatgtgtatggaataagcagtgagggatatctttatgatgtgaaatggtttaaatgagtttaagaaatcgatgacttcattcacaaaatgactccaagggattgttcactttttgaatggctactacttttctcccatctgtaaaatggaggcagtaatgtctagtttcaggattgtggaaaggaataaataagatactgtctggggagcacctgcttcagtgtcaggcagatagtaagtacctgatatggtttggctctgtgtccccacccaaatctcatctcaaattgtaatccccacaaattgagggaggggcatgtaatccccacgttttgagggagggaggtgactggatcctgggggcagtttcccccatgctgttctcatgataatgagtgagttctcatgagatctgatgagatctctgtctctcacctgctgccatgtaagatgtgcctgcttctccttttgccatgattgtatgctgcttgaggcctccccagctgtgcggaactgtgagtcaatgaaagcttttttctttataaatcacccagtatcgggcagttctttatagcagtgtgagaatgagctaatacagtacccaataatgatagctattattattattttcaggagcatccaacaaatattagtattaactagaagaaacaaacagtacctttaagtactgatatgaattaatgaaaacactagctatcatttatgtatgaaacattagtacctctattttataggcctcagaaattcaatatgccctactgcattgtagcagacagtacaggatttattgaaggattcttcgactattagtacaatctgattcataccaggtgttgaggagctgaggagtaggcacatatgccatgcaaggcttggatgagaatgctttagagatttaagaagcattaagaaatgaacctaataaatttacaacttaatggcaagagcatcctagaaactttctaggaatggagtgagtggaagagaaggcaaaagaaatgtagactggacagaccagcaggatgatataccctgttgtcgacaaaggggttttgttggaggatatggaacaactccttcaaaagagaatgtgtttagaagttctaggctgaagacctgtttctatgttaaaatctttatgctttccctaggaaagtgactaaatttcctgcgcattgtcatgctcctttgtacaaagaagaaattaaactcaatttctgagttctctttttcctcccaaatctatagattctgtgggtctgagagaggcaggcattaatacaggcagatcttattgaggactaatcctaagtaaacctaactagtaggtgtgctgatgaccacagtgataaacaattgggtttttaaatattaaaaacaggtgtgaagaactacctgttacagaagctgagagtagttaaaactttagggttgaatgggacacagtgtttagttattttattcatcaaaagaaaggaaagctttgatggccttgctggaaaacctgagaaaagtgagaaaagctgaggaaagacgaagatgagagaaaacaagagatggatagatagtggaacagatttagggagcagaagtgcaggaggaagcagagctggctgaagaggggagagctggacttttctccatttctgctttctctcccttagcagacattaatacaattcatagaattccttctggtggagtccaaatttggctccaggatcctcctaaacagcatcttgagattagggaatgagttcaggtttataggctgtaagatttttcaggcccatcttagtacagttttttttttctgtgaaatcaactcttcaccaactcactattagttttagtctttgtaactcctattgcattttcatttctgttatttggcccctgctatggactgaattgtgtcttccccaatttatacattgaagacctcacctctatcgtgactacatttggaaacaggacctaaaaggaggtaagtttaaatgaggtgataagagtgggtcctgataggctaggattagtgtccttataagaagagacaccagaaagcttgttctcttcatgtgcaacaaagaagaggtttgtgaggcaggatggtggctactggcaagtcaagagaagaggcctcagaatgaaacctgccttgctgccaccgtgatcttggacgtctcagcctccagaactgtgagatataaatttcttttgtctcagccacctagactgtggtattttgttgtgggagcctgagctaatctaccctcccatatctgtggtcagtattctagtggtctgaatcttgtcatcctgacaacactttgagcttgagatcatgtcttgtatgtctttgctttcctgatggtgtatacttgacactgaagaattcatagtttgtgaccagatctttactacattttgttcactaactcaggaaattacgtaaccagttttgggaaacttcttgtaaatatatgaagtaaaagttttggtgccaagattaaactacctagaatatatattttattaactattctgaataactggcatgttattataaaatgctgagaacagactaatcaagagggacatgttaattttttgaatgttgtcattttctagtttccagataggcacatgtgcccaagacacaggggcaaacctactgacaatctcagcgtcttctggcacattcgagtgccagctttaattctggttagtgacagctgaaattggatcccaggttgcttgactctaagttgaggcttcctggaatgccaataaaggctatactcttgacttcattctgttctgctggaatttccacttgctgagtttgatggagaaaagcatccccacaatagtaatgcatgagtctttaaatgactgtgtgtcttagtccttattaatgcagatgagactttaataaattatttactgagcacttaatatttgccaggcactattccaagttttttttttatataaactgcttatttaatctctgtaatgtatccacaaagtagatactatcactacttaaagctgaggcacagagtagttatgccagttgcccaaggtcagacaggtagtaagtagaaaagcctggattcagtttcagacagcctgattgcagagtccaatcccttcactacggcattctgtgtctctccggttgagtacaagtcccggaggacttgtctttgattggtttcattagtaaaccaacattagctaatgttctttgccactctgaatgctggtgaaaagctggcaatagaagataattattttctggaagatgagtattacatataacggctgtgtcatcctctgattcaaggcagtagagtgtagtcgttaaaattgttctggaattagactttgtgatgttttagctgagtcctcagatttccagttggtgactttggaagttatttattctctccgtaccttaatttcttcagtctgtacaatgaataagaggaacagttcttacctgatagggtaatggaatggttaaatgaggatctatacaaattacttgatccagtgcttcacatgtagcaagcacccaataaacaaccaccacatcactaccatcattatcaccaccaccatcaaagtgatttggcagaaaggtagtcatgctataatgcctagcagccagttatattctttgttcatcttaatgtgaatgagataagtcaatcataaagttacctaggattgagtggactttttatagacctggttatccaaactatatgtggatctatatctacatacatattgaacatgatgaataattaatgaccccaatgatgatcccgagtagtgaataagaggcaagggacatttatggaatattttagaagtgtttttattaaatgttatatttagggtatgaaagtttagaacctgtttgtataccttaatttttttttgagctaggttgcttcattcccaaaggattccaaataaaaccgattttaccttttgtcttaatgcactaccattttaacatccaattataatatagattaatcagttagatcacaaaaacatgcaggaagtcaggagggcatgatttagccactagtcccagatgcagcttgctggggaggaggactcaagagttttgcagacttcctgcctttgtgcctatcagctatgcaatcttaggaagattacttaacctttctcaacctgttttgtcacatttaaatggagactgtaagtctcaccttgtaaggttaaaatgaagatgatgctgaaagcaaaacacctggtacacaagaagcaacatattcaagtatttacagagaatctgctataaatctgtgctgtctttcagagatagtgaatattcttcttatgatttagaataaatctcaatgtcatgccccatgctgttaaaacacaaccctctcattgccaataaaatgattttaaaagattataggtattttgtagcacattcagtggaggagagttgtgcttcctccaaacatctagacttggacatatctaagttctggtaaatagatatagaaatagccagagttattggtacacagtgggccttaaagcctaagctttggaaaaacattaatatggagggaaaagtctcaggaattagtgctacatatcacccagatgaatgaccaaaccaaggtgaatattggacatgctaaaatatgggattcagaggctgcggtggctcatgcctgtaatcccagcacttgggagtccgaggtgggtggatcacttgaagtcaggagttcgagaccagcctggccaaaatagtgaaaccctgtctctactaagtacacaaatattagccgggcatgatggtgcatgcctgcaatcccaactactcgggacactgaggcaggagaattgcttgaacccaggtggaggttgcggtgagccgagatcatgtcattgaactccagcctgggtgatagagtaagactctgtctcaaagaataaaaaatgggattcagaagaccaacagcagatgatacctaaccaaaatgtcaatagataaataggaatcagagcagatcctggacagaagtgtgtcccctgagctaggcttgcataatgaggtaatgcctgatatccatagctgaactgttaccttctctgtggggcttgcccaagctttttatcaaaacgttacttccccatctctgccactgctcacaactcttgtcctccatgcaactttattacttcctgagcacttaacactgtctcttatactgtgtatcttgtttattgactgtttaccccaacagaatggaaacgtcttagggataggaatttttgtcttttttgctcacttctgatacctcagggcttagaagagtaccttgcatataggaagcattcagtgaatattttttaatgaatgagccacgttacagttcatatttgtgtcattcctagttattgtaagcatatattccatttaggtaaactattgatagtccattgccttctgtagatttagtcattttcagtaagtctattcttaaccctacaaagttcttttggaaattgctaaggaaaatgtgttaactgatagactaaaatcctgatattcataattcctgtgtccagagtaggcagaccaggtaaaagcgcctcctaccaatggtgcctaaaaaatgattattttaacagactctgactgaccatgtatacacaataacaagccatatttgtttcatttattgagaagtataaatattagcctataacatcaaaggatattctccaaataaataaggggtgattattggacataaagtttgccatcaagctttctgaggttaccaaagttctgtttatgctgtgagtctatagaactcacatcccctgtcatggcataagtatgtgcagcagattgtcctgtgtgactccagatcaaacctatgttcattacagtttccttctaggacacttttaacattaaattcaattatgctgtaagtactttaaatatcattgccagtgcttcctatgaaagataagtttttccttcatagtatatgagtaaaagaaaaagcattaaattcttaaaggtaatttttctcatatccaagaacatgtatttttgatttgataatgtgttttaatggaaaaaaaattcagtgaagagtcactgtggtaggcgaactgtcatttatagcttcccaaagtgtccctatcccaatcctcagaagctttgaatatcttaccttggatagcaaaagaatatcttaccttggataatcacattgcagacgtgattaagtttaaggaccttgagataaggagattttcctaaagtatctgagtgcatacaatctaataatttgaatctttaaaagtggagaatttttcccatatcacccacaaagagggtgataggaagatgttgtgttgctgactttgaagatgaaggaagagaataactggcaccaaagaacacaggcaagcaatagaagctgggaaaaaaacaactgaaaaacaaattctcctttagagcctccataaggaaactctgccttccctgcagacaggttgattttagctcagtgagacccatttaggatttcttacctaaagagctataagataatatacttttgttattttaagccactaagtttgtggtgatttgctacaacagcaatgtaaaattaatatagtcactggctgttgaataaacaatacttgtagtatttgttttaaaacttttgttctgtaaaacaactgttagacctgtgcaagtaaacatgttattaagaaaatttttcttgctattaatgtcatacgaattaagtggcttaaagtgtattttgagctaagtatttctatgggtgacattgtaatttaaaaatcagataatttagaaatatttgaactgtgacagattatcttatagtggattaggacatatttcctttgcattcttaatccaaacactatgaaagcactttggtattttttagtgggtacatttcaatgtttgacgagttggcttacatcttgtttacaggcgctggagttaatttttcatgagtgataaattgtcagttaacatgagcttttgcaagtgaaatttgaaactctactaaatgttgagtgtaatattgaagtgtattaggtcaaatggctaaacacaagcaatgcattggcactgattcaacatcctaatgatccaactgcattcctttgcatgaaaagtatttatagtagtttaattcatagtattctttagctctgagttttgtttaagaaggctagtgaagttaattatgttgtctagaaatggaaaaagaaatccaccaacaacccctaagaatgctgctaatgttgatatgattgaattcatagtagaggcagctggatttaattatcagtttgcaatgttgcggtttcagcagcagttgctgaggaatggataatgcaagtagccttcaaagccactcacattagagataaaaaccttgtcattgagtcagacagctgactgaacaagtattaaaatgaacaaagatttcccaagggaagttgcagactaaggtttggttttgtctccttggcttcaattcaaatatgtcagacatataggatttttctcttttctaactcaaaatgttggccattcttagcattagaggtgggtttggggagaggttgagagtgggggcatttagtggcaattatataaatctttggttagctaattactccactctttattcagctcatttatggggagaaatgtagaagagaatccctaggttctaattattttagcagtgttacctaagtatcaacttaagtacttttgcagctgtgactgagtttgctaaaagcaacagtggtgactggtagcagaaatcaaatattttccctgtaaatcaggtttactcaacagcagcactattgacattttgaaccagataattctctgttggggaagggcgggggctgtcctttgcattatggtcagcagaatttctagcctctgtgtgtggaatgctagagcactccctctccattgtgaagactaaaaatgtctctagatattgccagaagtccactgggggagagggtgcaaaattctcctcactgagaatcactgctataagtctgagaggaaatatgcaagttacttttggaaggtacaggtttctcattctaacgagctcttggtgttttcaccttactgttccataaaaatggcagttcctgtgcttagtgcttagtatcctcaagagaatggaatacttgcaggaaatactaacatcttagtgtttaagtgggtgtgtaaccacacagacactcctgacctttatacatcagctttgtttgcttttacaaataatatctttatgatattttagagagaacattcagaagcataacatctctcaacataaattctatagttggagctgcttctctgcacagcagtacttcatcctgtaggaagcagccctttagcaacataagatatgaaacagcaggatgcaataagaaaggaatgaatctttaatgaatagtttttaatagaagtcacattgttttaataatggggaagataacatggtattagtgctggcaattaattaaggaattcttgccaagataattggtaatcattttcttaatttctttgtgtgattcaataaatacattttgtgggttttttttttttgagtgtgataacattagctgactgaattatagctctctttgcacgaagattagagttaccaaaatgttcagggaatttgtcctgcattatgttgactaatatatctaaagaatagttaaagatttgcctgtttttaaaagtatgatgcaaaataaaacacgggtagcagaaatcaaatattttctctgtaaatcagggtttctcaacagcagcactgttgacattttgagccagataattctttgttgcgggggctatcctgcgcattatgttcagcagcatttctggcctctatgcactgaatgctagaacaccccctcccagttaggtccatttgtgagattttggtgtgtttttaataccctttcacctcaaaacccccacctaaagaacacaggagtgcacagatcggttacagtctgaacggacgagaatgagccaggaaatctgaattgtgttcctggctttctcacctatgtgaccttaaacaggctgagatttagtcttcttgttttccttatatacagtaggcaataaaccatccccgctcaatccctcataaaatattatcaggattaattagagaattcatttgaagtgtgttgtgagcctagaagaaaagcactatctgtaatacaagatattacttgttttttccttgctcttctctgttttatgcagctctgcttccccagtctactctcatctatccatttagctgctgggggttgattaaactgttactcacactctttcccagctcgcattaaaggaacagtattagatttcattttgttgagagatttaaacactaccttgtctgacagattttgaattcacctcttaaatgcattcctacaggccccagccacaaatatcaacaaagttgaaaacaccaactttatttcttagtcaccttgaataaaaatgatgctgtttatttttaacacgtttggaatattcagttacaaacactatcagttctgatggacttcagtaatgggaatagtgtctgtgctttttttatggaaaacttatttctaacagttctcttttttgtaaatctaattgcttttggttcaccaagaattcatgggcaattgcttttctcactattacaaatatattgcaagtggagcttttatattcagggttgctgacctgaatctgttttccttcacagtaatcttgtgctgtttccaagcttaggaaagctgacagagtttgaaaagacaatattcatcagtcagactatgggtgctgcttttgcatcttttatacgtaattgtcaaaacattctattaatacccaactacaggccaatgcatgaaaatataatcggaacattgcagaagtgatgcagagacaaacaggaacttgaaaccgtccctcatttttgaccccaatttactgctatcccacacaaatttggtgttctcaatttctgaagaaattatctatatcagacatgcaggcttatggtccagaggttataggaaatgtcactttatattaaaaaagaacccacctcaaacctggcgttgtgctttgctccttgcattaataatgatgtctttccagctctcattctgcttttcagtcctgggggacacatattttaattttttattggctgtggtagagtttcagcagattcataggaagcgcttcccatatgcttcctgatccatgcaaccagaggctgcagaggggtgtggatacttgtgtgtgtgtttgtgtgtgtgtgtgtgtgtgtgtgtgtatgcatgtgctggttgatgagggaggagtgacaactgttgatttcaattgacatagcccattgtgtccttaaagtagatacgaatcaggatatttatatgcacttagccatttttcccctcctaacaggtcttggactttgaaatttgatggtaaaatggattgggatggtaaaagtaataaaggagaagtcagtttatccatgatttaatctatatggtaaaatccatcaaaattcaaaggtttataaggtcgcatgttaggaaaaagttttggttactgatacagcctattagtttctacaatttccaccctcctccactctactcatgactgcctggcctgacagcatttgaaaggtggggcattgtatatgccttaacgtttagttttaatttatactccctaaaatttttatgtgtaaatattttccaatttaagtgtttaaccataaaatatatttagagacttgaaaaaagcagagaatatcatatttatgataatttaccattttaagaaaggacacagtgcttctcaaataagtagttgtatgatccgactcttcaggtgatgacagctttgttgattgagaggcaagtagagggggattgtctgggcagtccatcattaatacaggtgtaaatcacctggtggagcagaaaacaaatgtgtggtacatgtatttctatctgaattataatatttattccccatgtaagctacagtgtgttctgaaaaagggtttctgggatcctttctttgcccatgggtttcacattgctcaatgaaaatatgttatcgttgttgaaaaaaggtttttatgagcatatttgaatcatattttctatcataatctcaattatgtttaaaaatctggaatcctgcttttcatgtatgtaagtggaagagctaactagaaagctttttatcattagataaaagttaatggtgtctttacttcccaagatcccccaaatttgtcttttattttgatatccaaattagtgccttatatatttaccacccacccttaattttgttcttgaatggttttaactgtataaagtttgcctccttttaacaaggtgggagtgatggtacatgtatgaaaagctgtttgataccagagagtgtatggtacttagcattttctcaggcccacgtatttttagaactgaaaaaaaatagccttcaaagaccatttccccagtcatctggctttttaaagaggactgagcatgtccaaaactgagctcctcatcttcatcttgaacttaactattgtcaggggttgcctcttcttatgcaagtacttttcttcccgttgcccaggccaaaaatctgggtatcatccttgacttctctctttcttttataccccatgcctaatctttcaaaaaattccttggttttatgatcagattatgtccagaacctgtcactttttaccacttccattgctctagcttcattcaagttaccatcatcttttgctttgagtattatagtagcttcttaactggttccctcctttcacctttgcttttttttttctcttcttacaaagcagccagaatgatctgatgacagcgtaggcagagtgtgttcttcctttgattaaaagcttcagtggctccccacttatccactgcttatgagaatctacatgatcttcctccattaccctttatctctctgaactcacctcctcagacttccacacttccctctttcctttccaactacactggactcttcgccgtttctcatatgtgctgggcatgttcctgcctcaggcctttgcactagctcttgttcaactgttgtcatgcctgtacctttctgttagatatctgcacaatgggatccctccatcctttagtgtctcattcccatgaaagtatcttgcctatctttaaactcacaacttgttttcttggccctctctatcctccctgccttgtttagcatttttcccctctctgacaccgctttctagcagactacactgtttacttacttattttatttatttatgtatttatttttgtcatcacctactacaacgtcagatctctgaaggcagaatttttttttcaatgtcatattcacaacccagaatagtgcttggtacatggcatattctaaataatcattctcattaagttactatttactgtggataaattttcacttccatcatttacctagattctcctctgtgcttcttggacaatttcacacaagtgttagatcttgactcatgagttgactttgaacagatagaaagaagccagaggcattcaaagagctgggagagggtgtgcaaagacactgaggtaggaagagagcagtgtgtgaagatttgagggtggaaagaggcaagagtgtaggaaaggaaatggtgggagaacaacatgcaaaagttaacagcaaacagattacaagtgccttgtatatcataccaaggtgtctgaatttatcctctaagcagtggtgagtcattaaaagattacacaggagttgacttgactcagattagtattttggggaaaagaactcgacaaagtaaattccttttagaaagtatgaactcttcaaatgtgtagatgggtatagagaacaatttttataacataagtatcatgaaataatattctatacaggttataacctaaataaatttggatccaagttatagacacagttatatttgcacatctgagcatgaacaagggcttgtgtgatctatgtaaaacgaatgcctttggaccctgtcacagttttaagaattttatattactgaagtgatgttcctgctttaccatcatgacaggaggcttgttactgtacttcctaatcattgaatgtattttgatattatttgcagctaaagagaaaatgataacttccattttaatcagaggcattttcaattgctctccaatctaaattcataaagaaaaatggactaaaatttttagtatggaatccaatttctttttgaaaacaaagacttttctttgtggaagaaaaaataatccataggggaataaattttatttatggaggaggtgttggaggatgctattttagagacagtatgcaggttgccaaacagtgattgtgcttttgtaggtaaagagcctctaccagctggacagcctctggaaatagccacatgttcaattaaaatgttttagcaaatttattgagagtcaggtagtttttcgtttttatctcaacttccagcacatcaaaggaacttagctttaattgcctcttgtaggaattaatctgtatggaagcctatctctaaatagccagagaggccatgaccaaatgtgaagccaatcttctctccacacttgcaagtgccccaaagagatttgctcacatgtaaacagacccctattgggttcctattagtagagttagcaaaacttattttacattgagattttataaattctaataacttttttgtcagttgggatttttgattccaagagagagaaactgattggttattttaaaccccagaagactttactggaaggctagtggaggaagaaaggggaatacaagttgatgggaatgtggagtctgatacagaaaatttacagatgccagagagttctgggggaagcaggggccacagtcatagcagaattctattgctgctgcaaggaatctggcctccagaaacaacttcacgtttcaagctgccagaagcaagtggctgataggctaacagggagtgagtgaaacagagagaagctctgtccttttctgtcctcagtgggaggcaatagtacaaggtaggtcctaactattaagataatcccaaatggagaatttcatccaaagggagaccacagtgttcatagggaatcatgggtgggggagattgggtactctcaaaatgataactatatcttgcatttgttattttattgcatgttgtcttgctttgtttgaagtgactggtaggattggggtaaggatttttgcctttgtaagttggcttaaaatatccatatatctatagctatgcacatagtatatagatttctttctcttgtggaaaagtagctgtgggttggaatggaaagtgaggaaggttttatacagaccaaatttacggtctgcctgtagtaactcaggattatttatagtactggagacccaaatggttggtttgcattatgcttgaattgctcttcttttcccatgctgaatacttctgaggtactaacaaaaagaaggcagagtaaacaaaaaaagtctttgtatattttcttcaaattgggttaagatcaaagagaaccactgattaaaactgaagcagatgtatgtgcacatatgtacatgcacacagacacacatatgtatacatttatatattttatataatcttaactgttaagagttaattgcaggcctgatgtccctaaacattttaataggtgtttcttaagaacaatttttttcataaccatatgataattgtcaaaatcaaaaaattaatatgtacataatactgtagtctgtagaacgtattcagattttaccaattggccacatgtcctttgtaggaaaagaaaatctcagatcctgtattttcttttttttttttcttttgagatggaatcttgctctgtcacccaggctggagtgcagtggtgccatctcagctctctgcaatctccacctctctggttcaagcgattcctctgcctcagcctcccaagtagttgagattacaggcatcctccaccatgcctgctaagttttgtatttttagtagatatggggtttcaccatgttggccaggctggtcttgaactcctgacctcaggtgatttgcctgccttggcctctccaaagtgctgggattacaggcgtgagccaccgcgcccagccttttttttctgttgtcatgccttgttggtctttgtaacgtgaaatactccgtcattaatttggaaacaaagcttttattttaattattgatatattttaataatttggccattattttgtagaaagtccctcatctggtgtttggctgattattccttatgaatcaatttgtgttatagacttttgacaggagaaaacaaaaaaaaatgatgctgtgttttcagcacatcgtgtcaggaaacacatgaagtcaaatttcatttccagtgatattaactttatcacttggttaaggtggcttcaccacagatttctccattgtaaagttattgttttccttttgtaattagtaagtatttagtgtggagatactttgagacaatgggaataatgtttcctatccaacttttacctactgattatagtatttattgataattcttgtcaaatgttgatttttctaattaaattattccttctaaatttagaagttggatttttattgcaaggaatgactttccttatttatttatttgtatcagggtggacaaatgaatacttattcactgtgctataagtgtttacttttgttacttattttgatgctcaaattatccaagattttcccaatgttagcccttctaatgagctaactttagtttacttcctctgtgtgctatagggaagacctatacttcctctgtgtgctatagggaagaaaaatatacaaagactttttttgtttactctgccttctttttgttagacccttgtgtcttccctatagaacagtgctttgtataatacttaataaccatattgaatttgccaataaaccaagcatcatttcctctaaaattttccaccttaccaaagtaaacttctaaaaagcaaattcaggggaatatacaaaactgtgcatatttatcatgggttgaaaaaaattcatatttttcttattttgtctaatctatgactttttacttttaacataatttcctttatatctattcattattttacagaatataagatatttttcaaaatttagagtaagtactcagttgagtcccttgtgtgaaataatagacgaattggtttgtgtgttacctctccatctgccatcctaagggaagttgggaaatctcaggcaagattaatgacaatagaaattttgttccatgattaacttatattctgtcagacagccttttggaacagttttataaccttctttcctctatgctatttccccacactatttgcttaaagatttttttttcaaattagtcatcattcacttcttatttcctttgtagaaaaattaaaagttataaaagagagaaaataccaaaatactacttatactttgattaaatcttgaaataatttttaaatggcacctgcaacttaccctagacctggtgaaattcttgtgaggacaatgttaactcatccaacattaataggatggtacttatgtggcaggcattgtgctcagagcttaattaagtttctgctccatcttcaaaagactaagagtatagttggagaggagatacataagcaaaaatccccaaaaaggtaacaagagcagtatacaagttgttctgaaaataagggagaggtgctgacttctcctggaggaagctagtgagcaagatgcttttgagaataagtgcaaatcagtgtccaagaaaagagattttcttcatatattttgggatggttgaaatcaaatgataatttattctaaatgatactataattgagttgaaggaaagaactgatcattttaaattaaacaaagaatgttatagatagctcttattattctgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagcttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcattgattttttgaagggttttttatgtctctatttccttcagttctgctctgattttagttatttcttgccttctgctagcttttgaatgtgtttgctcttgcttttctagttcttttaattgtgatgttagggtgtcaattttggatccttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttgctggccagggcaatcaggcagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaatgaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttcaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggttctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttgcaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatggagccataaaaaatgatgagttcatgtcctttgtagggacatggatgaaattggaaaccatcattctcagtaaactatcacaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaacattaaaaaaaaaaaaagaatgttataaaaccagtgttattagtttgggaacatgttctgtctgacaaatttgctctggtataattaggtgacataatggtcaaacaaatggatggaagtagtaaatgaagcctatctcgaatgttgtaaagcttctgacttttttttgtctgacataattggattattatgaattcttcatattgaataattaaaaaatactaaaccttgtgtccagaaatccctgaaaaggggatgcgcatggataagctccatgactgtatgaaatcctttacattacaagtcaattttttggtgaatttgcacttacgtatatttttctctgaaagaatccttaggtcttatcagattctcagtggatcccttgaatccctccaaatgaagaagcatttacggagtggtatgctgaaagcagaactccactagaattttagccccagactagctacactcagtacagtcttagactagtaatttaattttcctgtgctttagtttcttcatttctaaaccagaagatttaactatggtcagttctcctccacagacatattctcaagtgacaagtacatcctaaagatttttgcaactttaagtggccacaggttcagtttttcagcctttacagtgttgtcactaacagtgtactaagaaatttgaatcttgctgttcagtttcccttgaaaaacatttgtctactctgggcccatattactgcacagcagccctttggagatcagtgctaatacatttgggcagttgaatgcgctcagggtctccacagaccccaccatgccctatagtctcacaccagcaggctccactattttatatggctttccggctctggaagcatttggtatggtctcctcagatctgcacagtacaccattaagctaaggaaagagaatgtatcagattattgggaggtgatacagtgctatgaatgggcagcttcactgtccctttactgagagaattctgaggctctctgtgttcctatacataccctgattgtggaggaagatttaacactttttgctgaaaatgatttctctgcttggagttgaaactgatcaacttatattgggcgtcttatatgatactcttacacatttgccgtgaaccaatattttaagatgttatgttacaccaaagaggatctgaaattgttggaaagtgtatgataaaactgctcaggccctgtatttacacaagtaaaatgaaacctgaagtaattgtacatttcaagttacttcattgactagatcagggatctgcaagattttttgtaaagagacaggaaatatctgtttgctttgcagggcatattatctttgttataagaacataagccaccttagacaatacataaatacataaatgaatgatcatggctgtgtttcaataaaaccttacttagaaatacaggtagatttggcttgtggattgtaatttgccagcccctaggctaatcattagaatatggtgtctggtcttaaaaaccttgaagaataatcacaaagattaaaacaggatgctactacaggaggtattagaaaagaagacccacaggaaaagtgatctgggatggcttaacttcaccaggaggaggctcttgggtaatataatttatgtttgacatagaaaataatttcttgacaataaaagtggttacatttttagagtgaattattaaggcagtttgtggactctctctgaaaggttgtaaaaatagtataacttttcatctttctgagttggttttcaatagatatatgaacaggataatctctaggcactgggagatgaacaactagaaatgtaaattcaaacagttttacattcacagttgttcatctcccattggacagaagcagaccaacaattcagatttctgatgtttacattagtacttagtactttcatattcttaggaaaggattttttttaacccctttcctaatctctgaaatgcccaagtgttctaagtagcatggttgattaacatataacgaatctattagtagtgcatttaatgatgatgaaatgctacacacatttaaaataacagatataatagctcactgaacagaattatcctaaagttattttggaatcctcagaaaacatttacttgttctctgaagttatctgtgcagactattgtgatttcgtgaagggagaactcaagatcgtacacctacatttcattaacttttttggtcatgtttcatgtgtctctaaggcaatagctacagtaactttagttggtttttggctactatctcacttgtatcaaatagattcatagaaaaatatggtgacagcattggcgggaagtttggaggacatctaattcaaacctctcatatttaggacaaagaaataagaaccctggcttgggttttagggcacctgatgaggaactagaacttcagatatactgtttattacacaaaaatagatttttaaatttgagattttttgaccaaaaaattttatcataaggcagtaaactcaggtttcatagatctacataggattacttgttggatataacccatttaagtttaaatacccaattcttttttgagggctggactctggtcattctggcagttgattcttctattttcctacgagttctgtattatgagaatttatgctctccattccaataatggaataaaataagagcatgatactggagattgccatcccatgtggtgtgttaaagattcagtctatcctgttgcagtctcattgggaaggagcaatagggagacatatgtgatcactgcatcatacatattagatggtaaataaaatttaataaagagcaaagatctttttcctgttagggaataaatttgagcataattgcaaattacaattttatctgagaatatctgtgtcttacagacattctataatgaagaaaaaatgagctattttctagtgtaaatcttattttaagtcataatgatgtatatgtgtgtgtgtgcagaacaaaataggtgtaattaccttatctattccattatattttagcatctcttatacatgtgattaaagttgctccctttaaagtattgtcatagggagactttgacacttatttcagggattccacatttaaccaataagtttttttggaaagcttaacttagatttaccataccaattagtttttaactgtttgtgtttgtgtgtgaataatcagtttgtgagaaaaattagtctcattaaattagtcactacttcagcatgacgagcataaatagtcttttctagcttaaccacttggaacgtacagacttgaccctgaacaattttacctttagatgattttatgctactgatatcaaagaaatatattctcatctcggaatgcaattccaaaagaggagttccaaaaattacaacagtgtcatatttggaggactgatttccataagatgaattatgtctggtacacattaatttttttcaaaatgaagcatgacttacagtaacatgcacagatcatcgtgtgcagtttaaaaattttgaaatgtgcatacacctttgtaacttacacccttatcaaaatatagaacatctcatcaccacagggtttctcctgctctattacatcatcccctgaattgaagccccacccctgacccccttcatggctacccagggaaccactgctctgatttctatcaccatagtttagttattcctcttccggaatgccatgtaagtgccatcatcacatattctctctattgtgtctggcttctttcctgcagaacgttttttgaggttcatccatgatgttgcatgtatcagcagttcatttctttttattgccgagtatgaatgtttttatgcgctcttgttttctgatgtgagttaaaactatgtgagaagactgaattatcttcttagaagttacagaataaggctatatttgaggattttctcctccacataggtcactttatactataacttatcctattacacaaagtatatctatgtaaacaaaattactctaatcacaatgaaaactactagttcaaatatttaactataaatattttaggaaagacattgtatcagggtattagagtttttaatatatacatagttaacattcattttattaaatacttattggaagcctactacatgacagacataatactataagaattttctcatgttttgaaatgatatataaaagctctagaagaaatgaagtattagtaactgatctaaatctctgtatttatttataattgataattaccagttttagtattaatctgtcactttataggctgatgcaaatgaaaaagttatttgtgaggatacaggatctgagaaaagtgagttcctatacatcatttttcaaaaactgtcctggaggctttctttgctgcttgttgttgaaaaatggactccatagggttgaggcatcatggagactttaattaagttttaattaaatgttttccatggttttgcataataaggagatagtatcaaatctaattcctgaaaaatctaacatgcatcctggtaatcaacacatgaggaaactctaagcatccacatataatttagtgctatttcggttaagtgcattttaaaaggataatccttacacagtttctgaatatattcattaaaattggtgaacttagtagaacactctagggaagaaatttttaaataaaacttcaaatttttgttggtttgatatactgacaatttaataatttaatgtctctgaaattattttgtgtattttatttggtaatttgtaaaagtattacataagcactcttggatttttaaaagtctaaggacatagaatataaagtgtcgcatcactttcaaatgtgtgaacatagtaagagttgcctaaactgtttgtttgtaattgggggtaataatatattcagaccatagaattgtaaggcttacccgagataggatctcaaagtatttcactcttacaccttgggtagaaggcatactttaggccttatatccaaatgaagttatatggataattacaaacattaactaacaggattgaacatataaaatatatcacagttttttcattgcttcatttttaatacattataaaccttaagcaattgaaagtgtcctgtgcccttgagctttaagagatgagtttaaaaaacttataacatgtaacataatccaattgaccaaacatatgttgagttttaactatttgctaaggattgtattaagtactaggagtacaaagatgaataatgtaggattcctcacttcctttgccttattcagctttttccttactccttttagtttttcactcaataggtattttttctcctaattttaaggtctaccttttaactgtaaatggctagattggactacatggtgtctaagttttcccccaattctgcaattctatgccttctaaatgtatgctttgaatgctaacatggatatgtgcaaacactgaggcaggttttgcttagacatgcagcaagtttgaaattcgtttatatacacgtttaagaaactcagcttcggagtcagacgggcctaggtacaaatatttaccacttaggcaagctaccaaatctctgaatttttctctgtggtgtattttataaagtagggataaaaatactacttcctttataaagcattatgaagactatatgagataatgcatgtaagagacttaaacaggtgtgttcagaatataataaactcgaaataagtattagtctttattcatcaggcaatataaatataggtaatttacttgtctggaaaaatattcctaagtattcgcaagttaggtaaagtgcatttgtccttattttacaagagaagttagtgaactttaatgaggatgacaggataaatgtattttctgtctatgctagtcatgttcttgtcaagaaccacgctcagaaattctttgttggtagcagactatcgcacagtggaatcatcttacatctagtgttttcattgctcagcactgtgctgaaaacaacagctctaccatgtttgcccaatgagtaaatgattggctggatgaatagatgaaaatgattgctgttaatacactaaatataaaacaaaaatttgcctgaggcaatattagtaaatagttaatagagacaagattttagcttttactacttgttggtacttttacataatttcctaatcctctgtttcttacaatgatgcatacacatggacaacgctgcagtatagtggcttcacaaaatgtgatgcaatcatattttttacttatttataacaagaatcccaagtacgaactgcagtagttagcattaattttcctattttattttcagaaaatgtgggaccagaaaaaaatagatgacctagtatgacaactgatttttaattgatccagtaaatgttaccctgtttcagagagaggtgcttctttcccaaagttatagtgttatctcacctattcatagcaaagatgtccttatgactctaagatgaactttccagtagtgccctggagctcttttgcattcccatggacctattatgattatggaaccccattaagaagattccctttgagatattgagataaaaaatccagaatgtatatcattaaaagttataacattggacctcaatcatgcttccctttctatatctttgatcttaatgatctgagtttggaccagcaaggtattatgctcttagaacagctgctggggtataaaagagcattttagagagggatggagattgtgaaatatgaattgaaatcaggtctagtgaagttaattcagcagctgtgtataaagaagcattttgatgtctagtatggtaatgcatcaatacttatcgtcagataattttaattaagcaaaccttaaagtagtaaaaattagaaatattgtttaattaaaccttaaagtattaaaaattagaaatatttttagacttttctcctctatattttgtatgtggagtcagatagaaagtagaaatataataaggacctaaaaaactgccagtaggaaaatcagttgaaataatccagatgcttctactattttaaaggtcaaatctggtttgctcataaaacccagagtagtgtgagaggagatgtttaataaatcttggaatttggtagtagaataaaagtggtgaatttagagaccttaagcttggttggttagattttcacattatgccatctaagagtggaaaagatttcttccagctgtaaaattgtgggttaaaagaaatgtcacacttcaactttttttcctttttaaatccatatgctctgaatgttaccagatttttcagacttcaggaactgaaggctttttattcataggacaggctttgcaggaactactatagtgcaaattcatccccataactctcctaaaataaatatatttttctttggaaataccaactcttagatagcaagaataatttcctcgtggccttcatagcttttggcttttgtctgaaagatccagaaagtgcagaggttatgatgtattgctttagtgacacgaacacttgtcccttaggattgacatttcaggaacttcttcatgtgttacaaagccacatgcagagagtgtttgaaagtcattggatagctgacttcacccacagggagagtgacagggacctggagtaaagccttttcagtgaaaacctttaggcataattagattattctagcaggtagtggattcatgtcaatccagccatctccagaggatgctgagggctaccagtctcacatgacagctttcactggctggttgctgctgaactgctgaactgcgagttaacttcagggaccttttgaattgccttcagggtgtggcacaagaatgcagcaagctcaagagattttaaagattcattctccatatgagttggccctagggattcagagagaaactgagatggtggcggtaattctagggccctgtgaaatgtaagctatctataaaatactgatgcaatgtataatgagctattctggtgttagtgcattagtgtgccaatcctggcataataaacacaaaatatttatgaaatgcttaactgacatgtatttgaaatatacaccaaatattggtatcaaaagagggctgatactatgttataggttagttgggtttacataatctttgcttgaacattgttattatgggaagcatggttttaaaggaacagtgacaaacatgttaggtgcttacccgttatctgttttcttccattgtttagctgaagacaatgtaagacttttatgaccttcctgttccttactttctcagccatgagttcccattctgaccaatgaggtctaaggtccaagggctatggtagttcttggaaaagcctttacattcttggtaaacatgaacacacattgtcggcttagccaatctggtcatctttgctttcatctgtttgttgtttcatttagaagttgaattaatgagtacaaatccctcatacttccggctatgggaggtaaataaactcttagttatttaaggcattttaaaatcatggttgcaaaatggctgccacgccttttaggtatcacatttttccttgggttaaaaacaaagcccatcatgactgacgtccttttagatgtcactggccataactggttcacatagctagaaaagcagggcacaaacatagaaagtgccggtatccctgttgtcttcatttagtagttgaatctgtgagttcaactgcctacctctgaactttcattatttgtttaaagcattgtaataatactgttgctattttcagctgaacatgtgacaaaataagtagaatttggagggaggagaatatttgaaagttaggaagagtatgactgaaggatgagctaatgagtagattgtcttaagtggatcaactgttctctaaagtagtggaaagtcagttattaaatccataaaaggctttatcataaaatgaaaatctattctagcattattgtaagtattaataaaattactatgtaaaacattttgctagtccatttattatgttttctaaaagtattttctcaaccagtatttaggaaacatttctaactatgtaaacaactctttttttttttttttttttctgagacggagtctcgttctgtcgcccaggcgggagtgctgtggcgcgatctccgctcactgcaagctccgccttccgggttcacgccattctcctgcctcagcctcccgagtagctgggactacagtaaacaactcttatatagacaaactggtagaaggtagaggataaataatccaaaatgctaatcttaaaatgtctgtgtttgtattaagcaatcaggaaacattttgcagcatatctacttgctctgaactgaatggaagggccccagagctgcagcagtaaggttaatttattcacggattattaattattaattattatatgtgactctgtagtaacccaccatttataaaaaattgctttctgtttaaatttaggttagatacattgataaataacaattagagaacatattttacacatccaaccttaagggttcttattgttctttaaaactgattattataagatgtttggagcaagatttggcctaaaggccaattaatttgaaatacctcactaaaccaaagaagagttgatttagaaatggccaatttcatgtctaataagctactatcctaagtaaaaaaaaaaaatcagtctgttgtgtcaaaatgctttttttctcattcagattcatactggtgactatttcattattgcagaggagcccaatgtgggtgaaatgttacaaatactaacagtgaagaaatctggttctcttaagtctgtgtttttggctgaagctacaaagtttcccagtggtgtctgttacaaagtaacatgcaggacttggcagccagttacagataacaagacttccatcccgaagactgtccaagccacatgctaaattttgcccatctgtcaccagtctcctctgtcccatgtcagagtcaaatttggaaactggtgacattggaggtacttgttatgcctggcagaacaaaacccaaaggtcttattgctcatgacagttcagatgtacttgaacagtaattactgttcatatggagttctttgccatgttcttctgtttcatgacttcccatcttcctttagatggtcccagtatacagggtactgaatattagaagcagcaagaaatggtaccacaaattattttttttaaatttattttatgtgaaagtcaaagaatgctagtacaaacctaacatttgatggacatgtttgttgcatattacccagctaggtaaggctaagtaatacagaattaataactatattttcagagaaatattatttaacatattttagttttatgagtatataattgaaaacatcacattaaaagttattaatttacacacaatatgaatgaatctcagaaacaaaatgttgaataaaagaagccagacacaaaaaagtacatacagtatgattttactcacataaagttcaaaaacaggcaaaactagtgtgtgttctaaaacaatagggtagtgattacccttgggatagtacttgaaagtggggcaaagtaggggcttccgctacgtgagtaacattctctttcttgctctagctaaaggttacctgacacatttatactgtggaaattgatcccactgcacgttgatagtttgtatactttgtttgaatatcattcttcaattgaaaaagtaaaagaagaattaacttgtaaagtaaaataacagttactttagaaaacacaaaaccactataaaaattatttttcaacataattcagaattattaatgataatgataattatttatggaacacatctgtgttagacatggttctaagtgtttgaattacgttactttccttagtgattacaccatcttagaggtgttgttttttgttctgtttgttaaagaggaattgggatttgggatttagagaaattaagcagcttgctcaaggccacgtctcaagttaggaattgtgtgtaaatttgaacatttgtttgtttaacttcagcaaggaggagaagctttcgcactgtgccacgtgcttccactaaccatcacagttgcacattgagacaaattaatttcagactctggactgaattttcattttgaggatgagcagttttcttcttagattgaagtttccgtttccatgataatcaatgattgttattataaactttatcctcagtctgtactggggttttatatagctcaagagggaatcaaatataaagcagcaatagttgtttaaaactaaagtttggaaaggccaaaaaagattaatagtctttcatagacaatcccaatgggtaaagttggggatattttgatttggcagcctcatatattttttcttattttaggaagctgcttcctagtattggcctttgtacttctaaaacttttggttgagagaaaaaaaatggaagatggtaagataaaattccatgaatttaagaacagtgattttaaatttattagggctatattgcataattagattttaagaacctgagagtgtaatgaaccacattttatttctcattagaaaactgatttcttcccattggccatacacaagtcctggtgaaggagtaagtgctagggaaaaagggatataaggtagatgggtctataccttggggaagacaggcattaacttttgtgcaaatcagaattgcaagttaaagaagtgaaacattaatgttgtatagtttgaaaagcactgcgtcatctcattttaccctcgtgattctgagatcagtatcattgttacgtccattttacagattaggaatctgaggctcagaggccaattagcacaaacacatttacccagtaggtaacagaccgtgggaatgaaggggaggaaaattaattattgctagataaactaggaaggctttataaagaaatgcatgattaggtgcttcaggaacaagtcagatttaaacacaagaaagtaagggaagggcactgtggtttgaatgagctgtgagagccaaaactctaaatgcaggagaaagcatgtctcttctggtctatggtcaggcatttactgtgggtgaaaaacagatttcagagccatcatagtttggctggcaataaaattattttgtgagcacatcatggaggcctggttctgtaggctctagaaggagagactcttgtgtgtgtgagaaaacaccaatattgtgggtgggtacaataagtaaagagatagaagaaaagaaaccaggtagtgagttatgacaatagtgtaatgtgggcttcaattagggtgaagtggtagaaacaggaaaagaaaaggtggagggaagattgaagggcactccagtggtcattgtttcctaaggaggcccagtagtgctgcctttatataactttctatttgattaccatcacagaggaatcctgaggaatctcataaaaaattttcattataactctatttactcactattttgggaagataggggaaatgtattaaaattacagcaagagtaaatgcggtacttttcacttattcagattattttttattttatatagatacattatgaaatccaagtttgaattgtaaagctttggctttttgaagcttttgaagtaaatgtgacttgctgtattacacacagctatgacttcctatatttctagcttgtgcacctagcatatttgatagagcagatttttttaaatatcctctcttctatataacaagattactttttagtaatagggtaatatcagtaatattattactttttgatttgttctttaggttcaaaacaacaatgaaattagagtacattttaattttaaggtttaattcaaatattataaattgttctacaaatgcaataaaattaatagtaagcaaatgaaaatgttacaccttagaatttgtactgtttcattgatttaaatacaaataaaattccaagtaggctcataggatgacagaattaaggtaatttaagttctgattcttctttacaaagactgcactactattgcttattttgaaacagatagtactacatgtgttagagacacaaattgcagccaaagcaaactcagatgactctgaactattataaaaattacacttgttggctgggcatggtggcttacgcctgtggtcccagcactttgggaggctgaggtgggtggatcacttgtggtcaggagtttgagaccaggctggccaacatggcgaaaccctgtctcttctaaaaatacaaaaaaattagccaggcatggtggtgcacacctgtaatcccaggtactcaggaggctgaggcaagggaattgcttgaacccgagaaacagaggttgcagtgagctgagattgtaccatggcactctagcctgggaaacagagggagacattgtcttaaaaaaaaaaaattacacttgtaatgagtatgtgtagtttagttcttatctattagagattaggtcttatctattagaaataagtggaagttaattgtatgttggttgttctccaaacttccatgcagaataccatgtttatgaaagggtgcataattgccaatttggaactcatgtgtagtattaaactcaataataactatatagttgtttagacattagaccagtaaaatatttttaggatgttttgtcattgaaatttggtgggtatgtggtgatcataaaaagctaatgaacatattatcagccttatgaatggttttggattatctgcaggcagtgcactccttaattgcctgtgcctggaaaagactgcttcctctgccctacctttgtctgcctaatgcactgccttgactaacaccttttttcttgtgaaatgactttttccttcaccctgccttctgacatatgtcttcattacccttccattctcaatcagataccacctacattatttgatttccatgactgaatgctgtctccttcctttgaactcacagtgtactattttcattactctatagaccacctagtaatattaactttgcaaggatcgttgctgagagtacagtcgtacttatttttcatttttcagcacctagaattgaacacttattatcaatcagccaaaccagtctgtacacacttgatattgcttaaaccaaaaggaaactattacagtgaccccatttgtttttgctttgtcgtcgttgttatagagacttaaaaataggatttgggggatattacgtgaaagcctttaactcaatatgcatacttaatttcatatttggttctggaaaagtctaaacttctttaacatttctatcttcctccagaacaacatccagcctcactgctcttctcttactatcttactaatgtctgcaatttttcttctacatatatttttaaagtgctgtgaattagtttttttacactcagtgtctagtaagaattaccagtagattttggccgggcatggtggctcatgcctataatcccagtactttgggaggccgaggtgggcggatcacaaggtcaggagttcaacaccagcctgaccaacatggtgaaaccctatctctactaaaaaatacaaaaaaaattatctgggcatgatggcacgtgcctgtaatcacagctactcaggaggctgagggaggagaatcacttcaacccaggaggaggttgcagtgagctgagatactgccattgcactccagcctgggcgacagagcgagactccatctcaaaaaaaaaaaaaaaaaaaaaaagaattaccagtagattttataattacttttgtcactgttttatacatttcatttcttctttccgtgtttttttttttacttcttctttccatggtttttttttttttcttcctgaagaatgtcctttagtaattcttgcagggagtatctattgccagtgaacactccttagttgcatgtatggagggttctttgtcttatcatcactgatgaaacttagtttagctgggggcagaaaattttagactgttagttactacttctcagcatttttgaatattctggctgctgttgtagttgatgagatatatgctgccagtttaagcatcagttgccaatagataatttatcttttgtcttaggaggcttttaaagttttctctttatccttaatgcattctagttttattgtaatgcatttaaatatgaatttacttttaatttatctggctttcttccagcttttgctttctgtctgagaatacatttttctttttctttttctttttctttttcttttttttttttttgagacagagtcttgctctgtccccaaggctggagtgcagtagggtgatcttggctcactgcaaactctgcctcccaggttcaagcgattctcctacctcagcctcctgagtaggtggggttacaggcgtgtgccaccatgcccagctaatttttgtatttttagtagagatgttgtttcaccatgttggccaggctggtcttgaactcctgacctcaaaatctgcacgcttcagcctcccaaagtgctgggattacaggcgtgaaccaccgtgcccggccacattttatttcagttcttaaaaattcttaggcatcattatgattctttttaaaaatattggtttttcaccattctctcaacttgctacttctggaactcctgttagtgatgtgtgggagcagagagacattagtagtgctcaccaatattggaatagttattccttcaaggacatatgtgtgactatacctcttaggcccttgcagttaagcagagctatgtaactaattatggacaataaaatgtgagagaagtgatgtgtgttattgccaagttgaagcaaggaaaagcccctgcgcaactctctagtctctcttttcttctgctttagcaattacgacagagggcctgaatgaatggtaaacttctatgaagatactgatatttgggaatatttgctactgcaatgttgactctcttatcctgagtaaaatagaaagcctctcaagctaatccgcatgttacctaaaattctcttacatagttgtcatttacttgtttctctggtataatctttcagttcagtaattttttctttagctgtgttcagctcaggattagtctcttttccagttttaattttagttatggtaattttctttctagcatttataactccatcataaccacattctcagtttataataataatttacagtcttttatacttgaattatgttatttctatttatttctacaagtattttatacagttatttgtacattgttttcagatttttattatttgcatttccccaaaatgaactctctcaattgtttagaatgtgagctgtattttgtggcattttcctcatatgagattaaatttttgtttgctaattccttttgagtaacagatttttagttgtggttcttgttgctcttgtttgttttgtatttcttttctcctggaggttctatatattgcctactagttttaccattacctgcatccagctcctctctattcagaactaggccatgcactggcattttgggtctccagtctggcaggggtactgatattttacaagtcttgtggctaactcagagaataacaggacccagaacgagaagtaatcttggctccaattgctgccctgactgcagcttgacatagtctcagccctgggtaatagttactattttttgtcgaggctcctctcataaatcagggaaactaaacccaacctctggttttacatcctgagtctagcccctatctcttgacacagacggagcactttgagttcctgttattctcctccctcaccccattttgaaatttcttatttccagtccaagagcctagtaagttatactgctgttttgcatttctgttatagaatgttgatcttgtttctgagttcagttgtctttttcaatattatacataatatacataaatatataaatatctgtctgtatgtgtatatgtgtgcatgtttcattgctttggatctgaaggggagggaatgagtgtttatacttgcactcaaaattccatcttaataaggagtcaaagtctaattcaaatgaggttagttctctggctcatgatatggtgatccttcttttattaccaattacagatacttcattttgattgagttcccttccaggggatttcacttaattttttaaagattctctgagaaatgaggagtgttttggtgtgcattgaggcaaatgattgagtctgaaaggccatcatagtagcctcatgagaatcattaaaagcacctaccactcaactttgtcctttgctaaagcaaatgggtatatggattaactcagcatttaagtcttcctatactttttgacccttcatttagtagtagaattaatcataacttaagagaaagataaatgaagagatgtgagaacatcaggagtaaaatcacttaataaaatcttggtggagctagtgaagattatgacacattcattttctgtgttactgtgggtaggatgaaatcagattttattttattgtatatgggtgccactctctgaggttgcatagaatataaaatgcagtgtttttcaaaggagtgtccacggagatagaacaatgttttagtttcaagattagcttttcttttatctgtcttttgctgagtgtttactaacacacatgtgtctactttgggaatattttatagggaatcataacatctaaaacaatttcagggataatttttcacattgtcacagaatacctttttttactaaaacactttaaaaaaataagctgtctggccgggtgtggtggcttgctcctgtaatcccagcagtttggtagactgaggtgggtggatcacctgaggtcaggagttcgagaccagcctggccaacatggtgaaaccctgtctctattaaaaaaacaaaaattagctggctgtggtggcgggcacagtaatcccagctaattggaggctgaggcaggagaatcacttgaacctggaagacagaggttgcagtgagccgagatcatgccaccgcattccagcctggcagcagagtgagagtctgtcaaaaaaaaaaaaatgcatttacttgctattacattattccttctttatctaaaaaaaaatactttacaatggataatcattttgtggaaatagttttaaaacatatggcttacattttacctctgtactgagttgaatagtgtttccacaaacttcatgtctacccagaacctgtgacttatttggaaatgaggtgtttgcagatgtattcaaattaaaatgaggtcataccttattagagtgagtactaattcagtgatcagtaggaacagggaaatttggatacagacacagacagaggagagtgacatgtgaagaaagggacagattggagtgatgtatatacaggccaaggaatgcctaagattgctagcaatcatcagaagctaggatagaggcatggaaaaggttttctctcagaggctccggaaggaaccaaccctgctgatgccttggttttggacttctagctaccagaactgtgagagaataaatttctgctgtcttaagcctcccagtttgcagcacttttgttgtggaaaccctaggaaactaatataccattttacacaacatattctaaatgtaatgcaacttttatctatgttataaacaatttctgctttgttatcatgccatgatgttgtaaggaacctttgaagtgcattgcattggatttaccttgcccttaaagaaagtaaacaaggtaattttgctgtccttgctgggcattctgttgtcttgtcaacagctattacgtttctttatatagctttccctttttcttcctttgtgtctatgcagctgttgcactccaagaactgaaggtttccaggagaaaagagaaacccaaccaaccaaagtttactaaatcagttattgaatttcacctgcaattcttagtctatgggctcaagtttgagagtcgttggtttcctaatgtatattggccatagttgctctgggaaaaatggtgggtggtggtggtaatgcttactgtcaaaaacagattgggaaatgctgcctatggcacttctcctgtggcaaatttatactcttacaagatatattcaagactttcagaagttttaatgtaacaaaccttatttaaactaacacttgacaccagaaccctttctttgttgtcatctattaatatctcatgattctacagaaatcactttgaggaacacatttaaagagaaaaatgtctgttccttactaagcagttttctctaagctcacagctgacacattttttggggctttcaactcagactttgttttgaatatttgaggttaccaaaagcaggagggtcagaaacatgatgagttattctaatttgtttttaacagtaattaatcttcctaaagtactctttatttagataggattttgtttgttgtttctttggggccattttgtatgtattttcctgtcacaatctaggtgctaagaaagattaaataaacttctgtttggaaaattctgtgtaaaactgaagtcaaaaacagataagcagacattagagttggactacctgttttctatctgtatatttagtccttcacatttcccatggtgtcttgtttttgagttaattatgtggcatcatgtcatatatctaattattttaattcagaaaccaaacagggttgctgaagtagtgctgctgctagtctcttgaggagtgggaacaagttattcatgcattcagtcaaacagcctgataaaccatcttcgtgtcaagtgttgatctaggtgctggggatacagcaagtgacaaaacatgcaaattcctggctctataatagcacatatccaagtatggagagaccaaaaataaatgatacaccagtaagattgctagtacgagttggttataagcattatgaagaaaaataaagtaggcctgggcaagaggaatacaggtgagagtgagtgaaagtttgccatttgaatgatgatggtcagaaaaggtatcgctgagatggtaaaatgtgacaagacacccaaagaaggaagggaataatccatgtggcttggagtgagacagtgttctagaaggagggaacaaccaatgcgaaggctcagaagcaggagtgtctgtggttgacttagtaacagcacaggctagtatctatagagcagaagggatgggggtgaagaggtggggtcattgtgggggcctttaaggcctctctaaaaatttttgcttctcccttgagtggcataggaagtcattggaggactgtgaactgagaaatgatatgatctagctaacatttttacaggagtataatgaccgttaggttgttgccaccaggctcaaataccaccactcataaaggcatttttgaaatagactgaggtaattcctcacggaggggaactgctactgtcaaacagatgtcatcagaactataagaatatattagactctttcaacatcgagaaaatgatcaggaattgtaaggagtcactatggtgggaattttttttttttttaatttgagttgagaacctgtctgtattctttttttaccaaaaaaataaagacttgctcaagaaagacatgtgtccctatcagttctaaaaatatcatatctgctctgatggttaattgctgccagattaaaaaaattcttattaaaacaagttttatgttatgagaattgtaggtgaatttagaagccagagatacaagaatgtcttcagcttgtttgaacgtgttgttgttaaatagaattttgaaaactgatgaatagaataaaaaatttatcctgtttttctcaaactatgtctaagaaccaaataattgattagaaggatagtatttttatagaagtttatcaattagtaaagaactgtggttatatgaactatccattaatgaacctactacttataaaatgtatccccactcaaacatatcttcagtcagatatctgttctgattctaccccattgtgtcaactccctttctgttcgtatatcagtataacatgcttttctaatcagcatgttagatgtggatatattgattagtaaaatgcaaattatttctgaatgaaagtagtaatcacataaaagaaatgggattttataaagttcaaaaaagtggtcctggagaaccatttgagcctttctcaaaattattaataaacagtggtctaacagagttatactagttatcatttgaagaagaaaaccatcatggattatcaaagataatgcttttaaagtgaaagttttgaatgccaaatcaataataatacataataatagttatcaattatttaatgcataccctatgctgagtattgttccaagtgctttctatgcagtctcagttggaatattggtttggctgagtgtggcaaaggatcacaataataggagtttagataagctagaagtttattttttatttttaaagtgtaaactgatagaatggcttggctccgcacagttctgaggcctaggctccttccatgctgttgctttgctttcctagtgtttgactcattggtacaattcaagaactatcactctcttgcatgcacttctcggagtcttagttttcttccctgtaagggtcaaaactggaagttacacatatcacttttgctcatatgccattgttgagtacttagtcacttggccatatctaatttcaaggatggcagggaaatgtagtgtttcttcttggttgccctgtgtccaggtgaccacaggcctagattattttattccgtagtgatagcaatcatattaggtaggtgccattatgatcgctgtattgtaaataagacatcttagacaagaaaaaattttgataattttcacaaagtgagggaattctttaaatgtttcgcaaatatatgacttttgttcttcctttgcacatctaaaggaatgtcagtgtttctcaaaaatttagtggtaaaagaccagggttttttttttgttgttgttctttgtgttttacttaaaccattttatacatatttcaaaaatttataattttttttgtggttacatagtagatgtatgtatttatggggtacatcagatattatgatacaggcatgcaatacatagtaatcacatcatggaaaatgggatctccattccttcatgcatttatcctttgtgttacaaacaatccaattatactctttttttgttcttttaaaatatacaattaaataattattgactatagtcactctttgtgctatcaaatactaggtcttattcattttaactatttttcaccctttagccatccccaccttcccccaccagtcccccactactcttcccagcctctggtaaccatccttctactctttatgtccatgagttcaattgttttgatttttagatcccacaaataagtgagaacgtgtttgtctttctgtgcctggcttatttcacttaacatagtgatatccagttgcatccatgttgacacaaatgacaggatctgattcctttttaatggctgaatagtactccattgtgtataagcatcacattttctttttccattcatatgttgatggacacttaggttgcttccaaattttggttactgtgaacagtgctaaaacaaacatgggtgtgcagatacctctttgatatactgattttctttcttttggatatatacccagcagtgggattgctggagcatatggtagctctatttttagttttttgaggaacctccaaactgttcttcataatggttgtactaatttacattctcaccaacagtgtatgagggttcccttttctccacatccttgccagtattttttattgcttgtcttttggataaaagccattttaactggggtgagatgatatctcattggagttttgatttgtacttctctgaagatcaatgatgttgagaaccttttcataggcctctttgtaacttgtatgtcttcttttgagaaatgtctattcaaatcttatgcccatttttaaatcaaatttttagattttttcctgttgagatgtttgagctccttacatattctggttattgatcccttgtcagaggggtagtttgcacatattttcttccattctgtggattgtgtcttcactttgttgatggttttttggactgtgcagaggcttttgaatttgatgtgatcccatttactcatttccgatttggttgcctgtgcttgtaggatatttctcaaaaaatgtttggccagaccaatgtcctggagagttttccaatgttttcttgtagtagtttcataacttgaggtcttggatttatgtctttaaatcattttaatttgatttttgtatattgtgagagatatcagtgtaattttgttcttctccttatggatatccagttttcccagcatttattaaaaaggctgtcttattcccaatgtatgttcttggcacctttgtcaaaaatgagttaactgtaggtgtgtggattcgtttctgggttctctattctgttccatttgtccatttgtctgtttttatgccaataccatgctgtttggggttactatatctctgtagtataatttgaggtcaggtaatgtgattccttcagtcatgttctttttgctttggccattctgggtcttttgtgattccatattagtcttaggattgttttttctatttctcttgtgaagaatgttattggtattttcatagaaattgcattggatctgtagattgctttgggtagtatggatattttaacagtattgattcttctgatccataaatatagaatatctttccaatttttggtgaactcttcaacttctttcatcagcctttcacggttttcattgtagagatccttcacttttttgcttaacttaattcctaggtatttaattttatttgtggctactgtaaattgaattacttttttatttcctttttacattgttcactgttggcatatagaaattttactaatttttgtatattgattttgtatcctgcaactttgctgaattttttatcagttccaatggtttttttgcgggatttttagattttttccaaatgtaagattatatctgcaaacagggatcatttaacttcttcctttacaacttagatgttcttatttccttctcttgtctgattgctttagttagaacttccagtaatatgttgactaacagttgtcaaaagtgagcattcttttcatattccagttcttgaaggaaagactttcaatttttcctcattcagtgtgataatagctgtgggtctttcatatatgacttttattatgttgaggtatgtttctcctatacccagttttttatttttgagggcttttatcatgaaggatgttgaattttatcaactgctttcagcatcaattgaaatgatcatatggtttttgtccttcattctgttgatatgatgtatcacattgattgaattgcatatgttcaatcatccttatgtccctggggtaagtcccacttggtcatgataaatgatttttctaatgttttgatgaatttggtttctagtattttgttgaggatttttgcattactattcatcagaaattttggcttgtagttttctttttttttgctgtatctttatctggttttggtaccaaggtaagagtggcctcatagaattagtttggaagcattctttcctgctttgtttttcagaacagtttgagtgggattggtattctttaaatgtttggcagagttcagcagtgaagccatcaggtcttgggcttttcattactagaagactttttattatgacttcaatctcgttactggtctgttcaggttttggatttcttcatggttcaatcttgataggttgtatgtctctaggaatttatccatttcctggagattttccaatttattggcatatagttgccatagtagccactaatgatactttgaatttctgcagtatcagttgtaatgtcttctttttcatctctgattttatttatgtgggtcttttccattgtttttcttagtctgactaatagtttgtcaatcttgatctttcttttttttttttttttttgtttttggagatggagtctttctctgttgcccaggctggagtgcgatggcatggtctcagctcactgcaatctctgcctccctggttcaagcgattctcctgcttcagcctcccgagtagttgggattacaggtgcccactggcacgcctggctaatttttgtatttttagtagagatggggtttcaccatgttggccaggctggtcttgaactcctgacctcaggtgatccacctgcctcggcctcccaaagtgctgggatttagaggcatgagccaccgtgcccggccaattttgatcttttcaaaacaccaactttttgtttcattgatcttttatattgtgttattcatttcaaatacgtttatttctgctctaatttttattatttcttttcttttacaaattgtgagttcagcttgcttttgttatttttaattctttaagatgcatttttaggttatctatttgaatgttttcttcttttttgatgtgggcactaatagctataaatttcccttttactacttctttcactgtatcccataggttttggtttttgatacttctgttaccatttatttcaataactttttcaattttcttaatttcttccttgatccactagtcattctggagcatattgtttaatttccatgtatttgcatggtttgcaaaattcctcattattgatttctagttttattccattatggtcagagaagatgtttgacattacttcagtttttttgaatgttttaagacttattttgtgacctaacatacagtctgtccttgagcatgatcgatatgctgaggagaagaatgtgacttctgtagtggttgcatgacacattctattaatatctgttagaaccatttgttctatactgcagattaagtctactgtttcttcgttgattttctgtctagaagatctgtccaatgctgaaagtggagtgttggagtctccagctgttattgtatcgaggtctatctctctctttagtgctaataatatttgctttatatatctgtgtgccccattgttgggtgcatatatatttaaaattattatatcctcctgcttaattgacccctttattattatataatgaccttctttgtctcacagttgtcttgaaatctattttgtctgatataagtatagctatttttgtcctttttggattgcattgtcatggaatatcttttttcatttctttaatttttaacctgtgtgtatctttagaggtaaagtgtatttcttgtagacaacggatcattggatcttgtttcttcattcagccattctacagcttttgattggagagtttagcccatttaccttcaatgttattattgataagtagggagttaccttgccttgccattttgttatttgttttcttttttttttttttttttttgtggtcttctctttcttctttccctgtcttacttttagtgaaggtgattttctctggttgtatgatataatttctttaattttttgcttgtctattgcatcgtttttgatttgaggttaccattaggcttgcaaatactgtcctgtaacctatgattttaaactgatgaccacttaacactgatcacataaacacacaaaagaaaaactaataaaatgctacactttaacttttttccctactttttaactttttgttgtttctgtttctgtcttattgcactacgtcttgaaaaattgttgtagttatttttttttattggttcatcatctagtctttctacttaagagtggtttacataccataattacagtgtgataataatctgtgtttttctgtatgtttactattaccaatgagttttgtacgttcagatgatttcttcttgttgattaacatccttttattacagaatgaagaactttctttagcatttcttgtaggataggtcttgtattgatgaaatccctcagcttttgtttgtctgggaaggtctttatttctccttcattattaaaggttattttctctggatatactatatacagtaaaagttattttcctgcaacagtttaaatatgtcacgccactctttcctggtcttaaggtttccactgaaaagtctcctgtcacatgtattggcactccattttacgttatttgtttcttttctctcactgcttttaggatcttttctttatgcttaacctttgggactttcattattaaatgtcttgaggtagtcttctttgggttaaatctgcctggtgttctataaccttcttctactttgatattgatatctttccctaggtttgggaagttctccattattaccccttttaataaactttctaccccatatctttctctacctccttgttgtatcaaataactcttagatttggttatttgaggctattttctagatcatgcaggtgtgactttttgttttttttgttatttaagttctaggctacatgtgcacaatgtgcaggtttgttacatatgtatacatgtgccatattgatgtgtttttaattctttttttcttttttgtctcctctgactgtactttcaaatagctggtcttcatgctcattagttcttctgctttatcaattctgctattaagagtctctgatgtattcttcagcatgtcagttccatttttcaactctagcattccttcttaattctttttaattgtttcaatctctttgttaattttatctgatacaattctgaattccttctctgtgtgattttgaatttctttgagttttttcaaatagctattttgagttctctgtctgaaaggtcacatatctctgtttctccaggattggtccctggtgccttctttagctcatttggtgaagccatgttttcctggatgttcttgatgcttatagatgttctttggtgtctgaacattgaagatatttattatagtgtttgcagtctgggcttattttcatctgtccttcttggtatggctttccaggtatttgaagagacttgggccctaagcccaataatactgtggtttttgtagactcatagaagtatcaccttggtggtcttggataagattcagaagaattctctggattaccaggcagagactattattcttttcctttaattcctcccatacatttggaatttctctggctaagccatctggaactaggggtgtggtcatgcaagcaccatatggccaccaccatttggactgtgtttggtcagacctgaagccagcacagcactggctgtcacgcaaggcctactgtaaccactgcctggctaccacctatgttcaatcagtaccctagggtggatccacatgcaccctcccttcccaggcgctggctgagcccagcatgattttgctctttgatgtgactaaggtcctatgatcagcaggtagcaaagccagccaggtttatgtccttcctttcaggacagtgagttctcctatggcccaggaaggtccatagatactatctgggagctagagattagagtcaaaaaccttagaaatttagcttatgttctattctactgtggctaacctggtactcataccacaatacaaagattttcctgctgttcctttacctttcaataggcagagagcctctccctgtggccactatcaccacagcccacagggggttctgccaggccactgctgatgttcacttaaagtccaagggctcttcagtcagcctgtagtgattgcttccagacctggaactcgtccttcagggcactgggctcccctctggcctgggctcatccagaaattgttccaagagcctaggtctggacttggggactccaaaagcctgcttgttgctctacctcactatggccaagctggtacataaggtgtaagacaaagtcccttttacttcactatagccaccacagctgggaatgtactgcatggcatctaaagccagcacatctcagagcccaaggcccatagtatattaccttggtattgccaccggttattcagagcccaagggctccttagtcagcaggtgatgaatctcaccaggactgggtccttcccttcaaggcagtgggttcccttctgtcccatagtgtttctagaaatgtcatctgtaagctggggcctggattggaggcctcatgactctgcccagtgccctatcctcctatggctgagctggtacccaagatgcaagacaaagtcatctttattcttcattctcctctcattaagcagaaggaaggagtcacttttgtagcttccagctgcactgcctggggttgaaggagaggtggcacaagcactcccttggccaccctggctggagtcttcctaggtcatgtgctaccctagtccactggttctaagcccagcccagcactaggagttgcctaggaattataattctatatagtactatatagtatttgtgtcctagactgccttttgagcttacctatgaccccagaatgctttggcccatgttggcaaggcttaccaagaaactcaagttcatatgcctgggaagggcaactttcttctggctagggtgtgttcgaatgttccctccttgttcaggccctggctgagcccagcatggttttgctgtctgcgtgaaacagcagcactgagttcaatgtaagtcccccattcagtgcgctctcccttccccaagagcacagactctctctgtgctacagggctgctgctgggaggtgggagaggggtggcgtctgcgattcaagcctgtctctcctaccttcttaaatgcctctttccacgacgtgaagtaaaaccaggtattgtgatagctcacttatttttgggtcctgtgatggtgcttttctgtgtgcagatagttgttaaaatttggtcttcctgtgggggatgggggaacgaatggtataggcttctattttgccatcttgtgctgccctcctagactgatatttttgtaaatttctgtagatatagcaattgctgtaaaagtttctaaaccacctacttttgtttatgtacatatcttgttgtagaccagggaaactagtttgtgtactggcaccacttcttagatcctattctatcctatttgtatagctgggaattaagctgtatagttttaacaatcagctttattagaaaaaaattatactgcctcttatgcctgacatgcttatttgatccaatcttttttgcttcaaaaactgtaattgcacagctgcaattataactaatatacatgtgtatgtatgtgtgtgtgtgtgtgttaaagggtaattattttcataattttcagttttacctgtcaaaaattttaattttactacttacatagaaagcttagacttcattgtatttgcattttctatcagttagctttttataaaatactaattatcctcagggactgctttatgtacatttccaagtatactcaaaccttcttgtagtcatgagagctgtgagatcccttaatttccaaaaataatttgattatacttacactaaaagacacatgtcaatatgtttatcaaatacacataggaaaaattcaataaattttttgcaggatgggtagcagatatagctatcatctaggatagttaacgccatctcatgtcatatgtaaattctccattggttgtggatacctgctcaactggttgcggatacctggaatatcatgttgagaaagatcttgagtccaagtaggttcagctaggaaagcttgtcatgtgtgattaatgatgtctagaagaggagcaggtgaggaggcatgaattctatgtattttcctctattaagtattatgcttgttctgagcttccagcagcaaaggaaaagcattaaacatggtggattatgttcattatctaatgaaaataaacattcacatttgtaagaaagatagatgttttccttgttctaaattctaaaatgaatttgtttttctagatggaaggaacattgtaaaatatgatgagttggtatttttcattgattcagtaggtatataacaatggttttcagtagatatacaaactgtgatataccactttaaaaaatatcaatccttgataatctaagaccatatcagaaggaagaaacaaggattatttttatgagaattttcaaaaatattacattgtacttgtaaatagtgacaaagaaagctagaatatatttacagaaattcaactaatcaatctgtcagaccctctttttctctatacaaacttataggtttataggttcttttattttttttcaaatcctttcgtttttcttctctgaccaaaaagatgatgtacattatactgaagagaaagacactcagcaatgaagtatggatttggatataacagggagattaaacggtcctgaaaggtgatatatgccaacttccaaattataactagtgttctaacagtggtgttgacaacctgtgactatggcagaagcagcatggagatgatttttaataattcatgaaggcagaagatataattgtgtagccagggtgctctgctgctttcttctctaggcacctttcccacttcccaccacctcttctttttcttcagatactcatgcgctttattttgtcccttgtcaacattttctacccctctctctatttctgcccttctcagaagtatacagttttcgagtttagtaggagcagatttgatgatgatctctaatcttgttattttttcagttggcaaaactgagtttaagctgttaactgtttaaggtattacctctcactagtgaaaccttagtaatgtttcaagctcaaaataatccctttttatttgatttttgttaggttttgaagggaaggtgagtgttaaagacacacacacacacacacacaccaacacacagaaagagggcggcttaacagcaaatgcaggctttatgctcagcataaaacctacagaagtggagcaccagcctaatgccagagcccacagttggttacaggctgggggtacttattggtatgggctgcccggcaggatattgataagatgttcccatgatgaggcggttctggcccttgttccagggggatgccatcctggtgctccaagcctttgtccagcaagatatgatagggatgtttctttagttcggcctttgtccaccttgtggtcaggtggttaggcaggatctttctcatgactcgaacccctgtgaaatatttcactttgaccaaggtataaaaaatagcagggagcttacaaaatggtgcagtttggtctaacagttttatctatcaaaatttaaaactatcagtattattcatacaataaataacactattataaataactcttagtaggtaaatgcattttaattactgttggtgggagtgtaaattagttcaaccattatggaaggatctagaactagaaatactgtttgacccagcaatcccattattgggtatatacccaaaggattataaatcatgctactataaagacacatgcacatgtatgtttattgtggcactattcacaataacaaagacttggaaccaacccaaatgtccatcaatgatacactggattaagaaaatgtggcacatatacaccatggaatagtatgcagccataaaaaaaggatgagttcatgtcctttgcagggacatggatgaagctaggaaccattctcagcaagctatcacaaggacagaaaaccaaacaccacatgttctcactcataggtgggaattgaacaatgcttggatgcagggctgggaacatcacacactggggcctgttgagagggggtagttgggggagggatagcattaggagaatgtaaatgacaagttgatgggtgcagcaaaccaacatggcacatgtatacctatgtaacaaacctgcacgttgtgcacatgtaccctagaacttaaaacaaacaaaaacaaacattaattgtagagatttccacttctggtcacagtacagtagcagaaactagatttagggtattatgtgaaacaaccccttcaaagtagacagaatatatgaaacaatagattttaagacaaaaggcatcaggccacgaaacttagtaacctgtgagacagaaggcaaatgaggtattgcctatgattgtcccaggttacagtcttaagagagtttctaggctattgtactgggagggtgaacccagccagcacctgtcagactccctgatttgagaagacagagctgagagtctggggaaactcagtattctagagtttccacgacagagtactagaaaggagagacaactacacagtgagagaatgctggagatcttcagaggatccccctcgggtctccgtactgaccatcaaagtcactgggagaagaataatttgaaaggattaaaaggaatagtgtctgacactcacagggtaaagtgtctgctcctactagccagactgaaaaatttataattagtgagtgatcgggagaatactcagtagtggggaggttggggctagaaaatgatacctccaaatgaaggcatcagaagaagtctcagaagcaaagtttctctctgaactcctcttgttctcctgtctctcattctcccttgaggctagccaaacaaaccagaatccctcttctccaaggcaagtcagagacaccagagccccttttcccaaagctattcataaaacctcaaaataaacgttactgtaactttccctccacctttctgtgtaaaagctggtcataaagaaattatctggcctaccatgtttgattgtaagccataggatccccatttcagaatgggtccttccccatacccagaaggaagaaatgcttcagagagagtccccaagaggaatctaaatagataggccttgctgggatttcccctccatctataaacattggctcatatcctttgtgtccaattatatttctacacagctgttcatacttggctgaacctatgcagaaaaatgaacagcttctcctgtgtcttgggccttcattctgaaggcttttctgtcgcataaaattatggttaaataaatttgtaagcattttatcctattaatttgtgtcttgtcagttgattttcagcaaaccttcagagggtgaaagggaagttttccattgccccaacaggaataaatagccctagtagtgctttgaacctatctaataagttataaaagaaaaccagaagggaccaaactgtaaccaagtaactgaacttttcagatgactcagaataactacagaggtaaaccctactgggccataaaacaaatctcaataaatttaaaatgatccaaattcatacaaatatattctcagaccacaatggaaataatgtaaaattagtaacagaaagatatttgaaaaaattccttaaatatttgaaaaccaattataacacacttctaaataacccatgggtcaaataaggaatcaaaaatggaaaataaaaagtagtttgaactaaatacaaatggatatacaacataatcagactttgtgagatgctgctaaagcagtactttgggggaaatttttagcactaaatgcttatattggaaatgaataaagatctctaattagtgacctcagcttccactctaagcaaccagaagataagtacaaattaaaactaagcagaaaaaaggaaatactaaatatcagagaaaaaatcagtaaaacagcaaacaggaaaatagataagatcaatgaaacaaaaaactgggtctttgagaagattaatgaaattgatcaatctctagccagactgataagaaaacaagagagtgaagatgtaaattgccacaatcaaaatgagaaaggtgacattactgtagattctacacctactaaaaagacaagaaaatattgtggggtgggtgtggtggctcatgcctgtaatcccagcactttgggaggccgaggcgggaggattacctgaggtcaagagttcaagaccagcctgaccaacatggtgaaacccccgtctctactaatacattaaaaaaaaaaaaaaaaaagccgggcatgatggcacacacctgtaattccagctactcgggaggttgaggcaagagaattgcttgaacctgggaggcagaggttgcagtgagttgaaattgtgccattgcgttccagcctgagcaacaagagtgaaactctgtctcaaaaaaaaaaaaaaaaatactgtgaataattttatgccaagaaattcaacaacttagatgtaatgagcatattcattgaaagacacaaattaccaaagctcattcaataagaaatcaataacctgaatagcagtgtacttatatataaacaaattgcatttgtagttcaaaatgtccaacaaagaaaactccagacctataaggcttcgctggtaaattctactaaacatttaaggaggaaataatatcaattctataaaaactcttttgtaaaatttaagaaaatacttcccaaatcatgtgaccagcattgtcatggtaccaaaactagataaaaaaattccaagaggaaaaactaactgtagcccaatatccttcattaatattaatgtaaaatctctaaataaatattttagaaaatcaaacaatgtgtacaaaggataatgcgtaatgaccaaatgaggtttatcccaggaatgtagtgtaatatggttatgaactaactaattaacaaattttaaaaaaaacataaaaaagaatgagatcatgtcctttgcggggacatggatggggctggaggccattatccttagcaaactgacacaggaacggaaaacaaaataaatgttcctgttcctacttacaagtggaagctaaatgatgtgaacacatggacacatagaggggaaaaacacactctggggcctataagagggtggagggggcgaggagggagaggatcaggaaaaacaactaatgagtacaaggcttaatacctgggtggtgaagtaatctgtacaacccttatgacacatgtttacctatgtaataaacctgtacattttgcacatgtacccatgaacttaaaagttaaataaaagaaagaaaacatttgatcatctcaataggtacataaaaagcatttgacaaatttagtattcttttaaaattgtatttatttttaaaattatttttccataagttattggggtacaggtggtatttggttacatgagtaagttctttagtggtgatttgtgagattttggtgcacccatcacccaagaggtatacactgcactatatttgtagtctttgatccctcactcccctcccactcttccccccaagtccccaaagtccattgtatcattcttagcctttgcatccttatagtttatctctcacatatcattaagaacatatgatattaggttttccattcttgagttgcttcacttagaataatagtctccaatctcatccaggtcgctgctaatgctgtcaattcattcatttttatggctgagtagtagtccatcatatatgtatgtatatatatatatatatatatatatatatacacacacacacaccccacacagtttctttatccactagtattccttttgacagaaagtctgagctaagtaggaatagaagagaagctcctcaacttgttacagggcatctacaaaaaaacccttatagctgatatcataattaatggtgaaaatagtgaatttttcctagtataatgaggaacaagagaagaatgtatactctcactacttctattaaacattatacagaggttctggcaagtaaaattaggcaaaaaaaagaaattaaagttgttttgattggaaaagaagtaaaactgtctttatttgcagatggctgattgtcaaaaatctgataaaatctgtaaaaaagatactgggactaataaatttagcatgttggcaagacataagacaaatattaaaaattaaatatatttttatatactagcaacaaataatatttaaactcacaaagcaatatcacaatagagagaaaaggtatggaatagtttgggataaatctgataaaatatttgaaagaattgtatgctgaaaattgcaaaacactactgacagaaataaagccctaagtccacggggaatatatgtcaggatcatgggttagaagatacaatattgttaaaagccatttctccccaaattgtagatttaatacagtcctacccaaaaactcagcatctaattttttggtagaaattgattaacttattctaaaaatcatgtggaaatgtaaaggacccagaatagtcaaaacaactttgcagtaggagacacgttagagcactaacattacctgatatcaaagcttacaaatctacaacaatcaagaaagtacggtgttggcataacaatagataaatatatcaatggaacagaagaagagagcccagaaatagacttactcatgcacacatagactgctgaatttctacaaagctgcaaagccaattcagtgggtagttctgctgttgtttttcaacaaatgatgctaaaattattggatgtccataggcagcaaaaaggaatgcaacagaaaatatgtaatttaaaacagatcatagatctaaatgtaaaacaaaaactatgaaagttttttgaaggagacataaaagaatctttgtgatattgggctaggcaaagatttcttacatgtgatgtcaaaagtacaatccttaaagcaaattgataaaacttggccaaaattaaaaatttctgctcttggaaatagattgttaagggaataaaaataagctacaaaatgggataattttacaaagcatacatctgataaaggatatgtattctggacacatgaagaaccatcagaattcaaaaagaaaacaactcaatttcaaaaataggcaaaaattaaaaaataatgaaatcctgtcatttgcagcaacatggatgagcttagaggacattactttaagtaaaataagccaggcacagaaaagcaaatatcacatgttctcgctgatatgtgggagctaaaaatgtggatcatatggaggtagagagtaggattgtggttactagacttgggaagagtagtgggaaatagaggatgaaaagagattggtttttaggtacaacaatacagttaaatagaaggagtaagttctagtggtgttcaatagcacagtaggaggactacttaaaaataacttattgtatatttccaaatagtgagaagagaagatttggaatgttcccaacatgaagagatggtaaatgtttgaggtgatatcccaattactccaatttgatcattacacgttgtatataggtatcaaaatgtcatatgtaacccataaatatatacaatcattatgtgtcaataaaaaaataggcatatcacgaaagaagatatttgatggcaaataagcgtgtgaaaaggtgctcaacattttaaggctttgaagaaatgcaatttaaaacactaaggaaatatagctacacgtctactggaatgtctacaatttgaaaagctgatcatattggcaagaatatagagagactagaactttcatactctgcttgtggaaatgtaaaacggtaaaaccactttgcaaacagtttggcagtttcttaagaattgaagcacatgcttatgttgctctgccatttctctcctgggtaaacacccaggagaaatggaagcatacatttgtacaaagatttgtacatgaatgttcatagcagctttatttgtaatagccgtaattggaaaaaaaaacactaatgttcatgaacaagtgaattgataaacaatctgtgatatctccatacaatgaaatactactcagcaataaaaaaggaatatactatgtatacacacaacatggatgagtctcaaaacaattatctcaaaaagccagacagaaagaacatagtgaataattccatttttgtagaattataggaaatgtaaataaatatttagtcacagaaaataggtcagtttttgtttggtggtgcttatggggtggcaaggtgtggaggctgggaagggctggagggcaaaattatgaagggtatctaggagactatttggaataatgaatatattcattatgttgattttggtggctgtttcatgggcatgtacatacgtcaaaacttatcaaattatacactacaaatatctgtggtttcctgtatatcagtttcacctcaataaagctgttaaaaacgctaattgttttctgctgccctttgccagctcttaggaattatctcccaaccatacaattttagctacaagtaaaatgcataaagatgcataatcaacgttgcttagtactcagcaactgtacactccattgacccctttttcttgtttgcaagtggctctgtaagatcatagaattccacaaagcagtttttaaatgctagcacagatgagattttaagtcaacaacaaccttgctgggtgatccatcatctgacctatgcttgaacaggaaacttacccccttcacaggagtgtattataactttggacagctctcactcttagaaaattggggctactgataggattttacttatatttttactggttgggatgaaaatatatgttgttggaagaagtttttaatattcaaaagcccaaatcttggagtggacaaacttccttaagagcagtagcactgtctactgcagtgatttctcagctgagtccttctttagctactagggcagagaaagggcagtatcaggtgtcagtggcccagtgggtatggcaatgggtacctgatcttcactcatgttttgttcaacataggagtatttttatgttttactgttctgattttatatgtttctcttgacaacatttttttttctttttaaatcactggagtggtggaaagaattttctttgagcagagaggcatggatttacgtatttctcacccattttttagatattttatacattagtaatgttagtaagacagagtgagtgaaatactcaggtattagaatggagagttgctatctcaacatcattgttttcgtattggtttgctgggtattttgttggtataacaaaataccgtaagctggctggcttaaacaacaggaatttattgtgtcacagttctggagactgcaactacaagatggaggtgttggcagctttgatttttgctgaggcccctccctttaatttgcagatggccatcctctcattgtatcctcatgtggtcctccctgatctgtgtgttgtctatgtcctgatctctttttttcttttagaacaatcagattagagctcacccttataatctcctttagccttaattatctctctaaaggctctgtctgctaatagtaattccaaatacttagtctaaaatactgaagattaaaacttcaatatataaattggagggggacaaaattcagcccataacagcttccatttttataaaatgaggacttacctttcaagattcttttcagcaatgataagataatctatgtaaagcactagtaaattatcaggcacatattagggatgcagtagatgataattattctaattgtgaagtaaatatgaatctatgcttatacagataaaatttattttagatcattgatgccctaactataaatgccattttttttctctgtaattttaaacgtgctgagctgtaataggaacctataaagacatcagagaaaaagcaatccaagttacaacacgtatctatttttaacaagcttaaatttggatgtgaatggcaagacttgacttttatttacacagctcatcacttagatgaagaacattatccctcagtgctctagagctgttaaagagaaacccaatgaggagcacaggttatgtagaaattacataatggcagtggtgaccatttgcactgcctccaattctcctcatgttttacctcaattccagaggagaaatgagaatatgcccaactgtgttttaaactatggtcataggaaattcccttgagagaaatttgagaagcctgaaattcaaacacactagtgaaatgcaaatagttttatttattaatggccgctaatggtctgtaataatcacagctgattaagtaaataagcaaatcaattattagaagtgtttgcagaattgaattcacaagttttctaattgttttttctttttatgcatttagccatatctgatcttgaattgagttaaggaaccaagcttcaaaagaatacaatttgaaggagcagaggagtatcctgtaattataaaacatcatgatactctttaaaattctatatgttactcataatttctaagttcaatgatctgtgctgttatattaattaactttcaaaattctaatagctgagcagatcacttgatttcacttgcctacactactttttgttaattaatggaaaccataaattcagagcccttgcaaattgtgctgcttcattgcatttagtgctgttttaatttctactcttaattaaataatgaggctccagagcacattcctaactgtgaggcaaactagactgtgtttctagctgggattccttctagccagcccagtcaatcaatgcatgtcttctgtaatacataggagtttattactcaaccttggaggctcatgtggctcatgtggtgggagacatgctgtaggaaaacccgtctttgttttgatcaagttgccaggattgcattttcatctcccctttcttgctcctacctggactggaaggggtgaattattttattttgttgtgattgatgcaagcctcacttgtatagaaatggagcaatcaggatacagtgtgctcttttccttccttgaaggtgactctctttgttattcattctgaagtaaacaaatatggattgggcgtctacagagtacctaggggctacagcagtgaacaagaagattcctttgagaaagcagataaatctccattcacaccagtttctgagccctgaagtatttcaatagcgagtacctgcactgtattttgagactcttctaacacaaaggaattttaaaaacacaccatttgtaagaagttgtcatagtaaaaaggtgtgatagaagaataataatttaagctgaagttcttataatggataagccaggcttgggttttacttaggctaatggtattaatctgcttctctccttattcataaatacatttcctgtctggatttatcatatttcactttttacttgcagaatctttttttttaattgggttgtttagcatcgaatgaaatagagcatatttttttcatgccataagttattcagctttaccattaggtttagaacatcagttacaacttatttttaagggtgaccaaatcatttatcacacatatgctttactataaaagagaagcacattttccatcattgacaaagtaactcaaggaccagagtaagccagaatatcaggagataccaaatgactatactcggaagcaagaaatacttaatttgactgacctagataattcttaattattcatgaatcatgtttccaatggatgggttatccaatcccttttctccttcctcttgatcctgcccttagccatttaatttctttctggcaaagaaagtgaaatattcaattttatgacttggcccactttaagaaaatatattggttaatcatgattcagaattatatataataaaatattgatgaaaagggattctaaattatatgcaataaatgttattacaatatttcattcactctgacagtgctactgaaaatgtggttcatagatgcttagaacacctatcaaaagaatttgagaggaagtgtttagaaggattgacagcaatttgcctttctcagaaatccacatacatgatcagtaaactcttattgaacaggatagaactacccaagaatcagggtaaacatacaatcagacattagtcttttactacagatagcttaattgctgatataagatgcccttgatttttaaatgtgtcatcaatttttagatacatctcaacattagagatgttaaaatgtggaaaaatacttattttagaattgttgatattaatttattattttatttaccatgagagagttcctttttgcagagggagtaaggatattctgagagtgattattttttttgtggtaattgcaaaagttatatgatatagtagaaagtgagttggctctgacttcaggcagactgccatttactgggtttatgagtttgaacaaggctcacattcctttatggtgaagaggaatgaaaatatatctcagggttgtttagactttcttatctcaatttgactaatggaatagaatatttggaacatgtttcatttaatttacaaaaaccaaatatgtgcagataaaaacacatatatacacatacacagataatttttgatgccttaatagaatataatagtttcaaaatttaccttattatgtagctatgacattttaaatatttatcataggaaaattagactgtaatcatgtgaatagtataaatcaaaagttttagaggtcaagaattacctcctatgcttttattatctgactcccatggtgaataatagctcattgaacagatattggaaatatattaaatttgagtattctgtcaaattagtttttaaattatctgtttaaccaatatatttgatatacatcttctacagaaatatttcacaactcaatattttaaattatttgcaatcatcatatagtcgagttattactaattttttagtgaatttgtattatatttaaaactttaaaatactaatgatcagctaatgaagattatttttggagcataaaatattttctttaagaaaataaaattctaacaaatagtactagataatcatgaccaccatgttcagttagcttttattttgaatagtcattttgtcaacagaattatatgctaacatttgagttcattaagtgagctagacctttattttatattttacttatcttatgcttgatatctattaatgttttgatatcttgaagtgcaatagtagaatattagcacttttttcatctaggttgttaagaaattcaaacttatatttggacataagctaaattggtaaattaacagaaaataaatttattatgtttcctttatatttgttcaaatagttatattaattgacatatacgttagtggcatattatggtgtacagagtattttacacatgttttaaatgctgttactattataaaaatgtattttagaacaataaaataaagaaaattatgattttttaaactcagcaattattttactgtccaatgattgctactgttaacattatgaggtgttttctgtcaggatttaaaaaatatattttaacttaatcagaagtattgtatctttttaaaatattatgtcataacatattcaatttaatgacagtctcttaataaacataattcgtaatatgaatgttaataacatttagaagaccattcacttcttattgaatatatttaggttggttccaatttttccatactataactagtgtactgattacatctgtacatatgctttacgtggtgtcttttgatcaccacaacaactctgtgtggtaggcaagtactggtttatacatttttcttttccgtcacagaactgagaggctaagattccaacccaatgtcacaaaatcaggaagttcaggtgccaactgagaaatccagatatttgatattgtattaattgttctttcttttaaagtgctcccatcattaaaagggtttaagacagagtttgtgcccatagaatatgacaggtgtagctgttgcatctgcatattggcggtggcaatgtcatggagtatgtagcttttttgatgagatctcagagttggtggagcatgtgacatatttgggaataagattgaatacaacataaatttaatcgatgtatgggatagaatatttgagaaaataatgatgttcttctgcagccagctaaaatgaaagggattctatgtaatccaactagatcagctgaaatcaattttggtaatttagaggtaaacaggtatttgagtaatgctgacctcaaatctgattaaccaaaaacatgcttagagaatgtaggactaaattatttacatgtacagattaaataatcagtaacccacaaatgcatttcaaattaaactgcaaagatgtaacttaagacatatagtttttagaaaaacaaaacatattttaccctttagttaggttaacattgttattttttcttatatccagtaaaagatgtgacagtttctcactgagccatttctcgtagtagtatggacttaatcctatcttctttttaaggggctgctctttaattgaatcatgggagtctttgtgtttcacatgagcaaagttggcgcacatcacagccagtggacaagtagatagggccataaagagctcacgcttagccctgagcaaaatgataactggctcatcgagaccttccccttcccaaaatgctgagggcagctgagaagacagccatagagaggaatgatttgcagtatttataagtgggaagtgccgatgcgtttctggttcctactctgacttccaaacggcgagctaccccagaataattcaagtatacatcttcttctgtccatcctggcttagtccctgttactgggagagctgtctttgctttttttgccttttaaaataagaattctgacttgattttttaatacccagaactctccaaaataatcatgctgttcttcaaagatttttcaagacagatttcatgcttgttgcctgggcccacagatgcagtgatttgaagtgatatacatttttcattctctcatgaggtactaatacaatacatttaaatttttctgagcctcaatttcctctctgcaacttggaagaataaaacctatctggaaggtttgttttgagacatacatgtgataatatgaataaagtatagtgaatacttaataaatggttgatattattatttacatagaggaggtggtcaaaatcacaacagaaagaaaataggttttggtatcaggtacatttattttggattttatctttgcctcttattagctttgtgaccttggacaaatccttttttttttttttttttgacagagtcttgctctgtcaccaggctggagcgcagtggcgttatctcggctcgctgcaacctccgcctcccgggttcaagagattcctctgcctcagcctcctgagtagttggtactacaggagcttgtcaccaagcctggctaaattttttgtattttagtagagatggggtttcaccatgttggctaggatgatctcgatctcttgatgtcgtgatccacctgcttcgggctcccaaagtgctgggattacaggcgagccactgcgtggctctgcgcccagcaatacttaacagttactacgctcaaattctttattattatctgaaatttctcttgagttatttagatagaagagaaactgggaagatgtattttgggggatgtttacagcgtcagaagaacttttctggaattatttaagagcaaattgagaataattctatagtggtcattaatttttggggagcacatggttgaatttggttgttgatactttgtgatgaagataatgtatcatgaatggttgacattcactgttgtaataataatttaagctcatataatgaatcagttcaaatcactgagcatatttacaaacgcgtatacataattaacatttaattcccctgaatatcttatttcattatccacacagtttaggaaaatatattaaatagacactggcaaccagcaagcttatgctctatcaaaccataagagaccataagacctttgagtttcttctgttagtgaccagatgagtttgagttaacttttgaagtaaggatacagcaagttgtacatgcttttataatcatactcactaaacaaagctttgaaagaatggggttggaatttggacttaatgggtaagaattgaaaatgggctattgtgtcttagaaacttcagtttgctgtagttcacgttactgagctcaaacattttctaagccaacaaactggtaactttacaagtttccttcctaaccgtgctcaccacattcatgctgtgttgaactgccatgcaaattcaataaggtttgattttctttctttgctatttcttacttgctttctatgttactttcttctcttttctgagaattattttctgaaccaaaaagtaaatgtttagcatcaggatcaattgtcaaataacaaacaaatattcaagttctaggataaaatgacatcttgtgagcaacccttaaattcccattaaaattttcactaggatgggggtggtggtggaacaactcataacattaaatgccaagacataaaatcaatctattcccagaatattgggagcaattagtaataattggtaaagtgaaaaaataagaaaattaatttggatgggactcagtgcaattcacaaaatgttgaaaagatgtatatcttgctattagctagtaaaatttttgaattgaaaagacaaattacaatagcttttttgaaaaaaaaaaatgagactcccaattgagatgaccaaaagttgaaatgttaaaaatacagaaatgggccaggtgtgttggctcacacctccagttccaacacttgggaggctgaggtggtaggattgcttgagtctaggagtttgagactagcctgggccacatggtgagacccccatcactacaaaatttttttttaaaattagcggggtatggtggtggtgtgcctgtggtcccaagtactcaggaggcggaggtgggaggaccactttagcacaggaggttgaggatgcaatgagctgtgttcaggcctctgtactctagccttggtgacagagcaagactctgtcttaaaaaatataaaaataaaaatgaggaaatctttattaaaagagaagtagaaaaagtagagttaaataaagacaaatctaataaaaattactgtgttaaatttgatgataaaattcagtggaagagctaatattcttaaaatgctgtggacaatggaaacacaataatttagttgaaaattaattaaacccatagattatattaactaaagatcagaaagtataaggtagaggatacggagaggtaaaatttttctagtttccttatctttaatgatagggaataaaaaatctccaatttggagggggaggttattgatagtttggtatttatagtttaaaaatgtaaacataaccactattggagttattcttcacaccttgcaaattactagaccatataaaatataaacagttataaatcaaaggaagcattataaaacagcataaaactgtataatggaagacaaatataataattctgccaattaaaatgaataaactcctctgttagcacataagactttcacatttcattaaaaattaaagtctcactgtttccttcatgcccaagaacagagaactttaaaagaacaaatagtcaggggaaatacccagagaaacacaaacagaaaaataacataaatggttatatgaattttataaaaatgtattttccagaaagattttgtttttttttttatttaaaggagcattaaaatctcagtgaacttataacagaaataaaaatgaggcagacattgttagaattagaagcaaaactgataaaaaataaatgtcttggaagaatttgttatcctatttagtcaataaaagactaagtaaaataaaataacacaactaggaaaaattagcctggttaaaatagtagacataaaattgaactctcaatctttcaaaaacctcaccctcttttaaataattgagaaacactgatttacaaaatccttttaaacttgaaatcatacagggtgcattctttaacgtaaatattcattgaacgaatgttaaggaaggcaaatagcctagaaattagtgacttctttcagagaaaaaaaatctccaatactaaaaatccatatcctaagtgagaaaatggaaactagaattattgtatgttaagtgatgcagccaaagcagaacataagggaaaactcttagctttatgtcctttcattattaaacattaaaattaaaacatattaattaaagattgaagtcacaaatatagaacaaataaaacaatgcaaacaaattaggtaaaatagctgaaggcagaaatcaataaattagaaaaaacaaaaaatttaataacgttctttaaaacaatgtttaaaattaagaataaaagataactaatgttaaattagaaagggtatacagactgtaaatgcaatgtttttaaaattttaatatttaaacttcaaactattatatttgaaaacataaatgaaattaaacatttctgaaatgaaaacatacaaattttcaaaacgttctctagtacaaatcaaagatagctagaacaacaattctaatgaatagtacataataaaagattattccttgcataaaagtttctgaaataaagtgattttacctgagttccttcagatttttagagaaggaatgcttctctgtacccttccagagcatgaaaaattgagaatattgcacatcccattttagggagccagtattaactttgctcactgaatatgataaatttattacaaaaacactatatgtctgacaaaatagaatagatttggtggcagatatattaatttgatctttgagctatctctaccacatccccttctttgcttagtgaatcctcattttctttgtgctggctgcagtctccccagcttaaggtgatgaatcatgattggtctaattctaagaatgacaatcttgttcctcttttctatcagttcatcttccaaaccctccttagagcttgggtatggctgattgactcaattctggccaattgcgcttaaggggatctctactgggaagcactagagaaaacagaattggtgtcctaatacaaggatcaggtagaagacaagggcttgttgtctggagtggctgcagtcatttcataacatgaggtggcaagagggaaagaaacaaaattctttgtggttaaaaatgatgaaggagaaagaaaaaaagagcttagattactgatgattatgattggcctgctgaaccagtcgtgatatcacctgtgttctttctgttaactgagataacacaacacacacacacacacacacacacacacacacacacacaacatgccactgttacaggtttttaaaattaatttggtttaacacttggaagcactcatctgatacaaaagcaaaaatccaaaataaaatattgacaaataaaaaaatagcagttcacagaattatttaccacactttagtaaagttatataaagaagcaaggagagtcacacattagaaactgtattaacctaacaccacatcattaagtctgatgatgctacaaaaatttatattcattattattttagaatacaattaaatttggaataaatgtattaagttttaaaaataaaatgctggtgactttattagatgtagttgagataagttgaggatcctcattattgtacactattttaatttaaacactgttctgaaagttctagctaataacatatgttctgaaataaacttacacattttgaaaaggaaattaacactattatttgaaaaaaatatgattacatgcctgtacagtcaaagaaaataactgaattaagagtgttcattaaagtggccctcagtgaaatattctccaatctaatggaattaacagaatatatatagagaccatagaatatggtgatgatagcactgacatacctaaaattgaggaaatttatcaggatacaaaactatgatcaacatccatttctatcaggggagacagacatttagtttcagttactatgaaggtctgttgtgctttgttgtgaggttattttctcatcttttatcaaggcctagatgaaatatccttaagaacatttatcatctttcattcttatttcatctctaaccaacaacattctgataaattatttagcttttcagatgactagaatcttctagtacttttattactaataaaaacatattcccataaatacaccaataagttagcattcttgttaactataacagaacaggaaggatataaattgttcaataaatgataactgtgaaaactggtttatataaagaaaaatctaatgatagcatatttgcataatatatgtcaaaatgaattctacatggattaaacagaaaaatttaaataaataaaaaaactttaaagaatctaggaagaacatgtacatgaatgaatatttaacttatatcccaggttcaggaagaattttcaaatagggaaatcattagtatgcatgatgaaatcttgcttagattagtaggtaataattattaaaaatgtatttgaaatttaaatgccccaatataagtaagcctgcttattttgggaggggtatcttctttttttagaaagctgaaaaacaattttaaaattccaatatgttttctgcattccctccccgtcttgggtgagggaaatctagaggacttttaagagcttttacaagttctaagattatttggaggctgtctttatgtcccccggtcattctcattttccccttggattgaacacattaagacaagcatctactcttcctgtcccatgattgcaccctcatttcacacagggagaagtcagatagcactcagtctttaaacttccttgccaggacctgcttggtgcccagaacaggagagaaggaaaggtgggctgtctacctctatcatcataagttgaggcaactggtgttctgtgagcttttctcccagcacctgtcatacaggacagttgagggctcctcttctattgcattcttgcactgcatggggcctcatagtgcttgctcacaatgaaaatggagaaagaaacaacatgaaaatggtggtagaaaacttgcatattgtgatataatcagtggtcctgcttgagtaagcagctagaagaccccaggcacccagaggctcttgggagaccccccttcaccctcatacagggtgagagagaaagggttctgaatttgactgcaattctgcctaaatgtaatgtcattacaaaagtcttggcttctgcattctgctctacctctcaaggtagcctgttaggggcctggaaattttccataaaatggttcaaattcatccttaattatctaccatataaaatgcaaattcaagtataggaagggtatttcgaggatatcaatatataatgtatgaaagtgcagggtgcataacagttgtgcgtataaagctaaggctgagaatatacaaggctgagaatatacataaaaggaaaagtaaaaaagtaaaagtaaaaaagatttttttaaaagtaaaaaagataccctagaaataatattacaaggttaatgaatcagtgagtaggtttgccacaaataaaacaagcagaggtttgattgtcttagtatacaaataattcttataaatcagtaaaagtaaaattcatatgggccaatggtataaatagatattttacaaatgaaatttaagggcacttaagatatttggaaccattcaaataaaaatgaaatttttctttgtatagattgagcaaaactatttttaaaaataattttgggaaggatagggtaaaatggtgagaagtctctttaaaaagcacatatatatgtgtcttatatatatatgtttacatatgataaaatgcaaatcaaaaccacaatgagataccatctcacactagttagaatggtgatcattaaaaactcaggaaacaacaggtgctggagaggatgtggagaaataggaacacttttacactgttggtgggactgtaaactagttcaaccattgtggaagtcagtgtggcgattactcagggatctagaactagaaataccatttgacccagccatcccattactgggtatatatccaaaggattataaatcatgctgctataaagacacatgcacatgtatgtttattgcggcactattcacaatagcaaagacttggaaccaacccaaatatccaacaacaatagactggattaagaaaatatggcacatatgcaccatggaatactatgcagccataaaaaatgatgaattcatgtcctttatagggacatggatgaaactggaaaccatcattctcagcaaactatcgcaaggacaaaaaaccaaacaccatgtgttctcattcataggtgggaattgaacaatgagaacacatggacacaggaaggggaacatcacactccggggactgttgtggggtggggggacgggggagggatagcattaggagatatacctaatgctaaatgacgagttaatgggtacagcacaccaacatggcacatgtatacatatgtaacaaacctgcaaattgtgcacatgtaccctaaaacttaaagttcaataataataaaactaaaaaaaaaagaacatcaaacaatagagaaggttaaacattaagataaaattccttttctttcctatctcacttgcagagacaacaattgttaacagtagttttagttttgttctggtgatgaatattaaaatcttaaaaccctcatgtacttttgcttgtcaacttgaagtagtactttcaacttatgaaaaatgaaaggtttaaaacaccctaacttcctgccaatctttgtaagcttttatttttctaattattctagatttcttgatttattacctacatatatatatatatgatgtatatatgcatgtacgtatatatatgcctatgtgtaggtgtatctatatacatataatattttttatcagaactcaaaggaaaggaattaataggcttcattacctttccccctctttttcatcctccattttataaaatgtgatacattattattgcatttgtcaaattctgtaactgtagttattttgtgcattgctagtagattgatagtaaaaactgaaaaccagcaaacattattaaaatattataattctgtacacatgtatcatggtaaagcatagtgtagttggacccatagaaaagttacattctttgtctacaaactttattgctgaaaggatactcttccaatcatcaagttgtcattgattctccctcatttatttaccattttctgtatttatttttccattggctgcctgtatttcttgtactctatgtcattatcattattggagtttttttttattttgatggaaaatctggtctagtaatttctttcacatggaatgtttgagtgctaaattttctatttgcttgcatttgcaaaaatgattttattttcctcttaccctagtttggcagggtataaaattataaattcagtgtttttctttaagatttaaaaaatcttgctttttcatatttttgtgtatatattgctagtgagaaactgaagataatgaggagtatgatgttagatgcacatatggatcctgttggtttgtatgtaattggtttattttctctagatgcttttaatgtcctttctttattttggaattctgaaatctcatcaggaagtttgtaagcatatgtctctggttttgttttttaaattttatttatcttgctcagccctacttgaaccattcccatttaaaagtatgtgtctttctgttttgctttcttttattgtttccattatttctttcttctctccattttgttcctactgcatggatgttgggcttcctggatttttcatctgtgacctaaatttatactctttatctatgtttttgttgctttttattctgtgagactttacttctgttctacagaccatgtgcttagttttcagttgttttattctaccattaaatccactgtttataaactctgaatcaaaacctatcaatgggtcatgaaataaatttaattatttaaattatgatatttaatttaaaattaaatgtcagattctaatttcaaaactgtaaagggcacaccatattgacaggaggcaccgcacagtggtgctgatgggccaaaagtgagctgtcccatgacgctctccattgtcaagtcaggaggactttactttgagagtggaaaatcttagtaaatttaatttcttagtccagtgttgtatccttttttgccacataatgtggaggtttgacattctcttaagtgctgttaggcttctttctctcaggcttcaacactcatacatgtaactctccactgggagatgacccattttcttaggagaaatgttctttggccttaatcttgagagaaaaaaaaaagtcactagcctccatctgcaggagaggaaaaggggataccttgtccagccattctaaataatagtgctttaagtaatctactcatatgcttatcttggctccattctgaacttgtactcactcactttgaacttgaagcttctacagagctcccttactgtagttttttatggcctgttttattctataccaaattacttctgatttctatgtttcagaaattcctgaaattccatactcctcatatgaagcatgttggcaccttttcttctacattcaaaaatgttatggtttcattttttcaaaaatactttgtctttttaatggaaactcttgagaagggaggaagacgtgtttgttttgcgtcttcaactggataagcataaccttccttgaaataaattcggctttatatggaaaaaatctgaaaattcttaccttttacctaatgactccacttcaggaaaatcctgaagagaaataagccaacatgcagaaacagatttaagtttatattaaattgtaagaacaacacatactacctgaaagacaaaatacagtatagaaggatggttaagtgaattatgatttatccatctgatagcacaatgttgtaaaaagtcgtatgtctgagatttgctcaagttatatggaaaatcttcatagttaatgtcaagttaaaaactgcatacagaactacatatatataataagatcacaaatctacaagtaaagatttgtgtatgtttatggaaaagaacaagaatcaattatgtcaaactattagctgtagttaaatctgattggggtcctacttattgtaatttctttttgtctttttaataattttttaagttttatataatgaacatgttttatttcacattaatatattatgtaaaatattttaaagataaatttcatttttatatccttagtccctgggaggagaatcctgcctctattttttgcctctatctgtgtagtgtgatagcagttataatacttcatttaagaattatctctttgcatctgtttcatcagcataatttgactatgggttttttgcaggtaagggcaatatcactttttttaaaaaatagtattttgtgtagaacaggtgttcagatttttttttttctggtagtctttccgaactttgttgtttctgaattaataagcaacagtccttaaagtgtggtctgttgacccctagtgtcaacaaggcactttcaggtatcctgtgaaggtaaattgttttcataataatactaaagccttaatattgacctttttcactgtggtgacaattgcactgattgtataaaacaatagtgagttaaattcatcttagcacaaatgtgaaggggcagtggcctgaaattgtactcacagtcattgtattattcattgccacacactcatagtaaaaaaaataaattgccagtttcactttcaaatgtctttgaaggaacagtaaaaagtactaattatattaaatcatgactcttgaatatatcactttttaatattccgtgtggcaaagtgggatgtttacagaaacacttctgctgcactgataaaagacccatttcaagtgcaaggcagaccagtggacttcaatgtagcagaccacacaaagttcactgatctggcttcagattccacattgcaactaacctttaagacactaccacctatcaaattttgattcggtatcgaagaatatccataactgtcttaaaaggctattaaaatatttcttgtttccacaacaacatatctgtgtgtagccagattttcctcatatacttcaaccaaaataacctattgtaacagattgaacgcagaagcatccagctgtcttctattaattcacaacattaaagagatttgtaaacataaacatgacgtgattctcactatttttgaatataggtattttacgtaaaaatatcttatgttaacatgtcatgggtttattattgttatgtttatatgaatcaatgagtatatatatatatatatatatatatatatattttttttttttttttttttttttctattctcagttggtgcggtggctcacacctgtaatcccagcactttgggaggccgaggtgggcggatcatgtggtcaagagatcgagaccattctggccaacatggtgaaaccccatctctaccaaaaatacaaaaattagctgggcatggtggcgcacctgtagtcccagctactcaggaggctgaggcaggagagtcactcaaactcaggaggcggaggttgcagtgagctgagattgcaccactccactccagcctgggtgacagagtgagattccatctaaaaaaaataattctcatattattaaatgtttagtatagtgaatactggtcaggtgcagaggctcatgcctgtaatcccagcactttgaaagtccaaggcgggtggatcacccgaggtcaggagttcaagaccagcctggccaaaatggtaaaaccccatctctactaaaaatacaaaaattagctgggcatggtggcatgcgcctgtagtcccagctactcgggaggctgaggcaggagaatcacttgaatccaggaggcggaggttgcagtgagctgagatcataccactgcactccagcctggctgacagagctgtatatatatagacaattacaacccatgtatacagaaactctttgggttcttcaataatttttaagagagtaaagggatacttgatagttccacagttttttacttattattaaaaaatgctcagtgacttactcaaagatacatgttactaaagggcagaggcagaatttaaactaagatctgactgctccaaagccctcctaagcatttctatattcaatctttgaaaactaaagttgttttttttttttcagttctctgacagtatctcttcctgaataatttcttgcttaatcataactttcattaatctagcatcaagcaggttctgagtacttattggagtgtatttgagtaaagctttcaaggaatttggtgtacatatctgaaatatccttgacatctccagcagttatcaaccattctttcttcacttagaattgacttccagttgtcacacctgtgcctattcaggctttcagatgctctataaactactttttttacttctttgtctcttccagatttgaatgttcttaattcttagtgagcacattgttatcacagttgctgttaatagttgctatggtaggttacaagtaaaacaggtattgttaagtggcttctataatttgctattagtcactactacaatatttctcatgcaatcagaattgaaatttctatatttgtgtacagcaatcattgtgacagctctgtctccagtggcttgtaacagcccccattgcttatagtttcagttttcatgtgggaatggtgctaaattatggtgctcaccaatacggcttctttctatgcagctctgcagctactgctggctcttctgggaattttttcttttgtatatccgtccctggtggatcacttgccctttcctgccaaacccttgcctctgtctgaattctggtttggctcttcctttgtggcccccagagcctctgccaatcttgttggagcatttgcagcaataggaaaaaggtcccccttcttcagggcacccatgatcttgaaacagagactcatgaagactcatgaatgggtttcaactcccatccatcctctctgccaagcccttgtggagaccacagtccatgaccctgaataacttctgagagctcacgttgtgaaattgatgcagaagttttgtgacattgatttttaaataccaccacagtgctccaaatgccttctggatggctttccaatttcaggataagaatacaaaacatacactaattttcaaaagaaaatatcatcctcccactttcatatctggtccttacagaaaaaggtatgttacttccatacagaatgtctgtgtgattcaaacattcactccttgtgactttagtcttaaattgcctttttttttttttttttaccaaaaacaaaaatctagatgatattttactatgtttaatcatcaatccagagagattccctaaggcttaaataaaatgaatgacttaagggattggttatcacttgtgtcctttttctgggatctccttctcccatttatactctgatgcattagcttgcttctcagtgtcaactcttgcttgtctagacccttcccagttggtaatttcttgaccctgactttttttttttatatgtggccttctgatcttggctttctctacttttctccaaggagagatctactgacaacactatcctcagtttgggaggcctgttggctttccctctgagattcttccgtgtattcagtctcttatcacatttggactgttcttggatgcgaatgttgaggtgccgaacatactttcttctggattctcaagcctaggtaaagttagaccaccagatagccatatatacagaccttgtggaaacgattttgctccatgctttaacattatgcttttaacttcactgagaattatattaagttatgtctatataaaggttctgcaacatttattagcaacctgtgagaagactttgcccataatttttatattttggtcatccttacataaaaatgcacgataaactcatcttagaatactgtgtgtaaaagatttgtcttccctaactgttttagttattttgggctgctataataaaatgtcatagactgggtggtttgtaaacactagaactttatttctcacagttttggaggctgaggagttcaagatcaaggtgttggtagatccatgtcagtaaaggcactcttcctggtttgcagaaggtgatcttttggttgtatccttacatggaagagacagagggcaagagcaagctctttgtctcttcttaaaagggcattattccattcaggaaggttctaccctcatgaactaatttcctcccaaaggtcttaactccaaatactatcacattgtacgttaggatttcaacatatgaactttgggaggatacagacattcagtccagaatgcacttaaaatagtgctcatagtttattacatatataatgtatagatacattacataatgaatggtaagtaatatgtcatatttcctgtttcacattggctactaggaagcatagagctatatgttgtcctcatttgctataaatatacttagaatttgacaatcatgtatttagtttatatttatgagattcctcaacttaatgtcttaaatgactccatgaatttatgccctgcctcattccaacatatatctaagcataaaaataaagaaatgatttcagaacaagagtcacgcaataaagagaggaaatagttacagagatcctgtagatgcagagaaattgaaggaagttagagataacaaaataagctaatgttatctgggccagtgacggtcagcataactctaaatcgccttttctccaacacatgatgtatttctaccagcttcacttttcccttcgtggtattagagtcttctcatctttattcatggtaagaggactcagatgatatctttgccttaaaatctttccctctgacccatcctgcttggtcattagaggaagcgtcacagaaggaagaaagcagtattatgcggtgccttccaagacacagacacaatggagattgctgtggcaccaatgcgtatagagatgtattaatgtgatgataagtagaggggctgagatcttgtcagtactatcttattgcatgggaagtttacagattaaattcttttttctgtgtcgtattttattcatctttaatatcccttataatagcttttcagctgtagaagaaacctcctttcttttcttttcttttccaactacctctttcatagggtcaggagctccctctgagtccactactcttagatgatttgtccccaataatttatatatcatcacttaggttatttttagttgattattttttggggtataaaagagtgaagtgcttataaaagcttcctggcaaggagagccagagtgagaaggtacagctgtgagtaatgagtctaccacttatctctgggggcttgcaggacaggtttttagcctgtttctcaacatttctttggacttgtttgtaaccttggtagtcacagtgtgggagggtaaaagggaagagcagggctatgtaagtagcaatctaatatataccgtctctttctagatgagattttatgatctaatgtattctttaaaaggaaatacaattgtagaaattttcataggaattcagagaatcactgcagaattatccttttaatcatataggtgcacaacaaatacaaatccacatacatatttctttttctctacctcatccccacacccctcctgacaaaactcaaactgtgttttaagtgttctgtgcttggtggtggctgctgccattttcggcaattattttattttttttcaaaatctgttgctttgaaaggccccgtagtgttatgtagggtgtaggtctacacagttattacctactgtcagcaaaactgaatagctgggagggaataattatacaatcccttttgccataagccacttctgaacatattgcaatatgtactggattcattttaaagtggttgtaactaaatgaatcacaacctttggggatagggtaacagatagtatattaagactgtgtaaagtctgtaagaagtcagtatattaaaatctgtcaggaaaggtcatccttgactatgggttaatatctgtagtcagtaccttgaatagtgccaatatgtgttggctctaatctttgatatgactctaggcaggatatgagatctgaaactttcactgatggagtatgaaccagattgacaaacttcttagtgaagagaagtttctgctgtgtgtgtgtgtgtgtgtgtgtgtgtgtgtgtgtgtgtgtgtgtgttttcatgattctgggtattttaatgttaaagtatatataggattttatagtttttggactttgggatctagggagaaaaaggatgtatatcctttcctactcaccctacccccaaccaattacctttggcgaggtatcagctgtgttttgctaatgagcattgccggaagacgttctggaagctcacagaacacagggacttgtaagagtcacagtggaatcagacaacctgtcagtctgtttatacatgtatgctggcattttctttgcaagacgtgcaaaccaattagagggaggctcccttagaacacttttgagggggtggacacttctattaatgtttggcgtgggcatctgttgtattggagagaatgagatgaacaattttataatcaatttttggaagagaatttgaaatgaaggttacgaaaaagattttgttgtaatatgagttagcagagaaaagttagttttgtatctctgtacagttgaaagttcaaaagaataaggacaagcatgtttccttggccatgcttttcatcgaatacctattgtttttataattagttcattataaaggagagttgtgaatagtgacctttgtccagtctggctcatgaaaagcaagcatactgatttcctctgggcagtgtgatcagttaccagtaatggagctgaaatgagtgatcctgatatgtctttgcacattttattgtgcaaagaaatcagggccttatgcagtttgggagaaggctgggactttaatgttagtaccataatgtcttgccttcctcccccacctccttgcaaatcagtacttactgtcagataaactcaactggtgcctttagaagaaatcaggtgaatatggggcagaaacagtggagttgcattttgaaggttttctattatatgaatagcagccagttagagaatatctaaccatcagcagttttattttaattctttgctatatggaacctcagggaggaaatgttcttgtctgtagtaaagtgtttcttttctctctaaattgcacaatgattgaaaattgtggctatcattatttgtactatatgcaattataaagcgatggtgataatatttagaatttgataatgaagctctgtaaacatttattgtaaaagttggtgcttagcttcagcattccagaattactgttaccacatcctattgaaaaactgataaggatctgtaacactgaacaatatgtgggtattgtcatctcattctttgtaggtttccttctggctggaaatcttggagttggtcattataatcctttgctttaaagtcgaggcaaataagatacatgttaatttcaatttagagacaaaattgtgtcctgcctgtttcttacttggactaaagcttacattatacaaaatcatgtatttgctttgttatagtaacaatgtaaaaatagaagttctgtaaagagttaatcagttatttgcttctgattgtttaagtgagacaacctgtgggtcttttaggtcttggtctttcgttactgcaagacgaaagagtaatacacgtattgctttaatgccctcatttatacatagaagtatcttaataaaattgtgaatgacagggcaccaaatcattgtggttataatggaaatagtcaaataattgttatcagtagaccctagtctgagtctttgtggttctgctgtttattaggaacatgatcaagagagttgacagtttttctgatattcaataagatttttgtgctaaacaatatttaatattctagctctaatagtctatgtgtttatagtaatcataatcatttgttaatatgctcagcaagcagtatttatagtcacctggggaccaggactttattagatgttgaggagattataagtgaatagccataaaccatagcttacaagagcttgcagtccagaggagaagacagccaggtaaacaactaacagacagatatacaagtacagaatggctagtgctgggcaagatccatctgcctatgtactgctgagatacttgtttaaggagtggtatagtctgaatgtttgtgtctccatggatgggatttgtgccctcgggaaagaggccccaaagagctgtttccctttctaccatgtgaggacacagtcacaaccataggcgtcatctttgagaaggccagcactgactagacgctgaatcttccagcaccttgatcttggacttcccagtcttcagaactgtgagaaaaaaaaatatattgtttataagccacccagtttatggtattttgttatagcagcctgagttgactaagacagggaggtatgtcagcctgtggaccttaggggtcttctgggaagacaggtggaaatgatttagaatcagattctctggctagaagagtcttcttcctggaagttttcaaaattgacagggaacttatactaagataaaatatatacttgacctttatcttattttttttaaatcagcagttattctttaatattatcaaatattcagtagttgttaaaatttccaatcatttcataagagtcataaatgtactttataatgtgtttgtttgattaaagtccatatatggtgaatgggtgatatgtctttcaaaactgcaagtcccttgcccaaccccatcatctcttttcttttctttgtacatttttatttaaccaagttggaaaacactctgcaggatattatccaggtgaacttccccaacatagcaaggcaggccaacattgaaattcaggaaatacagagaacgccacaaagatactcctcgagaagagcaactccaagacacataattgtcagattcaccaaagttgaaatgaaggaaaaaatgttaagggcagccagagagaaaggtcaggttacccacaaagggaagcccatcagactaagagctgatccctccacagaaactctacaagccagaatagagtgggggccaatatttcacattcttaaagaaatgaattttcaacccagaatttcatatccagccaaactaagcttcaaaagagaaggagaaatacaatcctttacagacaagcaaatgctgagagattttgtcaccaccaggcctgccctaaaagagctcctgaaggaagcactaaacatggaaaggagcaaccagtaccagccaccgcaaaaacatgccaaattgtaaagaccatcgatgcgaggaagaaactgcatcaactaatgagcaaaataaccagctaacatcataatgacaggatcaaattcacacataaaaatattaacttgaaatgtaaatgggctaaattctccaattattaatttttaagaaagttttaaaattcacatataatattgtacatatttatgggatacatagtgatgtttcaatacatgtaatgtattgtgatcaaattaggggaattagtatattcaccatatcagacatttatcatttcttggtgttgggagcattcaatatcctcctttagttatttgaaattatataatatattattattaactgtagtcatgctacagtgctataccaattttaaagtctaatgggaatcaatcaggacaataaaggagtcatccaagtattccctggagagccatttttgtgtgtgtggaagatgcttaagtgggggtggccaagataatttttgaactgaaattggaaaccagatttgttcagactatggttgcacagagtaccatcttgcactaaatcaaaacctttaattttgttggactatgatgaaataatcctaaagtgctatggaattacttctaccactgtagtagtttcttctaaaaaattagacctgacctttgtttttaaaaatgtgttaattttcagagttgacagatgttttggtgtgattctggatggtgcctctcaaaatatcctccaactgaactctgaagaaatgtgtccagttttctcaagagagacaactggaaaaaacaaaaccagcaatggcagcatttggagaatgtaataggcgagctgccacacaggtggaaacagatagttctttttctgtgagggctgcattgatgaatacagaagtggcatgattggattagtggccatagaaacaataacacagaaatgaaagcaaggtcagtctctaggtgagaagtggcaatagcttctaggggagtcctcaggtattatactagcagaagcaagatgaaaaatttaaatttaagtatcttaaatgttcgttggtgggggaggggcatagcccacataagaggaccaaagatcccttgctcctcttatctcacagattcacctttccatttgtaaaatttgtcactgtcctctaaatttcaactgatctaacatgccattaaatgtaagacacaccattattttaggtatcactaagaaagaaaagtgtaacaactaagacttctttatcactgtatatgcactgaaagagctctttaaagtccaacttaaagaatctataatggttatactatttcagctggcaaatatcagagccaaccaatggtgcaaagaaatatactggattctgcttggcataaaacacctgagtttacagtccaagagctctttggtttgcaaagagaaggatggagaaaaggaacagcactttccgcacagggagaaggattgggaaaatagtgataacatcctttgcagctgccagaaaatacccctaatttttaaagataatttcaattgtaagatgtgctttgatttcagagatgtcaaaatgtgaaaaaagtacattttagaatagaataaataaggtatgtaagagcttttcagtgttgccaggtgttgaatgttgaaaggcaactaggccacttagaagaatactgatctgttgacaagttattttttagttattttagcaactcaccaatccactagcaaccagcctgtagtcataagtaaaagtgaaaatagacgcactgtgctttactctcttctctatgtgagagaaagagagggtacacagaggaagaaaaacagtgaaactgactctgtcttgtcttttgaggacaaacttcctgtgttgatattcaacccatttggagcctaatagtgagctaggatccaacctggagaatcatttgatggttgaaaaggcaacatgatgaacaagagccaccagggggctagaaagaaaagaaatatagaatctaagttgaggtaggtaataggatctaaactaaacattattatttttacttttgtaggagttcatgcattacattgacttctctcgggttttcttgggctacagaatcatggatgatatgataaaataagatgttaatttatattcctttcattctatgcccctcaatcccctcaacagttgggtaaagctctcatgtgcataaaagtcagttggagggctatttagaaaatgttcagtccaggctctgatttttgagattttggagtttggtgaagcattctgaaatctaaatcctgaaaataaaggtcctgaaatttgtgtttttttcaaaagcatctccagttatttataataaagatatatatgtgtaacgctttgagaagcatgctctcatagttaatggtaaattaatttagatgatcctctcttcattctcggcactcctcagttcaagtttcctttttcttcaagaatccatagaactagaaaatttttcccccacagaaattatcttttgttgcaaatcaaaaacactatctttggcccagtttgagctagatggaaatttcaaaaaatatatatctttacatagaaatatacttatttccagaggtttccatagatttcacattatggaggcaagctaagtgcttcaaagtacccttcatcacccattgaatccaatcatggctgggctgctcagtggcaaatagcattcctcctgcaattctgcttagttttgaaggctaccaagacacaattcacaatgttgtttttcttctggaaaacaaacaacagaaaacacagaagatctattcatattttaaatggttgacttggtaatacgttcagagggaagaagataacatatgataatatcgttaatagatgacacaaacatttgtgataatggcccagcacgttgtacagagtaatgtggatggttggatggtgtgagtggaagtgtgtcagctggcttttagcccactggcaaaatgtttggacaatttgtgttggataacttggtggtggatttaagagaatttgttttccttcacaaatgaaatgatgtatgcaggatttgatatgtaattctttgagtaagagataattgctgtacacactaaccaactatttgcatttagttagcaacagtttctactgaactttatctcatgtttccttaagtaaatgtttggaagtatgtttgtcttatttagtaactttaaaaaaattttaccacatctcaatgcttctcaaaggttatctaaatatctactcaaggaaaacattctttagttactcagcatcacaggcttcagttttctcatatgtatgacggcttgtaatgcataatattcttaccagccctgacatgcagtagtagttatttatatggtattgtattgtgtattttagaactacattcaattacaattcagtctgtattcattttaggaaggatgcatgggaatgtgttctgaagcagggcctctcaaagccaagtccttaaaccacataccttagactaatcttggatgctggcagaaaatgcagattccttggttctgtggactgaattgtctcccttcttcaaattcatacattgaattcctaagctccaatgtgtctgtttttgaaggtagggattttaggagataagtttaaatgagctcataaaggttcattctaatccaatgcaattggtggcctttataagaagacaaaaagcgttctctttctctgtctctttctccacacctgtgcacactgagaaaaggccatgtgaggatgcagcaagaaagtggttgcctgcaagcctagaagacagccctcacattcaaaatccaaccatgctgccattccgatcttgcaattccagcctccagaacggtgagaaaataaataaatttctgttgtgtaggccactcgagctatggtattttgttatgacagcccaaactaagacagattttggcaccaaaaagcagggttgctgctgtaacaaatacctaaaaatatgaaagcagctttggatctgggtaatggtaggctagaagagttttgaggtacactctggaaatacggatgttaaaggtgattctggtgaaacatcaaggaaaaaaaggaaatatggagagaagcttccatgttcttagagaatacacaaataatcatgaacaaatgatagaaatatggaccttacaggccattctagtgagatctcagatagaaaaaaacttattggaacctggaagaaaggcaatccttgtgataaaggtggcaaagaacttggctgagctttgttctagtggtttttttgaaaggtggaacttgccagtgatgaaattgaatatttatcagaggagatttctaagcaaagtattgaaagtgtggcttgggccctccttactgcttatagtaaaatgcaaaataagagaggtgtattgaagaaggaattgttaagcaaaagaaaattaaaccttaaagatttggaaaattctatcctatccataatgtaaaaattgagaaagcctgttcagaagaaaacatcaaggatgtggctggactaccgctaaagaaattatgggattatatgaacagagacactgccagtttcaagtgatgggaatggagacataatgaaatcaaggaagaccataatacttcttacattctacaggacaggatgataatgctcctcgcctgggaatgtatcaattcttcaacaaaagggaagaagaatccaaaggcaattcaaaggtaaccagagccactgacttgtctttaataacccagatggcctcctaccagagtcatcggggcagggtcgcctggagccatgggagtttgatctcaacctggcagagccttaggagcaggacatgctatcctggtgggtctggaagcctcacccagcaccctagtgagtccagaaggcagaacattaagccaaagaacaagattactatcaaggctttagatttttatggagttttccttgagagatttaggatttgcttggatcttgtcaccactttcttccttccggtttattccttttagaataggaatgtctatcctatgactgtcccactattgtcttttggaagcacataacttatcaggtttcacagatttacagctggagcagaattttgcatgaggatgaatcatacttccaaccccacccatatctgacttaggagatatttagatgagactttggattttagactttagaattgatgctgaagtgagttaagactttggggtctcttggggtggaatgaatgtattttgcatatcagaatacaaattatgggggtgagggcagaatgttatgaactgaattgttccccctcagttcacatgttgaagctctaactttcaatgtgactgtattttgagaaagtttttaggaggtagttaaggttaaattgttggaatcctaatttgataggattagtgtccttataagaagagaaggagagagaaagttatctctctctccacacacatgcctctagagaaggccatgtgaagatgaggacagcaagaaggtggccacctgcaagccagaaagagagcccttaccaggaaatgaacaggccagcaccctgatcttgggcttcctggcctccacaattgtgagaaaataaatttctgttgtttaagccacccagtgtgtggtaatttgttacagcagctggagctgactaagacactttgttccaatccagtcttactaaaaatgaaatagcagaaatgagatgactcaggaatccatattataaagactcccctacccttggcacatgtacgtagccacataggataggatagatcatgctatagcagcaggatggcaggggttggggggtgaggtttggtgggattatttgatatcaacatttaagtgcctgagtggccaaggccccaggcagggttaggaacttgatgctgctggcagacaatggtctttgctcagctagccagtgaaaagttttgatcatgtatggataattctgatgacctctgcaagagaccagccacacgctgagccagtcttgcctaccaggtgtacaggccacagaatctggcaaatcccgggacttctgcttttacttctctcaagaagggttgtatataatatgaagggaatctggggtaaaatctgtcaaagtttggggatttgctaccacaggtgtcctgcaaagaagctttcttgtcttctctccccaggtccttggaatctctatactatctccaacacaatcctctcagactatatttagtgttacatattttgttttctttttattccacatcttcctctcccactaatgtctgggcttgcttgcatatactcacactcttaatgcacttcacagtgagcttgtcctggtcccagactttcaccaaggaattgataaactagtcactgcaaatatattaatgggctttcagatgatggcttgtcagctaactaacttactttttaatggagagccttcataaggcaaagctcagaacaccaataatttattctactgacatatatttcaggctgtttctctctaattttatcatgtaggcagcttctcctgtgccaacatgagccaaatgtttagaaaaatgagcctatagaaacacttttcttatgatttgtctactattcattctttaatttggcttttgcttatgactctctcagttctaactttacacagttccaactcaggtcatcaagaacttcctcttttctaaatttaatcaacacttcccagtcttttgacccggagaggcattgtacactgctaattattaccctggtgttgtttaaaacaacacaactaacaacactaaaactgacagcaattgtgtgtccactgcatccaaaaaagaaaaattccagattataattaacaggtataagtatatgcccttgattcctagacccttattcctctaggtctaaatcaaaagaggaactactgctggaggaatgaagttaagggagaaagagggatcttacttcccccctgttgcctttgcagatttttaggcctaaagtaagctccaactaggagagaacagttgccttacagcagggtttttcaagctctacattactgagattttggaacagatgattcatttttataggtggctgtcctgtacattacaggatgcttagcatcatctctggtgtctcaccatgcttgtggcatctcctgtccctagttgtgacaattaaaaatgtctccagatattccctgatggctttgagggcaaaatctctctctctttttttttttttaccactgcccttccgaaattgagaaccactgttttaagggaaatgaagttgggagctttaattattatgcaggagaggatatttgaattactgtacagaactgttcttgtgactaaagaacataggagaagtcatgagactggccgaaatttcatacagtgctagggaagcaaaactttaaaaaacccgtgaaaaagagtaaagttgttatgattgtacactctttttgccattttttgtgtaaaattattatatgcatttctttatctttagggtatttgaatatacatttcagtttgccccaggcagttttgttccaggttaactgttcatagagcctcctttcactctcaaagtgtctgattttcaataataaattatatgattgccctatactttctgttttctcaactatactataagcttcatgagggaaataactttttatttgtgcactgacatatccacatggtactctgatgtagtgatcaatcaataagtatttgtcaaacctaccataaaaacaaaattcactcacttacatatcagcaggattggtctggcccctatgaaaacaatgcaaccaggtttatagggaatttccttctgtgagtttggagatcttttctaggaggtactgggcttcttccccagattcaaggagtaggctggttatacacatagctgagtgtgtttcactgtcattgctctacaagacttattatacttaggaaggataactattactcatattttacactttattggtaggcctgttcttatgattttttccaaaggggaataaacaagcatagaatttagttagtgagggatagttcttatacaagaatgcagtgccaaagaagaatgccttaaagaactgttctagattagcatctttgttttctcatccttctttattttgtccttcaccactcttgagtatgcgctggcacacacatataaacccatgcccactaaaaaaaaaaaacttttacatactttgccttatctcgtgattttcaagttcccactttgggttacttgctgaagaaactgagagctactcttcatttaggagcaaatcaggcgtgatatgtaatgttactggtagaatccacaatttggcctttgataagaacaagatggcataattagcaagtcttatgacttgtcgcctatctgaagaaaagcataaaattgtaggattatagcaaatatccatctgcattaatattttggaaaatgccttaacacctctagaattgctaatatgttcccttctaaaataatggtaaacttctagaaataattattattcaagcagattgagaattaaataatgttattttctcgcccttgctgggagctttcacatgaattaaatttctcatgccattgagaatcaggcattatcaaccccattatatatatttgagttaactgtgattctgagagcttattatttaaatgcaggttttcctgactctgaaccattgtatctttcagtatttcattagaaatgcttcggccaaaattggaaggcacaaagaacaaatattctaacaaatttatttgatttaatcaggggaaacccttgtgaacttgaacaaattattaaacaatacttttttcatctgcagggtgaagataatgagtaaccacctcctaggactgttataggactatactcagataatgtgtacatagaacttgacaaactctcagcacatattagggttatgaaacttttcatcaagcgcagagaaagaatgcattctgatacatttatcaatgatttttaacatgtttaggaaataattttggaacattaataattctttacatgttcttttgttttatgcagtcagcaggtatttaatgagagtatgttactttggcaacattgtgctagacaccatagagaacatagagaaacatgctgtcctctgttgagtcacttactttctgattaagaaggcagaacatacacattaagttagagaacaccaagttgtgagattatacctatatgtgcaacagaagtttggtaaaaggagaaatttctgtgggccctaaacttaagagatgggatgaactttgttagttggctccttaagagctgtggaatatggagagggagggagcaggggagggaggacatgtggaggggatggtgatcatgagtaaagttatggagatgtgaggaggaaccaagttcttttgggaaaggagaagagtgaagcaactggacagagccaaaaaagaaagctgtttgactggcaactctgttaaatgcttcataattttccttacaaaaatcttgaaaagtaaatttgtaaactaggcctgtttcactaggaattgatcacgttttcttcattcctttcagcagcaatagagttgtgaaggaagaaaggacatgatagggagcctaagaaatgaacagtctcctagtgtgggttttctccacataagatagtatatacaaacatgcaaaggctaatctgtgaaatgttttacatttacatgtgaaataacctaagttgattaaaaatgttacttgtactacataaatgcatcttcaagtagcttctgtcctactctttgaattttgctttcactaaagaggtagggaatcttcactggaccgattaggctcctttatttccctacctctgatatttacctgctactgatggccttctaatatgtattgcagtggaaagataatatttctttagataaacttttgagaaattttaataactttgaagcctatttactagcatttatcatatctatgttttcaagtgtcctttcatgccatttttaacagctttattgcgatataattcaaatatcatacagtttattcatttgaagtgtgcaattcaatcacttttggtattttcatagttgtataaacatcaccacaatcaattttagaatattttcatcatcccaagaagaaaccttgtatgttctttagccttcactctccgcttcctccatccccccagctctaggcaaccacaaaacttctttctatttttatagatttgcctattctgggtgtgttgtataaatggaatcttatgaatgtgactgacgtctttcacttagcaaaatgtttccaggttcatccatattgtagcatgggtttcaatacttcattcctttaatattccattgtatggaaacaccacattttacttgtcagtatatcagttgatagacatttgggttgttttcactttttggttactatgaacaatgatgctataaacatttatgtgcaagttttaatgtgaatatatacctaggtatctatgcatcataccgtattgctgtgttttaccctttcgtgccattttgatcttagagctggcttcatgatatacctatatccctgcatcccagacacaagcatctgtcttcaaatggtcttgtttcatttgtctcaattttaggccatctgcttttcttatgttcatattctctgtcatgtttttatataaatccagggtttataatgccaaccaaatgcatatctttaactcagactatttctatggactttaaatctctgtatctaaatgctctttaccagataggtcttttttaatatcctacagggacttctaaatcaattttttatttgcctccattctaatgtgctcctcctcctatatattatactatgcgaatgacacatcctaataagaaatccaatagccatatgaggctcattcctttccttatccaattcatcaccaaaccctattgattcagtttcctaaacatatcatgaatctgttacttcttctccactctcactgacattgccttagtttaagctctcgtcttctctgtgcactggcctcttgtcactctgtagatcattcccttcctcttccatctattcttcctgagcctgccagaaggattgctctgaaacacagatctatgcatatcactcccctgtctaaaatatctcaatgattccgagtaatctgcagaataaaatgcaaacttctgggcttggttcaccaaacctttcacaatctgaccctaatgatctctcaagcttctttttgttttcatcctgtgtacagacatatcaaaatctctaaaagttctcagatgagctgtaggtattttcaccttcatgtcttaacattagttacctctccccatactgtcctgccctcaggccactttgtggtttggttaaattctactacaattatttttgtagcaaatcaacattttattaaaactgcagttatcttttagttattcaagataacttgattctttcaaaagaactttcagtaatctcagtttgatacattggactctttaagcatcttctactttatttcactataaatagtattgggctatattttaagtgtccctttactggctcaactttctcaactgattgttagttctttgagttatggaactatttctgttttacctttgccatctgtgcactctgtacattggtaagcactaaataatatgttgaatgaatgcatgagttctatatgctgtaaatattccaagaactctcggatcttatgtttcaggttctctgtgtttcatctgaccctacttcttccatatctagagccagagacagtattaaatacttgatatgcaataactggtggcactcttattctaatgcccttttcttacacctattttcatgccaactgctagcttgcttttctttttggttctcacagttattcttgctgttttgccttagttttggcaaggataaatgcttagactgatctccagaggccacaggacttgatctcactctatggctagtgagagatctgtgtgtgcctagtcttcatgctgggaccttattattctgtgcagctctgcaggtgactgtttgcgaaaggatataatgggaaatgaaacatttgcctctgtaatagttattgcttaaccactaaagaaaagtccaaatacatttccaagctttctgtaagtttcttctgactctccctttaaacaattgaatttattagacttttaaaaaggaaggagattgggggcgaaatgggaattcaacccctgcatatcattttttcctcacacacgtagttctagaatcacttctttaaacatctacttctgttgtaaggaaaatagcctttattttggaaccccatggggcttctgatttctctcattcaaatgaatgtatttgcagtttggaggaataattaatagggctctcctgttgaatgttgaatgagagagtgaatgccttttagccaaaagaggttcttgtttgtacacataaaatgtgatattctgcataaaaattatagttaacatctaataccaaaaatgtattacaagtctcttaatcagttaatacaacttttcaatgcactttttttttacatttgagttttgattggtaacatgaaaggtctttgatttggatattgattaacataaaggagtatagaaaaataagaaaatgtttagcttttttaatatttcatacagcgtttcatatgaatagaaaaccattacattggtgattatataatttagtgtttatcatcaaaaacatatttcccatgtttttaatctctaaggagtttcttctttaaagacatttgtaaagatttcagacactaaatggaaatctatttcataaagcaaagagaaacaactgtggtattgtaaggatcagaagtagttagcacactgaagttactgtttttttgtttcaaaatacagtattttgaagaaatatgaatagattttcaagcctacaggtcacctcagacattgccaataaggtcaagactggaggaaattaaagcaaaagatataaagtagtaaattttacaatgagacattgtttattccaggatataaataagattcatatatgggtatgaaagacatcttcataaaatgtaatatactgaatgactattttgtaatttgtttcagaggtttctgttttgaacttctgaagtcattttcaattctgataatttctatagactgagaactgtttccttcaatatttataaaatgtttcttgagattaccccctcgatactcttaatcttggaaaaaaatttttgaaatctgtaagaaaaatcaagcattcctctaagttggtttgtataccactccatcctccgcttgaaaaagagagaaccaataaaaggtatgatttgaaagcgcagatttatttcataaatttctgaaccaccctttatggatacccacagtatataaacaaccataatcagtataccaaacaacagcaacaagcacactgagaaacaaaggcatttggggaagagcaaggagcaagtgggcagcttcttgagttgctttttgttgatgatttcctactggaagtctgtaaatacaactgggtatagaaacagtcaacacaaatttgcacttttatggagtattgtgtgatacaaaatatactgggaaaaatattttatgaagaagcagtcttttgatgaaatgtatcccataaattttatgcttgactatataaaaagagataagctgaaaagccaagtcattttctaagttaagagcaaagacttgctgaaatgacatgttttttcttttcactggagcttaagctctgaggcgaggcttttggagggttgagctatagcttttcaagtatattgacaatagcaagcaacagacagtcttgtttagcttctgagtaggtttttttttccccctcctttcaggtattattgttaaatactgtttttaacctgttgtaatgtaatgaaaatggctgtcagcaattcagttcttaccaccaatcatgtaagcttgatgtaggaatattcactaagattacacaccaccaccagcagcagtaacagcagcagcagcagggaccctgactcttattgctgataataatgaataagttgaatatcaggctatgaaagtagtacatggtgagacttgaagaatgttgacagttactgaaaccttttttgcccacactgctcttgccctgccaactcttgggcaatatttcacagcaatctgaagcctaatattccccacatttatttatttatttatttatttatttatttatttatttactcatttacttaacaaacacgtatatggcacctattatgtgccaggcactgttctaagtgcttaagagaacctgatagggtatatattcttattttctttaatttgcagatgagaatacatgggtaaagtagcatatcattactttcccaatgccacacactataagtatttgaactcagtctacctctagaatctgtaccttcaatgactgagctatagacttctgcttctccagttgaagaattttgttaaagtgtgtccctgactgacagacaaaataaaccccctaaaagttaaaacagaaccaggtggccacagcttgctgagggagtggtgacatactctggattcttagaaccgtgttgtaaaagtaccacaggacttcctgtattagcttgccacatggaacatataatcctggcattcattttttaagaaggaaggggaagagaaggagcaaaagagaggaagagagaaaaggaagaaaagaagaataacagaatgaaacaaagtgcacaaaataaaaaatttattaaggtgattggacctggtgaatattctaaaacattcaagcttgttcagaagccagatacaatcaagccaaaccaattcctgttgataccaagataaactgtggctggaacacccccctccttcctccctcaacacacatacactggggcatttgaaagaaacatctcacagagacttctggtttggggctcacaaaccaaccaatcacaggtcactgccaatcagagctcagctatattgaccaatcagaactaagtgagtttcaacggattgggaatctgggcaggaacatttgctgtaaaactggaaccctctctatgttctctagaatgtaccttcctctttccctgatggctgctgcctcttttgggtttgcagacttcactggaataaagcctctttcctccaaattccattgttgttgttattgttttggagactgggtttctctcccacacccaggctaaagtgctgtggtgctgtctcggctcactgtaagttccatcttctggactcgagggattatcctgcctcttagccgcccaagtatcgggggctacaggcacatgccagcacctctggttaatttttgtatttttagtagagatggagttttgccatgttgtccaggctggtctcagactcctgggctcaaggcatctgcctgcctcagcttcccaaagtgttgggattacaggcgtgagccaccacgccagacccaaatttcttttcaaataacttttgttcatgttctgtacagacaggcaatatttgaaaatactgttgtaaaaaaggagcaatatattgatagccatgaatatattgactctaaacaatataaaggtattgtaaattgctaacaggtcttgtgaattgctcaaaggtgaactaaggctttagtggaggggcagaaacgtttaaaacctaggctgtgaggggatctagaaagcttcagaaaggctctaggtatatttggaaaagggaattatggaaggtaagatgggtgtccacatggacttctgaacagagttgactgttttagaatactcaccatgtctaatcaccttattacatttttaaaaattgtatatactctgtttcattctgttattctcttcttcctcttcttccttcctctcattcttctactctcctcttcccccactttcttcaaaaattaatgccaggattatatgttctatgtggcagtctaatattttactttttgtttattgaatgcaaaggacaaaagctctcgtattaagtatactcattgtgatttagagtgacagtccttgggtacattcaaatccacattggtgtgtgggtttgtgttagcacacatagtgttatatttttgtttttagttaagttaaaatgcttatcagccaggataagtgttttacaataacacatacccacacacatctcagcagtttaaaataacattttatttcttactcatgttatacatttattatgtgaggacaattgcactgaattgtcttcactttagatctggcttgataaagcagcgactggcctggaatatcagttaccatagctgagaggaagaaactttagaaggttgtacattcacaattaagatctaatttacaaatcattgaccagaattagtcacatgaccctgtctcatcactaagggccaggctgtgccatcccagcctgtgcccagaaggcagagaagccccatgacccaaagtagcaaagacttgaaagccagaataattcatataaatattggtaatttttttttagaaaaatcagaggatttgacaacattgctccacagccctcaataggaaagggttagcgccaaatagtagatgtcattatataaattatatggcaaatctcccatttaccatgtcctcctaatctccctgattagtttcccattattatatttattgttcttgcactgttctttttcttatagagagtttgaaaggaaggtatctgtagccatatttattaaaagtgaaaaaattaaagatgcacactcacaaaaaaacccaaagcaaaacgaaaccaaaccccctcaggtttcaaaaagaatggaatcgtatttttttttttttttttttttttgagggagttaaaaaaatgtctctggttgctaaatactatttaatcttggggaaaaatgtctgtcagaatttacttgatttgtcctctgaggatatttaaatgatctaccactggtctaagtaaatctaagaatggggtacatgcagatcaatttattttttcttaaaaaatcttttaaaatttcatttggggttacattttaaacttatcattaaatatacacatattgttataaatagaagttatagtagttcagctttgaaaacactagtgcaggccaggcgctgtggctcacgcctgtaatcccagcgctttgggaggccgaggcgggcgatcacgaggtcaggagatcgagaccatcctggctaagacggtgaaaccccgtctctactaaaaatccaaaaaaaaaaaaaaaaaaaaaaaaaaaaaaaaaaaaaattagccgggggtggtggcgtgtgcctatagtcccagctactcaggaggcagaggcaggagaatggcgtgaacccaggaggcggagcttgcagtaagccaagatctctgggctacagagtgagactgtgtctcaaaaaaacaaacagacgaacaaaagtagtgcaggtagaatttaaaataaactatgtgcatgatgtcatgcatttttccttttgctgtcttagatgttcttaggattttattttctctaaaaattttcaaggaaaattccgatactttttatcttgacagtgataggaagagagttgaatttagtcaattagttgccaaatgaaacagttactaatgtaagtagactgaatgtaaattttattgtttaaaagaacgttggtcagccaaacatatttgaagtttagaggaatcatttttggaatttgtgaatgcatggttgaaagtaagattaaaatatttttctagtggcactggacactactgaagttaaacgataataaaatactatttaccattttatgtaagaggatgatcaattctgaatgatgtacattttaggaattgatctatagaatctaaaagttggtatttcacttaccattattgtgaggcgacctctacatattgcagagaacaatttttttttaccttttactattaaattgggatgaaatgtggctattttactctaaatatgtagtgtcacactttaaaatatattaaaatttagatggtttaatatgtattgccaattcatataaaaggctacagacaggtgagtgaataattttaaggaatgacaactcaatgtgttattcctttcaaatgaaagctgtaaaaactcattctgcctactctactcttagaagctaatataagttcaatttcttttcatatttcaattgtaactgaatttaaaatgcctggtttccttcatctcttacagtaacatttctcaaaatattttctgaagtgcatgtaaatcctatctgggaaaaaatatatagtagattggcttttgtgtgggttaatcaagtatggatagataaaaagacactctccttaaagcaaagttgttaagcatttttgatgaaggtgcatctcatagttaaatatgataggcaccaatttctctttttcagagagaatggaactgacatcacagcatattcagggataatacaagtatccatatattctgaataaagggaactggggagggatggtgagccctttaagaactttcctcagatatgttacttaccagctttgcatattaagaaggacattttgatcacaatatagagaatccctaagcaattaattgtttcttgttgtttttcccacgttcattttcatccctaatgtcccatgggctttctgctaggtacttttctttttctccatcaaattttggttttcagtattttagtatttcaggattttaatttgtttgttgaatttcttgtcttgtatgttcttattcattttgtgacatgtataccatctcttgataggaatatgcctatttcagtactcaagacatggtctggaaaatcttaaatctttcccttgacattttttttctgtttttttttccctgcgatttttgaactttactttcttgatgttatacacaactacttaatatcctgtataatggtgtcattttttcccaaggtctcaatgatttccttaatcagccatttcttccattgaggcagaatggtgttgagagagaaacctgtcatttcattgctttttcaacctcctgagagattgtcaactagtcaagtagaacatttatcatatcccctactcttaactgtgtgagaatatccaggtagttaaagactttctgtatgtttctgagttcattttctcttcactattaggaaagcagtatttacataaactcttgtttagccatctttcatctgtctgtagcctcagtgcatagtgcaatatctaattattgttcaatatatttgttgagtaatataataaatagttgattccagttcagtctgctgtgtactaaaactttttgtatctatctttattcttttataattatttattttttattttaaaaatttattgtattgtcaggaccacaagcaaaatgtgttgcagtgtcttaattcttacacacatgctctctccatgctctcccctcaggtttgcagatttcagttcatgtcttctacatgtcacacagcatttttttcacggtggcctgccttgttattactgtattgtcatgagttctaaccaatgtcttagagaaaccaatgagaatttgtttactaaatatattgttttgaacccaattttattaattattcatattgtataaatattcactctctttaaagttttaagtattgtatcagacttaagccataacttcaagttagttatgactgagaatggatgagttcttcctccaaattattctttccgggctatatatgtattcataacatcccattgtattgttttatttgagcttttttcccttctcttctatattacagtttaagcgatcctgctgaatgtctattttatgatctcaaatatttgaattataagttgcttctactataagaagacactggaattaccacaagaattcacatgtttaaaagatgctttcccacccgtaaaagtgtcagtgtgtgttcattgtacacgtagttaaaatgtgtgttgtagatttgaacagagaccttttaacttagactcaagattatgtgattattaaaacacactcacatctcaaatccttggttgtcttataatgtcatgacctttaactacaagaagagatgcaaatactgcatattctcacaatacttaagcggttagaggggcattttagacttctttaggtttttccacttattctcagagggttagcagaattgatgagtgagtatcaggtgggtttgatacatttgggcaggaagagagcaaacttctctattagctgtcaaatatacatcaatacgtgatgccttccctgtatttaacagcagttcgctagaccatctcccagtattctgttgatctagtaacttcaagttttttgtcacatagaatgttataatttaatcaaaaaggtaagtggcaaccttctttgagaaagtcttatacctgtaatgtaacttcatgaatccaaagataaataatagaacagtggtctttaaccttagctacatatagaggactttagagaactgctgatggctgagatccattcccagagattctggagtacaaaattttaggaattcaattttttaaaagattctaaggtgattataatttgcaaccaatttcgagaaccactgatatgatgtagcacatacagatcaccattggatcttcctaagatgcagattcattttctggggtgtctttaagtgggggcctgagagtttacattccaaataagctcacaggaaaagctgatgctgctggttcatgaaccacactggagtagagggtgtgtagaatttatctttttttttttcctctttttcataatcttctactctccagaacttggatgcttgttttaattccatactatatccctggagttttttttttctttcccattttgcttgtgagtttttgctcacaagtttttctaagaacttgtttctaataaaccagaacatagaaagacattcctcgacccttgagcttcttctagcaggaaggccaacttgcatttatagtgcacataattggtgagtgcctcaggcaggaagataaatatatctctggtcactggaaggtttctttcagtggtcttatcttccaggtctcaagttgaaatattgtcttttataactcccctgggagtccttcttattaacttctgggacaaactgtatccaagtgattcaggcaaccaccctcccctgcagcgaacctctacttaattgcttgtttttgataattagctccaagtggccctagtttcttgaatgttgaaagcaatattccaatattcaatattctatttaaaaactcatagccttttctgtgtctttttctaacttaccaagagactctcagatctctgaactatgttaaatggtgtttctcaaatattattgtgtgtgagcatcatctgggctgcttattaataatgattcctgactccatattcagagatcctgatttggtgactctttagtaggctctagtatctgcgtctttattatgtgccccactaaggtgagtcttttgtaagcaatccaaacttggagaaacactaatttgacctggcttctcgagctttaatgtacattaaaatcaccagataatcttgttataatgcagactgtggcttggggatgaagtatttctgacaaaccctcaggtctaagaggccacaatactctaggtactaagactttagatcatgtaattaataccacactacagcacaattcagactgacaagtgtacgttcctttaatcaaataaaggacatttttacacttatgcttttggttagaacataagcttcctttttttgtttgtttgtttttgtttttttgagacagagtgttgctcttttgcccaggctggagtgcagtggcacggtctcagctcactgcaacctccggctcctgggttcaagcaattctcctgcctcagcctcctgagtagctgggattgcagatgttgcactaccatgcctggctaatatttttgtatttttagtagagatggggtttcaccatgtggccaggctggtcttgaactcctgacctcaagtgatctgcccgacttggcctctcaaagtgctgcgatgacaggtgtgagccaccatgcctggccccaacataagcttcttaagagaaaaaaaaaaacaaaaaaacaaaactcaattaatagaataccaaacttggaagggaccttccagatacctaattcagaggtcttttgcctaagctcaactcaagggcccaaacgttcagctccacctcattttgtttaaagaaaaaattaaatgtaaacgtattttaaaaagacttgactctccagtttttctcaggtttcaaataactctgaaagcctttgagtctggcaatctgctggaatccattttgttttgcttatggctcaggaagaaaaagccgttggtcaacatcacactgctaattgttgaagagctaggattgggcttaaaacttgtcaccaggctgggacaagtttgtttgtttatgcttaagtaaaatctgagtcatggtgctgattttaatggttctctggatgtgtagaacttataaaaagacatagaccctgttttgctttagtattaaacatcaaaagttataaaagactaccctggagatttattgttgatggagataaggttggtctttgccttttgcttgctttagtagatttaacataagagagatttatctaaagcatcaataaactggcatctctcatgttgaaaggaggcctcagctcttcaaaacatcctttacaggtaacatgaagttcttttccatcatttgtggaatgtattacagtgaagaaaaagaaaaaaaatatttaggaggaaaactgagtcaaaaagtctggtatggactgagcagaaatttttggagctgaataaggctgaattcaatcaaaatcctgccaccttctgtgtgacagatcctaggcaatttattttatcatctctgaacgattttcctatctgtgaaatggagataataatagttaactgcagagctgtttgtaattctatagcatgatagatatatctataacatgaaacacagcaaagaataattatcagctgtcttcatagatttgttttcttacatattatagctactgtaaattctcattttttcatatttgctttctctgagtaaaaggtataattttagtatatttagtctactgaaatcttggaaattttacatagtttacttaaaagacataaatatagatggaagattgtaataaaaatattcaaatatatatatactcaaatatgtatacatttaaatataacattcaaatacatacatttatttatatataacattcaaatgtgtgtgtgtgtgtgtgtgtgtgtgtatatatatatatatatttttttttaacctttttattaaaagccaggccaggtattcagaataaaatttatgagaaaaacaagatgacttgtactgagttataaaacggaagattattagctttatagaaaataatcatttggcaagataaaacatttctctgagacttttgctatggatggcccagtatttattcttcttgaggaaaattttgagcaatagaaaaactactagtctatagtggagagttttcttattttgctgtgtccttgggaaaataatggaattcatttatgttcattcatttaacccaggagttctccaccagggacaattttatcccacctccacctgtaaaggggggatatttgacaatgtctagagatatttttgtttgcctgaccaaggcaggtgtgctactgtagcatctaggggataaagaccaggaatactgctcagcatctcacaatgtacagggcaaattctccacaatacagaattatcagatccaaaatgtcaatgctactgaggttgagaaacgctgatttaatctataaattaaaacaaatgatacctattttaaaaacctgtggctctaaagcatgctttcttaatgggggcaatattgttttcaaggaagcagaacgttgctacttagtgggtgaaggaaaaatcttaggtattacaatagatagtggccctccaaaggtcagtgctacccattaatatgaagagagctatagtatatctgtctttcatagaatttcatagggggaggggtgggaacagttagggaaaaatgtgtaagtaggctacttagtagtgataatgaaaaaagttgagaaacactatagatatatcaggaaaatttatcactcattaaatcatgtccgcatgttctgccctagtcttttccccttttgtgccttttaggcaccataatagttagatcatgggatctggcagccataaaggaactgttgcggccaagaactcctgaccactcctaggcttccttctgacttttattttattttatttcatttattttttttaatacaggacttcactctgtcactcaaggtggcacgcagtggcataatcatggctcaccacagcctcaaccctctgggctcaagtgatcctcctgcctcagcctccctagtagctgggactacagatacattcaactactctcgactaatatttttaattttttctttgttgaaatggggtcttactatgttgctgaggctcaactcaaactcctggccttaagcaatcctcctgtcttggcctcccaaaccgttgggattacagacatgatctcttgcacccgacccctctgacttttaatcctccaacctaatcctgccacacacccacccactctcacttagtctttctcagatacacctctctcctcctcctttcttttatttctttggtcaattattcattctactatcaagtcagaaaataaccctacaactgacacatctctgtctagggaaaagaaagtcaatagttgaaaggaaaattgagtatgcacgtgagctattgcttcatccctgacagtgtgaaatactcttcagaatctactcatgtcttctgtcatttccttcacctgcttttccttaaacaccaatattaaattaatccaatcaacaaatactgcttgagtgcctcccataggtagggcatagtaaattcttcctcttgggaaatttacattctgaaagaagaggcaaaaaataacaataaacataagtaaattatacagtaggctaaatggtaagtgctacagaaatatacagcatgataatggggacttggagttgctggaatttgaggatagtatgcagaattaaatagagtgatcagggtttacttcatttaatattgtatagcaatatgtttcttgatgatagctaaaaaatagctaataactttaaagaacttaatatatgatgcctacatttaattttgacaaaattatctgtgaagtaggtactattgttaccttcattttacaggccagcaaagcagagaacataggcaactttcctaagttcataaaactttcctaaagctttactaggaagtagcagagccacattcaaacctacaaaggcctgctctaggcgcttacccctaactgctgtgttatgtcgcatttctattgagtttaatggcattacaatgcaattcctgtttaatcatgtttcataggtaatacagcacagtgattgtaaaagaaaaactttgcacccgacatttattaacaatggtaaggaagactttaagattcttgtgataggagagatttaacccagctctgaacacagcaaagactgctggggatttatagccaacgagcagagtgagggagtcagtggatgagaaattactaagaggaacttgattcaatatcaagggtaggatgatttagtcaaggagggagttcttgtcatggctaagagagtggaccctggcactggcctgctggatctaatttgtagctcccacaaaccagctgaatgatctcaggcaggtcacttcagctctttgtgcctttgttctccatgtatactaattcatagggttgttgtgagggctcaagtaattttaagcaccatttatttactgaatattcaccatatgttattctagacaccctctttatattgccagtaactggcacaacaatactgtgaggtagatattattgtccccattttatagatgaagaaactgcggcacatgtagcctatttagagattcaaaacaagcaagtgaaaaggactacatataattttgtttctaactgatccgccttttctgttttattcagtctttcattagctactttatgatgagtattgtcacaacattgtgagaaataaaggaagcacctgcctagaattttctctggagagaaaatgttatggctattttttttttttggcttttaaaaattacacccagtctcagaaaacatgcctcgtttcctttcaaggttcatcttccacctctcgtcttgatcccagcatctccctctcctctgaggcctaaggcatgtgccagagttatctctctctcccttgcttgcatgttttactctgtcactgctggctcattccctagtacctgtcacatgctcgagtctcacatcttcaaccttatgactttagatatcaccatgtggatctcactcttttccttccaggcatcctcattggaagacctatttgcagatgttgcctttttgccttttcttcctcagctactatttgctcttcagcttctccaaattatgcttccactcctcatcactagattgcactgcacttgacctgtccctgggacttatgctgtggaccctctttttacctgaacctccctactttcttaatttctggtacatacttttctcatggtattcctcttacttttccagccattcctgtcaatctctaatgcccacaccaaagtgatggtatttctcagggtttcaccttgacactcttttctggccatgctgctcattctctcactaccttaatgtgtccctgtttcatagatcggcagccggatagccctcccgatccatgtgttatcctactgtccactgaatagctccacagattcatcacatctaaaagtaaacttatcctttcccttcccctgcagatttattcttcctctggtaattcttatcttgggtattggcactgccattcatccatgataatatatgtaccaagtgtagtctaatacatggtggaaactcaataaacagtcactattaatttaatcctcacagaacactaatatataaacactattattattgccattatataaatgagaggagacaaaagtgattaagtggcctgctcagagtcattcttgctttatttctcaaacaactaccaattagtaaccaagccattttcattatacagtatgtctccatctccctctgcctttgttcaaattctctttatttctcacttgaataaaactatggtaataactcccactggccccttcttcctgtaatggcacctcaccaccctccatccatctgcattctggtcaggtcaaagtgatctttctaaagattttacctgttcatgatattgtctttcttaaaactcttcagtggctcccatgtcttgcacttcaatataaaccctgtagcatggtgtagtggggccacctgagcaaaaatcttttttgtctcatctctttccatgcccctgccttagaactcatggtcagaccacacaaaatagtgagtgagtttctaaatgaattacccttcaaagtttctaaatgttttaccattccatgactttattctaactgcctcctttactcacaatgttctgttcttttttgccctcctgaggaactcctacttatcctctacagctaatataaaatatcaactactttaggaagcatttctacctgacatctcaggggcaactgaacactatttcctctcaatacattgtgtatgtgtattttgcatagcattttaacagttttaacagttatgttgtcttaatttaggtgttagagctgtttagagattgaactttgggtttgaattcttcatctaattgaaaagatttgtgtctttgggtaaaccactctttcccttatctacatctataaaacagggatcaaacagggttacttagggttattgggaacattaagataatcacagaagtgtttggcacattagactttgtcattttcctgctctcaacattccaatgggttcctataatacttagccatagaatttaaattattatcttttgctatttaaaagtatttcattctaactttatagcgagaaagtttggaaagtgaggggtacctctacttattgttgcctttataatcctgcatgatccagaccttggctatcttgccgacctgatttcccaccattctccctttgtttccccactccatccttattggcaaccctgctcttttttactgcatcatttaaactcttgcctcaccacttgtgctcctgcagattcctccacctggattgttctttccactgatgtccaaatggttcactatcttcttcaatgcaagctgttacttgaaggtcacttatctaaagtagactcctctttattttcctctgatcctctttaattttcttcatcacacttattgcttcatgtgagtcattgttttgctggtttttgtccactctcattcactgcagcataaacgccatgactgcaacaaatttgtttactgatatatcctcagattgaaaataatggctgacttatggtaggcatttaaatatatttgttgaatgaacaaatgagtgaatcattggattatgttaatattattatttgttaaatgtttctgaaaggcagagatctgctcctctttgtcttcatacaccaagttcattgcttataaagtgtattccttggagccttaaaggttttcacggactttctcctggggtccagctgtcttggtttcagggttaaagtaggtccaattttacttgttgtatacattgatctgcacagtaatagtttcactgctaaaaggctttgaaatccactaaccaagtgtaattcccaatacattcagtaaatcattcaataaatgtttgctggtgaatgaatgaggtagaaaaaaaatgccagaaatattatctttaacgtgaaggaaaacgtagagctgacattttcttgaatagcctacccataattatctttccccagcagcattaactttacttgtacatccttgcaaaactgatttagattttattaaaattaaaatatgaattttaaaatatttttctaatacagcctattgtcttttctgctgttgtggcattacttttattgttttcttgatattattaagttagtcactgaataccagtggtagatactgaaaaagtaagtgctaattaaattaccaaccataagataattactttattattagcaaactaaaagatgatgctgattcaacattctccgcattttgctaaactatttcttactaaaaatctacatcttcaaaatatctagtgatatctgattcagacaagattaaatttttatttgttgactcttgaaaatattacataattatacttgattggcatatgtaattaatgtaaatgaactcattttgtttgaaaaaataggaatggccacaatgacataaaactttaaatatttagtttaatatagcactttgggagcctgaggcaggcggatcacgaggtcaggagtttgagaccagcctggctaacatggtgaaaccccgtctctactaaaaatacaaaaaaaatcagctgggcgtggtggcgggcacctgtagtcccagctacttgggaggctgaggcaggagaatggcgtgaacccaggaggcagagtttccagtgagccgagattgcaccactgcacaccagcctgggcgacagagtgagactctgtctcaaaaaaaaaataaataaataaataaaaacttaagtggtaataatacaaatataatggccataaaaggatcaaaagcagttccatatttaacagagaggttatttctgttgcttgtgactataataattcatattctacagtatctttccaccatggtaatttccaagaaagtgttccaatttttttccagtcctatcttcccctcttcttgaggacacacacacacaaaaaaagatggaagatggtggtgatgatggtagggtttgaggtggaagttgagaattgaaatcaggatgagggttaatttcatgatcattacaaggagggaggaagctaattctggccatgaagcaagaggtgtttgttagccagagccactttgcataggaaacagtagagggtttggacatcacatacgccatgttgggaagaagtgtgactgtcttccatggctaaactgaactgaagaaaaatgcatcaaggtagtccaaacagcttactaataagtgatctagttagattagagagatatcactacttagaaaatcaaattaatcaatttgaaaagaaggaaaagtgatatagttgacattggaaatgtttttgacacctttgtcatagtgacagtacacgtgtttgtgtttttcattcttgaggtctagataactttcagagaacagtgatattttgagccataggaatttaaaaataccatatcttcccttttttaagttagtttaacctgtgatttacatttgacaattgaagtcttaaaaatctctagccaggcgcagggctcacacctataattcctgtgctttgggaggctgaggcgggcagatcacaaggtcaggagtttgataccagccttgccaatatggtcaaaccctgtctctcctaaaagtacaaaaattggctgggcatggtgacatgcgcctatagtcccagctactcgggaggctgaggcagaagaatcccttgaacccgggaggtggaggttgcagtgagccagaattgcaccactgcactccagccttgtcagcaaagtgagactccatctcacacacacacacacacacacacacacacacacacacacacacgcacacacacacaaaatctcttcactgaccaatgtagaaacaaacatatttacacacaaacacagaccaagtttcactttgttatatgacaatatgaaacaatgcaacaggcatattttaataaagtgtataattattaatcatttaaaaaattatttaatggaacatataacaactatatatagatattaacatttggaaaaaaaacctaaagaagatgtattttgacacccctcttttacagatatggaatctgagatacagaaaaggtaacaggttcagtcatatagtctaagttattaatatgaatcaagtctagaatcaaggtttttaggctcccagtacagtgctttttatcaatgattatataagagaagtctgtatagatcatttatttaatatttagttatgtatccactcattcaagtattactgtgaatgagtagattcaaaatatattttgaagtcaggtgtcaatttacacaagatatgggaatatttcccttaataaattcttgtacatctaaatattttcctgtgactataactttggctacatttcatgctacttttattctgttctcttctaaaagtttataatttatttattattatttggcattttcttaagtaaatagtcctactgggggtcattcttttattaaaaatgtctagtgttgctgcattaaagtttaaagttacagagattttctactttgggaaattatttgatgttttaatggccaaatacacagtgaatttttgcaaatattatgtggtattgtgtttcttggtttcaaagaagtgtggtgtgtgtgcatttcatcgtatttgataggttacctcatattcaaatttattctttgtttgcttattttttgtctacttgatctgtcgctttctgacaagtatgggttataatcccctagtattactgtgaatttgttaaatctttcttgtatacctagttttgcatatttcaattctacattatttggtgtaaaaaagttaattgtatatatttttggtcaatcgtatatttaattgttacatatcttttcttgttcttgaatttactgttagtacagtcatcccttcctatctacaggttcctcatccaaccaacctcaaataaaaaaatattttaaaactattaaactatataaaaactattaaatattaaagaatattttaaaaatatttcaaaattatattttattctatttttattttgtaataattattaaaactatagtattgcaaatattacaatattaaatattatagtattttatttgttaaatataacaaataacaatatagcataacaattatttaaatagcatctgtattagtctgttttcatgctgctgataaagacatacccgagactgggaagaaaaagaggttttaatggacttacagttccatgtggctgaggaggcctcacaatcatggtggaatgtcaaaggcacatctcccatgatgacagacaacggaagaagcttgtgcagggaaactctcgctttaaaaatcatcagatctcatgagacttattcactattgtgagaacagcacagaaaatacctgcacccatgattcaattacctcccagtggtctctcccacaacacatgggaattcaagatgaaatttgggtggggacatagctaaactatatcagcatttatattgtattatctattataaggaatctagagatgatttaaactatatgggagaatgtgcctaggttatatgcaaatactgtgccattttatataagggacttgagcatctgtggataattataggtagccaagagggtcctggaatcaatcccatgtggataccaagggatgactgtattgctatatttcctttttatttctttccacatttgtctgatgtatcttttctatccttttatttcaacctttctgtgccattttgtttcatctctacctttacaatcagcacatagatgaatttattacttttttaaaaaaattataatatcctgttttatgttttctggttgccatctttgttgttcttgcttgattcaagttattattgatttttttaaaaattggccatttaaaaatattttatccttttttgtgatttggattttttatcttgtttttttattaatgattcctaaatttttaaaacatatttattctaatatttttaaatttagcatctaatattattcaatgtttacattctcctctgtctttcctaaccaaaaagacaatgttcccaccactcccattataccttataacttaattacatctgcaatgatcctttttccaaataaggtcatattcacaggttctgggtgaacatgtcttttatgggggcacaaatcaaacccatgacaacaagcaaactcttagtcaaatataaataccaatacaaagagtggtatgtaggctgggcatggtggctctcgcctgtaatcctagcactttgggaggctgaggcgggtggatcacttgaggtcagtagttcgagaaaaagtgatatgtaaatgaaagttgatgtgagggtttatttacattgctgaaatgtgaataatggagagttggcaattaaataaatatccaaagttcagtattctgtaattcatagtatgtctctagaacactgaatctcaagatgtaatattcctacatgcattgaaatatgacgttgtaccccataaatatgtacatttttgtgtcagtaattttttaaaagatgtaatgttactataaaatcacttggggtctcctatttaaaaatgaagatattttaggctccactgccagagatcctgattaatatctgacatgggacccatgaatctgcattttaacaggcagaggagaaaaatttaagttttgtaggtctaggacccaatccagtttggggggtcgttctaaaagaaaaataacacaagatcacaaggataaaattaggtacagtgtcacagttaagtatcctagaagcttaagcttgactatcttgttggcaaatctgcctcagaaggcacaccaagtaattcatgcccatgttccatggacgacactcaatggaacactgatctagcataccctttctaccttttggttgttgttgctgctaaacatttcttcccagaatataatgctattacaagttgagctttcctttacaaccttgtagttaattatttaggcaatacctttaatgttgattaaaattatgactacatcaggggatagattgatctttgttattgcatgtaagatttgtgaatttcaaaaattcgtttgatatagtccttatgaaacaggagagttcccttatcccccttgcacaatgtgtgacaggggtgtggcttgctgctttcgtcatctccgtgctcaaacccctaggggagcatgcagatgggcaggtgcagaggctatgggggagtgcttttgggctccaaccccacgacagcatctaggggtgggtgtctgcgactcctgaagcccaagtgggcatgtgttacagtgggatctttgaactttgctgtctgcagatgacttgtgttaatcagcacaacagaccctctgccttattgcaagggcagagggccagcgtgacagctttctgtatcccgagctcttgcccagtgtactggaaaattgtattacacctgggttcaaaggatgagtgcaaggttgtattgagtggtggaggtggctcttagtgagttggatggggagcttgaagggttatggagtgggaaggtagtcttcccctggagttgggccacccaagcggctggactcttctctgatcacccccggccgagttcccttcagcatccagacgtcgctactcttctctttctctgctgcatcattctgctgtcactggtctgcctgtcggtctgttcctgtgttcctttcaatgttcaactgcttgtatctgtgcccactaaggtatcaggtttatatgggcacaggatgaggggctttgtagaccagagttttcttggaaattgcaacatttgggcatgaaaacaggagtgcccattctcacttaggtccaggggcacaagcccaagggtggaggcctcaccagggatcccacccttctctactcagcactttcctgccccactccttattacttattgttacatcagtattaaatatttatattttctttcctggaagcatcatgggatagaataagggacattggttaaaattctggtttcctttcttggaggctccttatgcatgctacaaatatcagattgctccaaaaattaaacaaggtgatgcatgagtgcctgatacgggggctattacataggacacagatgcttggtcaatatttctttcctcactagttttttttctttttccctcactcacctcgttttgctttctgtaagataattttgcccctagattattgaagaactcttgaagaaagaaactaaaaaattatctgtggaactttgcgtttcagttcttatattgttactgaaattttgttacttattctgtctgatagaaaaattgggtttataataataatcataatattttaactttttaattgggtgctttctttaggccaggctctgccatcagcgctccatacagcgctccatacaaattattaattttaattctctcatcaagcctacaatgtagacacaacaattatctctaattttaaggaggaaaaaaaactgagacttacaatgatttatgtaacttttccaagaagtcacacaatgaggaagtggcaaaacagagacacctatgctgccctgatcctgaaatcctactcttggccactgctataattctgagataatattccacagagttgaatcaagtttattcatattaatcaatttctcttacttaacaatagacttctgtgtgcattaccagccagtggtaatagaatgctgtttgcttcattttaaatactggcacagagatattgtagttttgggcattttaacccagggaattactgagaatataatttttagtgattgggtagaaatgcttttaatttccattgtctcttggcagttacactttttagtaagattctttgctgtacatttcagtttcgctaatgtgattatgtgggctaacatcaaaagggttcattgcttaatgaccaagaaccaagcatgtcaggatgcaggaattggaaatggttttaaataaatcaatttcaagtgaattaatctttgaaaacagtgcctgagcattttccatatgaaagtcatttccattatgacttcatagtaccattcaaagtgtctttttgatgtttattgtctttatggtagcaagagtagctacattgtgttataataacatggtttatttctgcttctaaattatccacggatgagagtggatttatatagctgtgtatatttgctcagagcctcttcaatattcttccagaatcacttgtacattggctttggttgtgtatgtatctttgtgaaaatgacagcaagcactgaatcagagtgatgcaccatttactctgtggtgttttatgtattgtcactgcaattgcatgttcacaggcagctttgtgtacttaagatttacaagtcatttgtttgcttccaagaagccatctgagatgacagtatatattaaagttgctaaacaaattatatatttcttgtaccgaaaacttcagtgatttaagatgcatcgtctttcttccttcctttccttcttcctcctccctccctctttccctcccttccctcccttcctgacttcctcccttcttcccttccctcccttccccacttcctcccttcctcccttccccacttcctcccttccttctctttctctcttttcttccttccttctctctttcttttcttcctgtttttccgaaaagcaatacatcatttgtaattcattacgtaacttcactaagaacctgaaattattttttattagaaatcccttttctttcagtttttgcttttgcatttatattgtctttgtgactcagcttaatatttaagtcacaaagcaattcagtttttaatcattttattggtattattaaacttggattttatcttcccctaattaacgaataaattgataagatcaaaatctcagatatggatgtgatagctttttaacaataaattttccaagcacttagtgtgtacaaaaaagatgccagagctaagaaaaaaaaattgttgttagaagaatctaatatgctccataaaccagtaaaataattatttcaaattttattttaaaaatatacatgggatgcttataagtaattaaagtaaacatatacatcagttccttactaaaataattttaaatttttttagagtatgatgatttcacttaaggaagttttctgggacttaatctgaaattattaagtatccatgttgtaaggtcaggttaagatattttattatttttggcagttatttatagagttccttctctctccccaaattatatatctattgatcattatttaattcaaagaaagcttgtgccaaagtaaaattataccagtagtgtttgatgtagaagaatacagtgaaggatagcctgtataccacaggcagaaatacagaatcctatatatttgtaatttgtgcttatgaaatactatttccaaatctgattatgtgtaggtccaagtagataaatttgaaaaaagtaataaatatctttttattctttttttcttttgttcctttttacttcctcatttcttcaccgcacaaatatagctctgagttataaatgaaaatacaaagtgatgagcaccaataccctacagtggctttcagacatagatttctggtgcctatgaagaactttgtcacacaattgaaagactttttcaaactgtttgggatttgaatcatcaaatttgaaagaatttggcagttattcagcgtctccatctgcctcccataaaagctgctattattaagtcatcccagtgagatgggaatctatgctttcttttaggctttgagagaaaatgattcagtaatctctttttttaaacttatttcagtgtttaataacttgaactgtcaaaaaagattttttcatcattaccctaaattctttttgttgtcatttaaacccaagaatcagatgaacagcctcatagaattaatatgtgaatgcaacatcaaaggacacaataattacaacccaggctgttttgtgtcagtcaagccatcctaattcttaaagtccagaactgggattcttattaaaaatgattacattttagtatttaatactcctaatatttatgaagaggtaatttattgaatgtgcctctgaatatgttaaattgtctaaaaccatatttaaacattattttttataacatacacattgttaccctttcggtttcctttggttgaaattattaacctgtgaatagcaatctgaatagcaggaatgtatagaatcctaatgtagaagtatttattcttatggaaacaattttgctaggacttcaactgttctggaagttatccacttggaacttagaataatgtcagtaattttttgtaaaaatagaaattcaagtttattgagccattccatttattgtcggtgtttttcatctatttcaatctgaacctattttccttgatcagcttcctgatccttttggttcaagttctaatccttcttgtgatctgcctcacctctacctctgttaggttttctgcatattgggtactatgtttattatttggatgatgggttcaatagaggcctaaagcccagcattatgcaatatatctatgtaacaaacacacatgtactccctgaatctaaaataataataataataataattcaaactcacagaagcagagaatagaatggtggttaccaacacttgggagtaggtacaggttgagtagatgttgaataaaagatacaaaatttcaattatataggagaaataagttcaagagatctattatactacacggtgactacagttaatacaatgtattatctacttgaaaattgttgacaagtagattttaagtattctcaccataaaaaattaggtacagtaggtaataaatatgttaattagcttgatttagccatttcacaatgtatacatatttcaaaacatcatattatacaccataaatgtatacaattttaaatttgtaaattaaagaaagtttcaaattttttcatcaaaaaaacctaaaattttaaaaattaatgacagggaaaaacatttttaaagaaaaactgtggctggacatggtggttaatgactgtaatcctagtactccagaagaccaaggcaggaaaatcatttgcagcctgtagttcaagaccaaaatagtgaaagcccatctctagaaatataaaatcaactgagcaacatagtgaaagcccatctctagaaatataaaaagataaaaagaaaaactgtcataaatatatgatatatcataaaatgtcaccataggacacacacatacacacacacacacacaaatcaaattgtagaaagcatctatttccacctcacagttcaaaaacaataaaaaatatggcagcctcacagaaaaaataatctattagtttttctctcttcctataccccagctgtaggcattgccatccccaaacttctggcattattgttgccatactattattagctgtccctgctatcagtcctgaagatgcttatagttcattttctcattactttgttacttttattgctactacacttctgtcacctagttagtcactaggttgccagaagtaatttctggacccaattttcggacaagaaccagtactagaaatggatacaccatatagagcttttataattgcaataatttacctgtaattagatttgtttgcttcataaagtttccagttactctctactgttctttcatttcaacttgccatctccttttagcatttcctgcagagcaggtctagcggtaacaaactacctcaccgttttttatctgagagtgtcttagcttctccctcacttttgaagaacagttttgataaatatagtattcttggttgaatgttttttttccccctttggccctttgaatatataagcccactgatttctggctctcaaatgttttaataagtaatttttataaacttattgagcatcttttatatattattagtcatgtaaaagactaacctgctttcaaaatttgctctttgtctctggtttttgacagtttaattataatgtgtctcagtgtggttctctttgagttctttttgtttgagtttgttgaacttcttggatatttatatccatgtccttaatcaaatttaagattttgaccattatttttaaaaatagtttcccttaccatttttctctctcttctccttctgaaactcccacaatgcatatgttggtccacttgatgtgttccacaagactgaaaggctctgttcatttttctgcaatctttttatttcttttcctcagacttaatattttccattgtcctattttcaagtttattgattctttattctgcctgctcaaatatgtctttaaatacctttaaggagtttttcatttcagttattgtacttttaacctctagaactttttctttctttttagattttctgtctttttattgatatttccattttgttgatacatcattttcttgacattctccacatctcctttacttctctgaacatctttaagacagttgttttaaagactttttctgatagatctgccatcagttttttttttaggggcaatttctatttgtttattcatttatttgaattggccatactttgtatgccttgtagaaaactaaatatttgagtatagtagtatgataactctggatatcagattatcctccttccccagggtttgctggtttttatttgttttgttgttgtttacttatttttttttattggtgtaggctgtttctgtgccaagcatacacactttacaagtgtgtaaagtgaaggtcttctcaggtcttttctcagcctgtgcctccccctggacaagtgcagtaactttctgattccccctgtacatgtgactgcttttgaatgtcctagtctttaatgtatggctctcaaaagggggcaaagggaaaaattagaaggaaaaaagacactggcactgcctttttaaatttcatgcaaatcacttcaaccaaacgaggagcaacttgcaacaaagggtaactgcaacaacaatagccactgcctctttgtgtgcggctctgtgatcagaagcagcaattagtgatcagagcacaaatccatggtatttggaggacaggatgttttgtgcccaccctggctcctgcaagtggtatacaagctgctcctggagcacatgcacagtttcctgccagagggctaaggggtaagtggatgagtagtggctactatggtaatagatgaaattgacctaaatttacctcagtttttggtttcagccttaccctggaagttgcaagccttcagtatacacctgagttctaacagttacatcaaacagattctgccagtaccgtttttgtctaggtgaggagacagacttcaggtgcttcctactctgccatgtttccaaaaaccttcttatctattgtgttttaaagaaaaactaatacttgttagaaattactcaagaagaaagaaggaaagggctttcttcttctagttttaaaaattcagccccaaacagaacatatcatttagaatggttgaaattccattacaaataagagaaacccaattcagagtagctccagcagcagtgaagattgtgttagcctaagtaaccgaataatatgatgtatgaattaggaggtatatctggcatcaggaacatcaggaatgaggacactgagggtataccagaattctgtccatttcctccttctcctagactgagagatctatgctcttaagatatttttgctacagaggagagttctggtgccttacagctcatagctttgcctgtttatggacattagattttgttttctccagtgtggaaaaatgagatgttatttgaggatgttaggaaggagtttggcttgatctgggtttacattttggaaaggtaaccttggttgctccattttattgtggggcatgaagggtacaaaagagagagaagccagtaaggaggttattatagtagttcaaaggagaaataaatgtggcttggtgtggcatgggcagagcagaaagggtgggaatgtttcaactgggatatattatggaggataaaaaacaggtcagactgattgatttgaagatgtgaagaatcaaagaggaatcaaggataactcctgtggttttggctaagaaatttgatggatagtggtatcatttaatgagaaaggaaatgcttagggatgagaaaatgtggtttaagattaatacatttattaagcccttaagtagagattcaagtgacaagctggttatccaattgtagagttctgatgggaggccagaatggacataaaattattgaaaaggagttatatgattatcattttgtgaaaataaacatgattctttatccagaagatgtaatagaatcaacataaaaattctaaaacctggcagagatacaacaacaaaaaagaacttcaggccgatatccttgatgaacattgatgcaaaaattctcaataaaatactggcaaattgaatccagaagcacatcaagaagcttatccatcacaaataagtagacttcattccccaggaagcaaggttggctcaacatacacaaatcaataactgtgagtgatcacataaacagaactaagactaaaaaacacatgattttctcaatagatgcagaaaaggcctctgataaaattcaacatccttcatgttaaaaactctcaggaaactaggtattgaagggacatacctcaaaataataagagccatatatgacaaacgcacagccaatatcatgctgaatgggcaaaatctggaagcattcccctgaaagccagcacaagacaagaatgtgccacctctcaccactcctattcaacacagtatagaaagttctggtcggggctatcaggcaagcaaaagaaaggatattcaaacgtaaagagaggaagtcaaactgtctttgtttgcagattacaagatccgatacctagaaaaccagcattgtctcagctcaaaagcttcttaagctgataagcaacttcagcaaagtctcaggatacaaaatcaatgtgcaaaaattgctagcatttctatgcaccaacaggcaagccaaaagccaaatcaagaatgaactcccattcacagttgccatgaaataataaaatacctaggaatacagctaacagtggaagtgaaggacttcttcaaggagaactacaaaccactattcaaagaaatcagagatgacacaaacaaatggaaaaacattccatgctcatggatagaagaatcaatattgtgaaaattgtcatactgcccaaagcaatttatggattaaatgctatttccattaaactaccattgacattcttcacagaattaaactattttaaaattcatatggaatgaaaaaagagctcatataaccaagacaattctaagcaaaaagaacaaagctggaggcatcacgctgccagacttcaaactatactacaaggctacagtaaccaaaacagcatggtactggtacaaaaaacagacacatagaccaatggaacaaaatggagaactcagaagaccacacatctacaaccactagaagatatgaatcgcttctaaattacaggaaaaatccaggattatccctaatattcaataagtaataaatatcctccagaaattgttgtagatttattcagactcaaacaaatgaagaaatatcattccccaacatatgaagatataatattgtaaacattcaatccaatttccattttagcagatttataatgagtcacagcagctggtagcaacagccttaaaagacaagaccacgcccacaaatgattggactagtagtgaactcaaataataccagcatactacctggatattttagtgtgagctcttgactaagtaatatgaacctattccagttaggtggagggagaagaaagttggtcttaatctgggtcttgagttagtgcaaggaagctgaatctacacaaaaactggatttgaggaaacaagaatcataggtaagcaaataaagtggctctgcagagaaatccaggagaatacagaagactgaaagtcaggaacagaaataaaataccattccatgctatgagagattaaggagttgcctcaatgcctgtttccccttcaggccctatgatgcacagcatactactttttttttctccttcgatatcagtatttcctgtcctacatatagacttagagtacccctcttaggcagagttggtaatgctgattcagttaggaaaataatcacagatgttgcagagtatttatgttcaaagatatatatatagccaaattatttaataggaaaaaataatttaagtctgcaataagagaaatgattaaattgcagtattcagaatatccgtacaaagtaatgttacacaaccaataaaaacatatatttatgacagttatatcttcatacatgtattcatgttatatattcacatatatttatatgtcatatataggttgagtatctcttatccagaatgcttggggccagaaatgcctctgatttcagattttttggattttgaaatatttgtatatacataatgaggtaccttggggatagaaaccaaatctaaacacaaaaattatttatgtttcctatatattttatacacatagctgaaggcaattttatgtgatatttcaaaaaatgtgtgcatgaaacaaaatttgtatacagttaaccaacagaaagcaacgtcactgtctcggccacccaggttttttggcatcactgtaattcatgattcttaattcatcttcagataagcaatcattttcttacacttattaacccattaaatatttaacagtaaaacatatagcataccattaatacaagtgaaaaaataatgtgttcagggtaactaagcagcacagtagcatcaccaaaataccttatcagctgttaaacaacagtgatggcaaacaagggtagcctttcagtcttcatctgcaatgatgtgttttgattaaaaggttactgtacactgtattgtaacccccttggggacactgaataaactgtgtgttgtgcacctgtgttttcaatgagacacatcacatgagatcaggtgtggaattttttacttgtggcacaaggtcagtgctcataaaggtttggatttggggacattttggatttttgaattagagatgctcaacatgtatatgatattgatgtatatatgtatcaaatgtgacattgtatatttatatatatatgacaattatatattcaatgacaattcagttacacatatagaaactaatcttatggcgtgaaaagaaaaagcagaatgtaaaactgaaagtaaatacgacacatttatacatgcattctcatatgccatcagcctcacttgcctaggtctttataatgtgattatatgttatttctacacaccagccaacctgccagaagggcccttaaaggtctctgagttatctttaagagtttctcatagggcagtctacccacgctctgtaacaggttcttctttggcctttgttgtggacattgtgtcttgacctcactgttgatggaccttgtgagttctccagtcttcagagactcgctgccatctactggttattgttaccagttctgctcctctagtcttggagttgggtcccgactctcaccaatacccacaacataatcattccagattttaataaggcctgggaatagtagaactacagcacaaatttgtttctatcaatggcggctccttgtatttaaagcctaaatattacctcatatctgctttctcacgaggtccccatatactaaactagttcaacttccagaaacagtttctagaaaggttcatatctaaagtctgaacccaaatgtactacagttacagagagaggaggaagacatttatgtgcctgaagtccagcgcccatgaatatcctgatccaggatgcaggatggtggaaacatttatctcctgcataggatattttctctcataaggaaaatgcatggattcccataacctccataattataatatttatgctactctttgcaaagcctacatcattcagttttaaatattttactgtggatgcagccccatccaggttgtgatcccctggattataaagttaaggtttgattagggtgacatgtccttctgccatgagtgaattcttaattttttagtgaccaaatgcttatatgatagcacagcatgcactgaagaataaaaatgaattttatcatagggtaatccaaatgtggatttgaggaacaaaatattttctaactctgtaaatgacaatcctaccaaaagagccaatttataacactgcaaaaaaccactaacacctcaatctgaagcaagttttcccagtaaaagtaccagccaaatgcctgattaactaaaagatttgcaaaagtggccctttgtagaaggaaaattcccttaagggaaatttctagactcaaaaactgcttaccatccccaaaatgatgttattcaaaatgaaacaatttaaattgctctcttcaatggtcatatgtgaacagtgattatcactgggtgatgagatttgctttttaaacaattttctatgttttaaaaattttctatattgaatgtgtattattaaaaataaaatagttttaagaagtctatattggagcttatttaccgtaatatattgtaaatgagtaatatagctgtttgccaaactagcttattagtggcttgaacaccactgacttgataaagttttattttaaatgaaaaattctcattctgaagaaaacctgatgcttctattagtcgcatgatgattacatctgtaaggattccagtcagaatttatagcagtcaataaacaagctcaaaactcctaaaaagtaacggatgagattgaatctcattttcccctacttaaattagaacattattaactctgtgttgtttggaacttaggagaaggttcattttatttttgttttttaggttgttaaaatccaagtagagttaactattgaactacaaattgttttttaaggaaaagtaatgggtaattttatggcatgggctttgagttcatcacaaattttcaacactaatgaaattattatatccttatgttatcatttttggtaacttttttatattgggtttaagtaaccatcttggcaataatttctaagctaattaattatatatgccaacagagttcagtttgatttagttgtatattcaattccctttttattgtggtggaactaggaaataaactctaattcaattttaagtacaaataattaaatgaattgggcttatgaatgaaatcttctcattggcaatgccaggaggtcaattaactagttttacagtatttctgtgaacgaaaatgcatctccaatcgtgtgataaatattcgctgtataggactgaaaacactgttgattttattaatctttcagttagtctggagtagatattttcattagatttacagaaaccactatacatttttgaaagtaacatttcttaatatgaatttgatgtggaagactatcatctcttttactcgaccaaaataaaactctttggagacactttatttttatttcgttttactaaagcaatgtttgtttaggttatgttgtgaagtatatacaaaccatgtggattttgatactgaaattcagttcaaatgtatatcttctataaacattaaaagagctctttcataaatgtcctaaaaacagtgattagaatcgtgcctgaaacagcatgattctctgattcatttgagttgttttaaaacaactcacataacattattgcctttggactctttcttcttttcatcagttgaaatgtgtacttttaaatcatttcttaatttaactttctcacttttttttcagtatgtaacttgtccatccttttgctgacctttataagtggttctctttgttataagaacaaagtaacagtgccctcttacttgataattatcaggaaactacaagatcaaagaaggaatagttaattttatgtcttcttctttctctaaatcttctatgctctttgatgtcactccttattgatcaggaaagaaagtctatctcaagtaggggtacgggtcagcaaacacaacttctgagctcaaagacatcatttaaaataaaaatagagattattttgttactgactaggataactacatatgtttattttttctgtcaaacacatagcaatcaggaaatattgaaattattttcattaaacctcacataatttttgcaatacagtattgaacttgcttatattaattagctgagtacaagtccatttcttacaaaatatattaggccaaagcctataacccctatctccattttataattatctatgcttagatagtgagcaaggactgaattcattgtcttatgttttttttaggtgcattcttttgcattagttagctatttgttctgctggataatttctattaattaaagttggtaatcccagaaaatgaagcccagtacattcatctcgagtcattatcgccttctctaagttttggataataagctcatctgcctctttgaaatgtctcatgactcagctgttcagagagattgtccatctaaagcagaatgcatgagataatgagactccttttccacgtcatggtgaaagagaacattctttgtttgcttagaaatgctatctagagatgaaattatgcctctaatattttatgacctgccaattttcattcagggttactgttttttttttcacgttatagtctaagatttattattaaacaatgaaacaggttaacactaccatttggctttaatgtttgactaccgaaaagctaaccattcatcaaatttgttttttaattgtggttccctgggtcactcacacatatacatcgaaacaatttattagtgtaaagattaattgtggtaattttattgtcttgggattagatgaagagaccttcaaaaactccttttgatgaaacaagtaataaaatgtagaaacagcgagttctgtggttcaatatttatatgtctgtgctagaagctttacataaatttgaaaactttttgtaggtatttgcagagtgaaaatatgccaatacttcaggcacacttataagcccctcttgtcttcagtctggttggctacgtccaataaagtttgatttctcctgaaggaccattatggtttattggcttaatgaagcaaattggaaaaagaatttgtgcagcaccttttctgtgctctgggtgctttataaaattgcagagtacgtttcagttttaagcaattcccaatgattagtttatttccagtgtggcaaaacaggacctgagaaaataactatgagtatcttgcacacatgcacatgcacagacacacacatgcatgcacactagttccagcaccttctgtagaacatgttaactgcctcaaagagagtatcctccaagcaatagtgaacagagtattactttctgtctttgtaaattttccaggatatcatgatcaacctaattgtgtggcgaatggttttggagtctgctgattaacattttattatacaggagatctctaaaagagagatttgtctcttatcatgctgattctttctcaaaatgaagattttcacaggtagaccattagtgccagacacctaagaattctacttttctttattaaaaacagtatataaaacaaaattttaaaagacttcttcatttacagaaggaagataagaagagaacaatgtacaggcctgtttagtgtttagatggagtagaagagatgaatctggaaaatgtctgaatgtcctttcagcaaacatgaattggagtagaattctgtctttttttttgagatggagtttcactcttgtcacccaggctggagtgcagtggcgtgatcttggctcacttcaacttctgcctcctgggttcaagcaattctgcctcagcctcctgaatagctgggattacaggcacgccacactatgcccaactaagggttttttggtgggtttttttgtatttttagtagagacggggtttcaccatgttggccaggctggtcccaagctcctgacctcaggtgattcgcccgcctcagcctcctgaagtgctgggattgtaagtgtgagccactgctcctggcctggcctctctttttttaacagacaaggtcttgctctgttgcccacgctggagtagctgtggcaagatcatagctcattgtagcctttaactcctaggcttaagcaatactgctgcctcagcttcccaagcagctctgactacaggtacacaccaccacacccaactaatttatttaatttaatttttttttttttttttgaaataaggggtcttgctatgttgctcaggctggtcacaaacttctgggctcaagtgattctcctgtctcagcctcctaaagtgctgggattacaggcgtgagcccctgtgcctggcctgtcctctcttattgatggttatggtttaaaaatactgattcttatgttctcatttgtagctaaaataatacatttaaaaggatactttattccaatattttataaatttccttttatagggtagattaaataattataatctggtactatttaagagcctcatatgttcactattccctgaaaaagtgaataaagtctctaagtctacttatgaagtttatggaaacacttaacttgaattatgtggctaggaacaaaattagaagtgtattgttaaaagataatttaaaaataaaattacagtacatgcaaatataaaatggacatatgcccaagattttgactcattaattaatgagataaccagtaagatgttacaattaattcagatgaatttaaagatatatatgagcaataaggaaagctgaaatgaatgtacaaatacatgcaaaactgctgtgtccacaaggcaataaagaattgcattcctcaggactcagtccattagcatttctacagagaggagtaatttgcattattatcagttttctacaatttacagggttataaaatagctcaaagacaatggaaggcagaggtaaccaagaaaggcatactagacagtacatccagcagtgcttttgcatttctcaaagcatttcccaatttttcctgatagtattaatgctgttcacattactatcttgccacaagcttgttctttaagcaaaagccagaagattttttttattattttttatgagtaaatatctgagaaaaataatttagttaaaccgcaactaataatttaggccacctattaaaaactatgattccaagatgaattgaatatgctttctgtcatctgagaccatttcttttatttcaagcaacaatgtctggtatgatatgtgctataagtaatttataaagtattgagtgagtgtggcagaaattttgtcttgagaagattagagagggtggcttttagtgatgttaaacattttacttcattgcacatgaacaaagaccttttcttaccattcacatctgattctcctcatgcctaacagttggaactgaagataaactttcctctctgtgagagaaaactgattgagtgtgctgtgcttcatcttaatcatatgcatgaacttttctttttgtttttgagacaaggtctcattttgtcatccagggttgagtacaatggcatgatcatggctcatgcagctttgacctcccaggctcaatcgatcttcctgcctcagccttcagagtagctgggactacaggcatgtgccatcatgcctggccaatttttgcatttttttgtagagatggggttttgccatattgttcatgctggtctcgaactcctgggctcaagccatccgcccacctcggcctcccagagtgctgggattatgggcacgagccactgtgcctggtccatatacatgaacttttaacagaaaatttaagagaccctaagtggagaatatactaattcaaaatatcatgttctagagatgtagaaaaaaactataactgaaaaatgaatgaaaaaaatatttaaattttaggggtagaaggtggaaagcccaatttgaagaaagcgatgtgcaaacctgggatcagacaagtgcaagagaagacattgagtgtatcctgaattagtttagcaaaattaaaagttatttaaaatagattttaggatgttactgtaattattgatttcataagaatatattatatttgtcttgctctacagagttttaccttgcatgttaatatcaaaatttattatagcaaactttgttcataacattttattgaaacaaggtttgaaagtttctttgttcattttcctgagctcaaggacctacaaggtaggacatataataaatgaatcctgtcctacttatcactagggatagttgtttcctcaagatatgttcttagtaataataattacaattaaaagaatctctgccctattaagtgtgcttctgagggacacttttttattttaaagcataaagcattgtcctattcagcagaagccaaatctaatacaggttggtaaaatgtcctgtatgcagttgtttgggatctctttgtgtagcatgtaataaattaccaaaatggaataaagatagctgagaaattaatactagcttttgctaaactagggacaaactttaaaatgatgaattatatatactaattaattggtacccttgctttttaaaaattctgcagttgtaatctattgattattggctaagtgttatatagagattaagtcttatttctcatcctgctatttcctacctttgcaactttcttcttgatggaaaaggggcatcactcctaaatgagattttttaaaaatattgaatcttcaaatttaaagagtagagcacaggattaaagtggagaattttcgtaatcagagctttattgaaaagtttagtgtgtataggcattgtagatgtgtctgtggaatttatggactcagttaaaaattgtcacctgataaaaatgaagttaactgtctattcaaatgatgagatttgcatctacagatatattactacctaaaagccgaggttgcatatattgccgatggactcctagaatgagtcaggcatcttttaaatctcagtaaaatgattgttatcttccagatactatctaaaatatcaccaatataagattcctcatcaatcacttctcaaccttttgactaagatcaagtgtaatatctatctttatcagtttaatatctgagatctcctttatctgaggacaatatatttaatggatttttggaacagagagaaggaataggagcttgtcctgtccactccatgcattgacctggtattgcaggacctccagaaacaccaccccctcccctcccacacacataaattctcaccaatcttgagggaatgttaaaataagatgtgctttgattggctgatattaaggcatattagaaatgaaagaactgtaaagaagtaatttatcttcaaattgggaaggcacttctatctagtggatctaaacggcaactagaaaattatattctgtagcataaaactaacttaatacttgatattagactcaggagacatgcattgggtaccgtgttgcctcttgttaatcatctgtctttggaaacattgctgaactctgttctctttcctcatctttgaaattaggttaatcacatgacaggatagttgtgagtaataaattaaataacatcacctatcctaatgcctgacacacaataaatgcttaataagtatttattggcattgcctcttgctagagtctggttggaatgatacatgaaacaactgagttcctttgccatgatactttaatacacattcttatctgtttcaccacagtagaggagtgccacttcatatcataggggaacagatacttgtgtcagcagttgctagataacactagaaagtctgggtgaaatagtaaaaaatacagagatgaatagtttaagaaaagcttcttaactgattctggtataattccctttaattaaataattggcttaacataattaccatcttttctgaagtatattgatgacgagaaggtggcctgtgaatgaaatgcacaattttttgactccagaattattaaagtataaattgctaaactataattgtggattataaactgatcactgatcatcttcagatgagtgattaaagattcaaacctgtagatctgaacacccacagcatcaaggtgaagttgcgggggaactgattattctctcatacttctttatctacatttctgtccagaaatggactgcactcttcccttgtaaatcctcgctgtctaatcaagcagccatttcaagccagagacagtcttgggcacactacacagttttgacgactaagtgacaacctatcagtggaacaagaagccttttcttgaaggctacttactggtttcgagcataaaaagggaaaagttcaatgagagagaacgaactcctaactatgttgttcttcttgggtgcattgtatatgctgaaaagttaatgctgtttttaaagttaattcatgataattgaaccgaagtgctctgaaagtgctgttagagtctatttatgaacccagtgccctctttgtcaattcagtaaaagcaccgttcagtaaaagaaaggagagagagatggctgcatggtgtgcacttagccatatgtgcgtcctttccccgtaaagtatctgtttttctaagtgcttttttttcttttaatctgtctacctcattgagtcagcggggctgctagtcccattatcactccactttgaggactgggaagggctgataaatgtattttggtcgtgatttaccacaaatcacttttgttgctctgaggtgtaggtcactgttgcaagtataggtcagcaagaggagagcacgtgggacaagtgaattaaataaataaactaccgtttggatgatcacactgacaaatatttttaaacaaatataatagacagtctttgttagcgtgtggaatatattaatcgtttccatgagtgctgttgggagtgtgtctttcatatgaagcatcagcaattccattttataatggcaaaaagttggtaacacctttatcttcaacaatagccggttaatagaaattgaattatgctttattaaaatgagaaaatactaagacacttaaatggtgatgtaaaataatatttaattacatggaaaatggtctctgataaattaagtggaaaaggagaatacaagatcatattatatattttgttctaaaaaagtatttatctatatggaagaaggattaccaggatatgcatatgatattaacagtaattttttggtgatgagattttaaatttttcttatcttttttgttctctctctttttttttttttttttactaaacatgaactataagatattgtaataaagttttaagaaaattgttaaataattttttaaaaagagtatgtgcatgtcaaagaaatcatgcttgtgaataaaaagaaattagaaagtataaaaggcttatttcagtatttctaattaattacccaactatactatattgttcctaagaattgaaccttttggaatcctctgaaagtaaaaccatattaaagaaagaaacatggagtaaccatgagcatgtagtttgaaaaagatacagaaatctcagctatgggtaaaggcttaaaaaaaaattgaatccatgatggcctctcattctgaaaatgacatcaggcagtatttatttgaagctaataaatgagagtgtattattgtatgtaaaactgtgttttaaattgtttgtaatataaaatgtttataatataaaatatttcatgtaccaacagaaaatcgcagaaacaaatgcaacattagcttgtgggaggaatttgaaaggtccagatgctagaattggctgaggctctttgcagcaccatccatataaaagtggatagtctgaggggtttacactagtgataatggaaggaacatggagtcagaatggctttctatatacctgttggcttgtgtgatttctttgggccttggttttttaatcttcagatgggagaaaataatacatacatatcaaagttgttaaataaaaagcatatttaaagtgactaggaaaatgcttgccaaatagcagtgattcagtgaatattagttctgtacttgaatttggagtctcccttggtgactcaaatttaattactaaaaaggctaatggcttcaaaagtagccatttaagaaagtgaattcacagcagggagaaaaactcacagaactccatgaacaggtcttgggatattttattcaatttaaaaccaaaggtctatgaaacagtgagttttcaaatttctatcatttgtttgggttcatatttgacttggtaagttcaccagtgcggattcctttagctaaagaacaagttggattttcatcatagaaacttcatattgagtagattaacttgattggcagccattctaagggagagattcagaaacagaataacaagtctgtggcaatttaagactaaactactgaatgaggaaattaggatggaatttcgtcatgatgacatctattaggcttccataatcgttatctcaagaaaaaaaaatcatacatcttttcaagagaataattgttgtagaggaaaggaagtgctaaaacagttttatgaaattacattctgaggtgttgtacaaaatagtactctttctgaaatgtaatttgcctttaaactgttcagaagagtctgaatggtgattgttgcctgagtttttatccaaaagttcagtgatggagcagcatctgggcttagtcctatctctagtggcacatcctgagtgactaagacatagatgtgaaagccttttctggggttacagggatccagtggtttcattcagcttacaaaagcagaatcctattggtttccagtcttacttctttgagtctgttttgtttttaaatcattgcagcctgctgggcgcggtggcttacacctgtaatccgagcactttgggaggccaaggcgggaggatcacctatcaggagttcgagagcagcctgggcaacatgaggaaacctcatctctactaaaaatacaaaaaatagctgggcgtgattccagctacttggggggctgaggcaggagaatcacttgagcccgggaggcacaggttgcagtaagccgagatcgtgccattgtgctacagcctgggcaacaagagcaaaattcggtctcaaaaaagaaaaaaaaaatcattgcagccgaaatgtccttttacctgtttctaagtcacaataattctgaaatgatcatttcactagctacaacagaaatattctccaaagctttcaagctaaaacaaagcagttctgtgattgtaaaaaaaaaaaaaaaagctttaaacatctgaatttggtcagggaaaagagcactctgtagtatcttttcaagcttgtaaggcacatataaatgaacggtattggacatatggaattgttcattttacgcaatacttactatcagatgttcttaaataacaggatgaagaacacatgcttaattagctcaattgtctatggataactgtgttgacgatcaacttttctttcagtttccagtttaggatgccatataatgcttgtacattctgcattaataaaattatctagcaccactaacatcctgccacagtgcatcgaaatatttctactcagcaacactattatcacttaaagctgcaggcagaccttaaactacgattttgtaggctatattttgtggacattatattctacaattttattcaatcatgaacacattttctcaatgcttttatttgatgaaacatagcatttaatattatacataatagcgttagtaattcttatggtcatctagttattgaatgactgttttaggtgtcatgaagtcaaatgcttatgatgtcaaaagtaggaagagtgataactgttttgaagtagaaaatgtgcgcctaccactcagctcccaaggatgctgtgcagcaacaggggcctaatgcgtgcatgcatatttgtttcccattgctgctatgataaatttccacaactttgatggctacacaaaacaaaacaccagtttattatctcatagttctcaaaagtgagaagtgtgaaatgggtctcagtgagctgaagccaaggtgttggcagggccacattcttcctggaggctctgagggaaaatcatttccttaccttgtacatcttctagaggctgtccacattccttggctcttgtacccctccatcttctaagtcaaacatggtgtgtgaagtctttgaccctgcatcacctgacactgattcttctgcctcccccttccacatgtaaaggacccttgtgctattacattgggcctacctgagtaatccaggataaccttgttattttaaagtcagtttattaacaaccttaatttctctttgccatgtgtgttagcattttctaaagacacagaaccaataggatctgtataaatctatatcagaagagatttattataggaattctcttacttggttatggaggctgagagattctcttgtttgcaagctggagaaccagtaaagccaggggtgttattcagtccaaatatggaagcctcagaatcaggagctgatggtgtaaatcctgtcccaagtctgaaagcccaagaggcaggagcactggtgctcaagggaaagagagaatggatgtcccagctcaaaaaaagagagtgaatatgccttttccactttttttgttctactcaggccctcagtttgttaaatgatgcccatccacattggtgaaggcgatcttctttatttaggccactgattaacttactatcttccaggagtaccctcacagacatacctagaaataatgttttaccagctatctaagtatcccttatcccagtcaagttgacacatacaatttaccataacaccatgtaacataccatattcacaggtcctaaagagtaggatgtggacattttaagcatttaaggcaattattctgcctatcacagaatgcatttctattttttggagaagctaggataccatattttaggtgaaatctctggatatttaaatgtttatgagatacgtagcatctcagtggatctgttttggcccataggctgcctgtttatagccactggtatactgcatgcctgactctatgcagagtgtttgtgtcttctcactcatggtttttaaatctaattgaggaagtaaacatttaaaaatatccataaaacaatattttaacaacacagtataagaaacatgatagggggctttgggaatgatccttgtagggtgaagcaagacaggtcctaaaaaatatgatggatttggatgagcaaaatggaatttaaaagacatgtaaaagatgtggtagttgggtgaaacaagactctcagcaaagatgggaaagacccttgagacatcaaaagtctggccttgctgggttaagaggaatgaaattgaggatcatttatctgataaaatgaaccaagtaatgtacagttttctatgctttctttagagtttggctttatttcgcgaagcaataattttttgtggtaagttcttgagccagagaaatagttgaatataagataagaatgttttttaaagaattatcacaacagagatgaaagcacaaaggccagaaagatgactgttttgttctccaggtgtgcaataatgagaaaactagactagggttctcaaggtgggttgaaaaaaatctgaaaagacatttcaaagaaagaatcagccagacatggtgagtgactggctgtgaggagttaatgagaaaaaaataaataataaaagttcagatatgggtctaggagcacagaggaatcattggttgaggtttatagatttgggtgattaatgtcattgaattaaattcatttttttttccaagagaaaagtatttgaggccaagaaccaagcttaatttatcttaaataaagagatgcctacattagatcaatgggaaaaaggtaagggaataaaaggggaaggaagagtggaaataccttaacacagcgttccaacacccaaaagaaggggaagttttagggtggaaaaagaaggattctgtgataacaaatacatgtttttgcagtgtgaaaattgcttgactgatatggaaatagagaaggataaagaaaaattgttaaaaagagtttgtattggaatttgaggcagaagtgaaatgttatttaagggaaaaagatgaatttcatgattttgcaagcttgaaatccttaaaagatagaaataaaggccagtagaatgatgaaaagcaatgttcctgaagatagagtggagtagacttctttgaagggtctatcaggtcacagtttcatcaatgagatgtgctcattttactcagttgagccagtgaacctcttttctgctttatgacaatactctattgactacagcagatactgactggcagaatctctttcctagaaatttcttattgggcctgagaagtttatttatttctgtgggtgacataaaatgtagccgtatgtactcaggctctgaatgcactgtgtgtatgcccatcacagcaattagaatagcggaaaaaagaaaaagcaagaggggcataaagaaatcagggactgacggacaggaaaggacagagagaggcagatattgcccacattcctgctggctttcctgtttctgctctgagcttcttctaaggtttctcccttctactagatttctatcattatcccatcatcttccctgtacatcttctttgattaaacaaggttgaagtgattctcttatttttaatcaaaagagtaataaataagacactaggaaaagttaaatccagaacactggctgacatttcgagggcacctcttcctcaagtaagaaggcagtggagaggattggcacaatgaatgatctggaaaaccagaaaacccaaagtggtactttggaaggctcgtgttcttcaccctatgattagtgcaagcctcagtgtagagaatgccacttctgagaatctctccttaaaccactactctggctgaagtgccctttcgatatgttacttctaacatattgctgtggatattcctatcacagcacttattatactatgtttaaattgttggtgaacttatttggagcagactctagactttaagctgtatagagtcagggattatatatatttgttgaaataataattcatatcttcccagtggagaccaatacttgttcattttgcacagtgcaagcaaagcctcattaagttaacacagctcttccctgaaaagtttagagtagaaatttagagttgatccttgcaatgtcataagaacatgcctaaagattgtaaatatgttgtttaatctgttagttcaatgatgaaatgtttaaagatgtatttagggattttgggaagttgatgattatgaaaaataattactttcaaaagctatctaaaatgttactacatgatcatgttagggttctagatctaagtataaatatggaaggcaaggaaaaagatggaagtttcctaatgagttatgattgctttggcagaaatatttttaataaggagtataatgtacagttaggggaaagtatgataataaaatcaagggaaggaaaatagccatcctataaaataggttgggcacttgactagtctacactagtagtttctagatcaagaagtttttccaagcgggtctccaagcccattggtacaacaagagatattcacttcttttaatggtctcaaagaaataagcatgtagttcttcacaataaggccggaggcttttgatagtaagaagaatatgtaatagtgatgttactatggacatagttcaagtctactatgactttttttggattaaactgtaaaagaaatggcaaacttaaacatttttccaaggcttgtccatgcactaggcactatgctacaggccttagacaaatttgccatctcattagaagtaattttaggagaattaagcgtttgaaaataattttgaagatgtaaagtttttgatccttaaaataagaacacatttattcatttgtactcatatcatgctttatctttaacctacacagaaaagcagccaacgtgtaacagggaggccaccatgtcattcaggtcaatgttgacaggtgtcagattctcagtccttcttggtcttcctgcacacacttgagctatctcaatcaattctttctcctcattgaaacccattccatcatcttctgaacatattgatcttcagtcatgcacatactcatcatactcttcatggtgtttctgcctgcaggcctctccttctcattatttctatattggtgactctgtcctcacagctgataccaatcatgcttcttacaagtacatttcaaaggcatggattctctagtgtttcactcacaggaaaataacactggtttctctcctttgtgcctgcagtatagattcacttagctgatttaatttgactgttagtcaaaattaaaaaaaaaacttttataaaatttcatgcattttcaacccctccccacattcccttttcacattatacacaagtggaaagagaagagtttcatataaagaacacacagaacaattgtaccacataaaaaagaaagaatcaatattaatcatgacctgcagtcatactacctttggctatgatcatctctgagctccagagaggggctcagctggctgcattttttaaaggaggaccctgtgggagagccaagaggtgatcagaaacacttctggggattctgcttgtgacacttcatgctggcagttctgcaacacaggctttcttgagagattatgtatgcttactggattgctagtagaaattctcacaagattgttcctagtctattgtgatcagggtagattgattctgcctcacctattggatagattctttaaaacattgggtctaactagattcaagaaaaaataatagcaacaacaacagttaaacctgattgaaatgttatgatgcagctgctatgcagcctgcttcatctcattaaatcctcaaaaatgtaaattagcttctgtccacatattacaggtgaggaagttgtggcttagaaaattaagaatcatacttcatcaattttgagatgcacatttttcacattttaacatctttgaaattggactgcttcttaatattgatgtgtctcatgaagataactggcagttttgtttgatttttctgagtgacagaaaaaatattagtgtatcttaaattcaatgatggtttaggttttacaaaatatggtatcttgtccaaggtcatccaattagcatgtggcagaactgactggaaatcccatgctatgttatcaaatgttacacctccaagaaagggaaactagagactagttggaggtgccccagctcattagaggtaatatgttcttgaagtgttgacaatctttccactggatgagatggcactgataaaagatttctaaagaactttcctattctggccccactttttagggagagcaattatgcaggctacagggagctatctcagtggctagagggagagaataaccttgaaaatttctttcagttttcagtcctcattctcatatttgatatgaagataaacagaggaactttgagcctctttgcattctttctttttacaatcttgtgttctctgaattttttcttcactgtcttctatagtccttagcagtccttgaatatacaggttatcctcccaggatttataagctaattaatcaatgacaagtgcagccatctctttgcttagggacagatttctgttgcgtattaggaaatgtgtcccagaaggcatttatctgtctttacttgccattcatattgaggagtgagaatgagaaaaccaataaatgttttttcctcttctgtttcgtcatcctttgtatggtttctcatgtttcactgcctcttgttttagtagcacctcagaatgcctgccagtctgtttttgagacagtttattggctgtgatactaagaaacatacaacttatgtttcttaacttttttcctgctgtatttgcctttccaaattaataccacaaatgacaactatttaaaaagtgggaacttgtcaagagagctgaggaaaaaataatgtaatccagacttctgtgatataatgttaatgaaatattttggtatgctgaaacctcaatttaatgttgtcttggtaagtgaaactgtcttgtaatgagtatctttaagtcacaaaaactttggaaatgtttccaaagataataaaagttccataacaccaaacttcatcttgggacaaaatgtatatataattccaaatacttaatactctttcttccaaggatgaatctcacttcagttatgacctcaaagttctttttgccctttgataaaggtaaatgctaatcttgggaatcttcctatatataacagggtgatttgtcacaacatggacagtcttaagaccagaaattagataccaaattctattactcttgtaacagcttttttaatcacaagaaatttttctatgatttttgaattgttttagatttattgtttgcctgggatttttttttatcctggctgcaaaaagaaaaaggtcagatttccatttaaaaggagtttgtaagtttccaaacaacagaagttatttctttatccatttttctcctacccgatttgtactttctcatcacttgtttgccatccagttaatgtacatccagttttgttttctcacctctgttgagaaacgtgactgagcgattagtccaattttatgctattatctaacgcatcacacatatgtaattgaaacaaaatgctgttgcatatagacttgtctgagtaggtgcttcagtattttctcacaaagagttggtataagcctctttcctccagaaacaaagatcactaggctcatctatgtaatttgtaaaactaagtgaaaaaaagtgtaagcctacacttgaaggtgagaaagtcagtctcctcttcccatagttaatggacaggtgatttccaagggattgccagctagggcactagacatctggattcggggtggacaagagttgactgctggctgcatcatggaactgccaggccacctgactgtgatgcatgcctgatcagccttcctgtacccacatccaggtcctccttcttcaccagacctagacgctgccaccctgtgtctagggtagtgggctggaggtgaggctgagaggaagaaggaagaattcgtctatgggaggtgctacaaattgtgtgccagaactccaagcttctgttgcatgcatactccattggccccttggactttacttacaaagcacaaactcaatttcaagattaccacagaggagaatattaagcccatttgccactgcactggttgcaagcccacaaagccatccctaaagataaccactatttctgttgtgaaccacatatttcaagtacagtattatttgcctaatgtttcaaatagttatttatgaacatttctgcccactagattataatctatggagcagtgtgataaaatgagtgatatctttcttggaatttctgttatatttttgtagctgctgcactgcaaataataggcttattaattggacaagcacagaaaacaaaaatatgtgactcaaggaatattacttaaaccagattttctagtttatttaaatcaagaatggtatacttacatgtaccatttgcaaatatctgcttgaatgttaagttgcttttcaggtttgacggcacagaaagagtgtaaggaagctgattattgtcatctgagagtggtcctgtgctaattgagtgcttttcaaccctcactgcaggttgcagtcacaatcattttggaattattttataaacattatgcatgggcccctcactcagagattctgatttaattgacaagtagatgagggcctggtcactaatgcttttcaaaagctcataggagaaaggtgtatgaggggaggggttgaagcgtgtgtcagtttgggtagtcagctggagtgtctatgcatggcctttccatggggcttggccttctcagagcctggcagttgggttttgagagagtctcccaagagcaaatattgcaagagacccaggtagaagctgtgaggcttcctgtgacctagccttagaaattccaaaacattccttctgtcacattctatttgtcaagcaagtcactaaggccaagccagatacatcaagagagaaattaagttccacttcttgttggtggagtgtcgggatcatattagagaaaagagtgtgggatgtaaaatattgttgcagttagctttgaaaaatacaatctgccatgaagtgttatagccctttaaagtcattttaggcagaactacaatattaaggggaaaaaagtcaaggaaatagctcaagatggggtttgttctcattatgtttgaattcactagctaggcttttaagagttaccagcttgtgatttctaactctgattgtaaaaagtctattcatttttaaatttttttgtgatggtaaagttacattgctgagttataaaaaatgaaagcaatgctaaattaaatagcaaaatctctttatgctactatattttccttcccagctctacttcaataaaggtaatatataaaatctaggatttggaagaatagtcaatttaactccctaactttatgtttgtgtattcaaaaatatggaacactgaaaagcctaaattttatcaaatcttaccttggcttgacctcttggtaattactgcatcaattagggtattcattaattctttgttgaacttgattcgttacagccaccaggtttatttagcaacaggtattcacccacacttgcctggcttcatgtctttcctgggcatggtattgttctggaactttacagaggaagacacatttaggttcagtctttagaatcgcagtggtattgttttgatgctacaaatgtttattcaaagttagagaacagtaacataaagttttctcattcagcatatgtataatatctattgagcaacctaaacttatttaggcaacctaaaatgagtgtacagtacatataatatgcagatattttatgtgactctaaggagtattcatctttggtgagagcacactcagcagtattaaatgagggatacagaagcatctgtgccttcattttatcatacagaaatttacacttatctcatattttctttccaagaactatgagctataattagtagtggaatccttggcatagatcactaggccagtcttgaagtataagttggcacattcatttcagtggcagagattcagccataaggaagaatcatgaaattatgtgtacttgaaagcagtcagagttactgatgcagtgtagaggtgttaatctcttactattctgaacatttttttttctaagaggttctcctcatacattgccacatgatcttaatatttttatttgcctttttaaaaagaaataatcatcagtactcctcagtttcccttcatcttgacatctctttgacttttataaatgcaaggatgaacaccttcctactccccacttttcagtgtgctcctaagtgaaggaccacctccttcaatactactcagtactcacagaaaagtaggtccttagacctactctacaactatagaatcagtaaaatgctgacaaatctgcatttcaacaagtttcccaggtgattctcgcaagaaattttgagactcgctgccctagtgtcttgctaccttacatgcagtcttaggaccagtagaggggacatcctttgggagcttattagaaacgcagaatctcaggccccatctcacacctactggatcagaacctgtattttaacaaaatgccccagtgattggtatgcacttaatgtatgagacatgctgatgtggagagaaagttaagtccagattcctaagcatgtcaaatgtggctcaacatgtttacttcctgtgtgtccagctcctccttctgcccccacatgggggacattctacctgaaccattcaccctatgaagataagccttttaaaattgcagatatgctaccaattttgagctacaaaatagaaatttcctatggctcaacataaatgtgtgcagttccttttattaagggttactatttcatggttccttttatttatttattttttatttatttatttttttgagacagagtctcgctctgtcgcccaggctggagtgcagtggtgtgatctcggctcactgcaagctccgactcccgggttcatgccattctcctgcctcagcctcccgagtagctgggactacaggcgcccgccaccacgcccggctaattttttgtatttttagtagagacggggtttcatcgtgttagccaggatggtctcaatctcctgactttatgatccgcctgcctcggcctcccaaagtgctgagactacaggtgtgagccaccgtgcccggccatatttcacattttcctattttaactgtattctctgactcaacaaatctactactaatgatggaagcttttattatgatttcccttataataataccaaaacagaataaaaatatattttctaaattttaatataaataaaagtgatatataagcacacttgcatcatgcaaattttatgttcctacattgcagctaattatggtcttagttaacaaaattatgtctttaagggaaatgtccatgtttctgaggtttgaagcctatggtatattctttttatgaaatggcagctcttcttaagatgatgataggcatccctacatttactaattttgtaactttattgtgttgctgcctctactgataaaggagagggttggcaggtcacccctgattttattccagaagaaataggaaactagagaacagctttacatctcaagtttttctgctgcgatataactatgacaaagaccacagcttggataggtttcagtttggctagagaatgcatacttcacatatgctctttgactttggcaatgttatctctcaggattttccttttggatggcaggttttttttcagatgaatatattcttcatgaaaatgagatcttaataaatctttaactccaatactgcaaaatcacacatatactatatttatgaaaaaaaactgtgagaagttttcactgtataccaaatactaacagataaatttatccaaattgcctggccagagaatatctgaacaattcagattatccacttcaataaataaaaacttttattattttttctgcttatgaaagtaatgtttgtttcttatacacactataaatccatcagtgatataggggaaagttcaagctcatagtaataatcattgtaaatattttatcatatattctttcagatttatttttctgcaaatactgtgttatatatgttatgatctatataaagcatgaacaactagtactaatgcactggagggaatctacatatttccagaatagagctacaaagcagttttgatcaatggtcatgctatatattggccgtaacatgctcctgaagggaagggaatgtactgtttttctctttgtgttttgcatgcatataactgttataagtgttttactaatatatactatgagcagtaaaatattagaaatcaatgtagtattaaatgaaatgcttaccccagtgtttcatttaattctgttatctttgtctgaaacattaagaagttttaatgtttatcctttttcatgaacaaatgatttgtatactttttgaaaaattattagttatttttcttactgatttgagaagaaaagttctaaattgagaacactaatgctctagtgtcccttcaaaaatattctttctaaggaaagaagtagaaactaatgtttactttgtagtgggctttattaagcaagaaactatcacttagtctttttcactcttatattttgaatttaattctttttaccttgagaatagcttaatttattcatgtttgggtgtttttcaatatttatgagtttatattctggttgtttaattttttcaatattttgagttaccacaagtaaaaacctccaatcttcatttcctcttccaagatatgtgtgacttacagaaaatctattaaactgactaatgaatacagccatacacacacacacacacacacacacacacacacacacacacacacacatacacacacacacacaccaagttcagggtcaaggcttaaatatcacaattgatcaaacttaatgaggataaggcatttgagacacttgaatggaggatgctattcatagttccaatgcttatatgataattatgaaagggagacccaaatgccctttatctgtgaaattctttaaagaaggggaaaatcaagttattattctagtatgatattgttctttaagatgagtcttaaaatggactgttcatattaattatcctggaaaacttttgaaatgctattcatcagtagctttggactagatttaaagcttggatcaaggtcaaggataaaattactttgcctagcaagattattacctttgtgactggaatttgacagatgctaagtatttttacttgagattctttgtgtttttatttccttctgtttaagaaacaaaaatggaaactattttaccccctttctaggactatatgctttatattctgaagtgtcagaggcaaagttcatctgtctttacatgtaccttttacgtcttagtagctcaatttatgagaatatgaatgaatgcaataatagtcatgtcccttgtaatctttgtgtaatttggagattaaagaccactgcaacacaggatgtttcactgatgtcttgatatctaccatgaagaaggtgtgtggctttttaaacataataaaaagagaggacaaaacttctctattgagaagttttaaatttagacttataaaagcttaaatttaaaaattttaaactttaaatttgaagttataaatttaggagacaccaaaagataggcttcattgacatcacctctgctgacatcacctcagcagaaagaataaaggaagaaggaaccaggtgaagtaccaagactaggggcagtctgacacctaaagctctgacagaagaggaaagttcagcaagggccacacaactacaaatgcatttttatccctacttgttgagtttaaggatgacttttcattaagcactgagataggagaaaaatcagaagattattctgtcatagaaaccaacagaaaaaaatatttcaataaagagaagatggccaacagtattggctgctgctgactatgagggcttggtaaaagtaggttcagtggagtggagggaactgaaacctgattacaggagagtgaatgggaggcaatataatgcaaatgcaaggatagaacactcttttgataggtgttattgagaaggtggaacagagaagggcagtggtcaagaaggaagaatgagaggactagaaataggttttctaaaaaagagacctttgaacatgttttgatgctaatggaaaaattccagcttaaaagaaaaaataaaaaacaatgatgatagatggagaggagatgatttcagcagtaatgttcccaagaggtgtgtttgggtagaaaacatgatgagcccagctaaagggctcagactttcatccaagcaggggcaaggtgtgtcttccacagaaggaaggcaaataatgtgggcacagatgcagaatacctagcaggtttaataatgagaaaatggaaatgttcctgctcttttgcatctattttttcctcatgaactatgagacactgagaatgacaaggatggttgaggaggtgggtgtgttggaaggtagaacagagaagtactaaaatgattaatcctacctatcttttaggggtgtagtttaaaggaaatctctcaggttatcaccaatgaaccatacttaacagataaggaaatatggaataatagcaaactataagagtgcccaatgctaatgataaagagtaagcaatactgtatagtagttttattctctcaagtctgactgatgcatttccattgcttcttagcagaagtaactatttttaaacattgaaaattatggacactatttattgtggctttctttgaagagaaatctctaaaataagtgagaagattttcagtattagtctttgagtgagtttattgaaaccaataaaatattccttttttgtgggaaggtgtttcaatttgcctttttcctccccataaataaggagtgatcaccccattcagaatgaatgtaaggtagcttgtaaaatatctatgtttggggcaataaaactcacctagaatgatcttgtgcctctgcttcctcaactcattttcttctttcagctgtgcagaacgttaattgtgtgaaggccacaaggaggggacacagcttgcccttagaagtacttttgaggacagattttatcatgcttgataaaaatgcctattctacaacatagtctatgatcatgaaaagagatccttctgatcttatagtttcttccgtgtgggtgtcgcatgttcctggataactctaagaaagtaaggtcaactctggctggaaataatgctctgttgtgttttcattgttcttgtttgctcatctactaattgacagcaataagctaaacctgggttttgaataattagaggaaaaaagttataggccaaaaatttataccacctagaaatatgtgtacatatttattatgcgtttccttttctccttggtgttggtcatctaagaatgaccttttactataaagtacgatttccttcttaacattataagcatttataaagtctgtgtattttcattttaactttcttaaattacagacaaatagcttgaggatttaaaaattacattatttagtgcaacacaaaaaatgaggaatcaggtattgttgaaatttgaaatcaaagaaatacagatttcaaatgacttagtactttttatttaagtttaaaatatttttgagagcttatttatgatttacaagttgagagtaatggaaataagcaagtttaactttgcagaaatctaaaatctgtatcccctgaagaacaaacatctaaaatgttgaaacagtacctaggtacacagaataaagtgaatataatcataaattttaaagacttgtagactggagccaatttgtaaaacatttctgagtcatcagtgatctcattaaaatgcagactcacacacggtgttataataatatgcattttagcatcaacttcgtatgcctccatctctgttattctcatctacaagacagtttaaaatataaaattatatattttttacttaattatgtcttagtattagaatgttttgttatttgttaatacatatcctcatcatacgtatacatatcatgtgcatgctctttggagatataatagttgataaatctaagaaatataaatatgtacagtacctattattaatgtatacctgccagtgtatatttatgatacatgatatttttctttgctcttttagaatgattgatttttgtctctatgtagcttttatggttagattgagtgatgattttctctctcagaggtatcagtggaaacatttctaactgcctgaggcagtcatatgccacagctggcaccatatttaaactacttttccacgtaagtgcataatttggtcacctggtgataagcagcaaaaagctacaaaaggagattttccaaaaaaaacaaaaagttttatttttagtgggctaattctgcacttttgtcaattaggcctttcaaggtagataaaaacatttgtttgcaaattaaataagtcagcaaatttcagcaagactcagcaaaactctgaatgccattttctaaagatgcagtcatatacttgttaggcgtagacaatcagatactctctatgacatttagtggctccccagatattgaaaaccttttaagtcaaagaaaaagcaacactattggctaaaggaaagtcaagacaataacaaatgaaatgaaaatattaaaaacattacgtaaataattattcttttttttttgagatggagtctcggctttgttgcacaggctggagtgtagtggcacgatcttggctcactgcagcctcttcctacagggttcaaatgattctcctgcctcagcctcccaagaagctgggattacaggtgcccgccaccacgcctggctaatgtttgtattttttagtaaagatgggatttcatcatgttggccaggctggtttcaaactcctaacctcaggttatctgcctgccttggccccccaaagtgctaagattataggcatgagccactgcacccggccaaaacatgacataaataattgttcaaaaagatatattctggagaaaaaagaagatgggacagataatttaaattggtaaatctttttattttatattcaaatttatatttttcattatttatgtattcatttttatttcaatgtccagttctgatttacttgttccttaaggataaatttcttaatgaaatgacaggtatatttgctctgagttactacgatatcaatagtttaaacacagaatgatttagtaaaaaaccagacatccatttatagtaacactttggaattaccttaaaaatctatttttaatgttttatatttttaaaattactgcctatttcttaagaatgtcatcaaaacatgttctattccaacgacaaaaaatatgaaagtatttatagtgacactttgccaaaccactgtctaatctgattaattcccttgctttcccaatattgtttttgctaggatacagaaagcctactttcatacctctgctaacctttgtgatactattaactcttaacctgttttggagcctgttctttaggttccctactttctgcttattaatttttgcttccaaaataaaaggatactctcctgtaatgaatatttgtatccttgaaaaaacacgtatgcacaattcaaggcatcagcagataaacgtgtttgtccccatggaagccagtggaatgatttgttgcccctcttcccgtctgtccccacaaattatgctatgttggaagctgctacttttgcttgtgcagcttgaccctatgtctctctacagagaattgaactgtcagcctttgaaataacagaataatttaggtgatgaggttttattttttttttcttcctcgaggaccatactgaaaaacatactactttatatagagataaaccctgtattctgtaacaatggtaagaacagtgcctctttcaaaatggcatttatgagataagtgaattgttcatgtaataaatttgagatagaagtttctctcagaaatattaattgcaacaagataattaagctttccggggatcagaagattgagagaaataggataattttggattctaggtagatagtgaaaaattacttgtaaaaaagaattatgattatttttattgggataagaaaataagatgctggactggaggtcactgaatagcattatttttaggaaatgttaattcataccctgagttttggaaaagacccagaagtggtagtcaatttgctacacatgtcctccaaatgttcccagatgcccagtggggggtataatctacaaatatggggtgaccaggctagctctcagctggtggttgatatagttcattcagctgggccagctgtttatcaggctaaaaataaaaagaagagtgcatttaaagagacaaaggactcagtaagagctaataagaattcaaggtaatgtcgacttttcaaatatttaggggaaggccgacacagcccagttaatgccaagtttcaatagcacattcaatccaggcacaggttaagcattttgggctctctgcttgcttcaggggaagtggtacaaggctttagacattcaggtttcatggagcctgaagccaatacaatgcaaaagactttagtaaaagtaatacaaaattatgaatacataattagtttcagggccttggatggggctcagaagtgaggaggactgaactgtaagtttcagaagcctcctggtaaatttgcctctgaaagcagaaatggtacccctgtcagtttcaagggcaggccttccagaaggagtaagagctgtagcaatcaggtaaggtgtggactaaagatagaacagtggcagcaaggactaaatgttagagtcacctgggagacttttaaataaaacatttctatgctccagatttctagagattaatacccaaattgtctgggatggtgccaggttattgacattatttagctcttgtccctcctgtaattctaaaatgcagccaacgtttaaagctactgatagttaataataattgtggtgaagataattttggagctaccatatagggaacatctcataccaagtgtgagatggcactgtatcaaacactttataggaattatcttcttaatactcatgacctgcagagatatgtgtatctccccatcttaacaaggaggattctgagctccagggaagtgccttagctcatacagcaagtgcaggaacctggatctaaactctagccaggcctggctcattttatacccacatatttctacctccttaggtagtagcatctttgagagggccacagaaaaagcacaagccctcacagaaagaaccagacagctgattgtctaccactagggcaatttgtaaggattgtctgccaaagaagtcctgggaagtccaggaacctccacacatacctgcagagacagaggtcactgttaccatatctggatgtcaaaaaggtcttttggaaaccaaggttttatcctttttttgttcttcccctcatctcctcacccccaacaccaagggttaaattcaacatcagtagctgtggcacaagtcctcctaacaccttttgtcctcattcaccccgtcacttttgctgctcacaaagtgctccttgctccctgggtagatactactacccctgtctgtaggtttcttttttttcctccattaatgctttccttgccccctgcccccgcttcttcctatgcatcatctgtagcctactgaagtgtgtttttatatacctgtgtatacccggatatacacattgggaaatgcttcccaattcctggcttaaactcttgtgctccattactcatttaccaaatagaagtgtcttcagctgcacttaatttcaaattccttggtcatgtttcggtacctccctttctcctgataagtgggaaatttcatagcctgggaactgaatgggtccatactagcccaggtacaatttgagaagcttaatatcataatgcacttaaaataacctgcagcaatcgaacaccaatctgtacctttataggaagtttatgcaccatggtttaccccatctagctggaagttggcttcaaaatcagccaggctccccattggcccataaaattagtggtgtccatgcaaggttcctaacttgtctggacatgggataattcccacggtagctgtgacttggtgatttgctctggttcccttctccccgaataaataggcaggtgaaatgcagaggaaggagcatgggaggtagagccaaagtctggcattcaaatccagctccattgctttctagttatgagaccttgtataagttagtcactctgtcatctcctgtataaaattgaaatgaaatgcctacctgatataatttttatgtgtggtaacatgaaaaactcttttgaaatgtgattggcacgtggggatgcctaatatatttttatatatggtttttaaataaagatgcttccctttctcaagaatgtgtctatcattataattctttcacagacacccccttttctggaaaagccttttaaaaatttttcataaccctggttatactcattttgtgtgattccaataagctgttagaaaaagcagagcatgttgtttaaggtgtagagattccagatattactaagttttctctccctgcctgctgatttcaggttcagagtcaaccctaatacataaattaagagaaatcattagaaaatatctcgaaccctcccttcttgttagtgtaacatgtgttcagtcagtactaatttatgcatgacattaaatttctttcctctgtactgaaaatgtgctcttttattgctttcaggcaattgattaaattcagaaacacttatattctatcctgtatagagaatagaaataaaaatatgtgatacttttgtatcatatatatatatatatatattctaggaaaagatgaaagggaaagtaatgtatattttacatatcaacgcattcatagatcagcaaattgttattgagtgcatactctgtgccaggaaccattctgggtattagggacatagcaaaaactaaaccagacagaaattgtggacctcatctaacataagttttacaattaatagagtgaaacatgaaaatagatttttcccttattttcagttcacacatatcatgaccagttagcttgtatttgttttttttgctgttgttttataacatgcttttatgtagtttatctaattaaatcctcgtagcaaatttaaaataggttaggtagattatgcttaaccaattctgtattagaggaaaggcaagcatggggtagcctaagtttgctgggagtacccagcaaagccagtggtaacgtttaccatggatttcagatcctccaatatttggtgacttccactttccacttcttctataatcctcatgttaatattcattcccctcttcatgatttaacactatatacaattcccaggaggaaaatgtggtagaaatctatttttccttgctttgccacactgaactacaaaaggtgcaattatattcatcctaatttatccatgtaagtataagcattctagaggaggaataaaaacaaagttagttgtattaataaagcattattatacatctggcagtagcttacatcttatatgtatatatttttaaattttgttctggctttttagtgacctaaggacaagaatgttgtattaaccacataggcagtttgagtttagtctcaacctagacttttattttctgctgttagttttactactagcataatactcaactgtttgacttttcctcatatataacttcagtgatctatttcatcatggttaacgttaaataagtatctgtaggtatacagatgtttcctcaaggagagaatgatgatgatggtgatgattataatctttttgaaatatatattgcattaaagcatttttcctaataatccttttacgaactatctcatagatgcatttcagcagagaatctctggactgatggagagacacttttatctgtagaacaatagtgacttctgttattaggagcaattgctaagcagctaaaacagatgcttttgtaccaattgtgcataactaaatgctgatcacataatacagtgttcttgtagccaagcaacagtaaataaaatggtccctatcttttctctctaagaaacattctttaagagggaaaggaaaaaataaagtcaatttgaggaagccagaaacaagcattccaactggcaactgagggaaaaaatttaaatgttagaatatgcacacatatatttctacctggctagaccatttttaggttgtctatttaagtggcctaagagacagtaactattctataaaatgtgtggagtggggcagaaaggttaaggaccctccgaccctgattttctccctctttgagcattggcattcaacatgaaggaaggaacaagtcaagccacagagaggtgaatgcactggaggaaagcttcaggaagggttgtatgtatacaatgtataggttagtttccatcttttaaaaagcttataaaaatgatataagaaaatgataatacatttttaaaaagaaaaattttaaacacaatctcaccatactaatgttttttaatgtattttttaacctagtgacctcgctagccccaggcacatgtagtgtattgttcatctctggcaggtttttattaagttctttaaattatcttggtcatttaataaacattactgttttaaatttcaggatctctatgacaacactaaaattttatagtaactgcctttttaccactgttcaatatccccagtgactatcaaaatgcctgacatgtagtaggtgcttaataggttcattgaatgaattaatgaacgctatagcctcttgttcaaactattcgctttccaagattctcttcctttccccttccttccctcccaaactgattttttttaaactgagatataatttatatgcgataaaatttaccattttgaaagtatacaattcaattatttttagtatagttccaaaatggtgcaaacatcaccaccatctagttctaggatatttttatcccctccaaaaaaattccatagccatttgcaatttttccccactctcacctccctccaactccaggcaaccactaatctatagatttatggatttacttagtttggatatttcatataaacggaatcatacaatatgtgtccttcttttgcctggcttcttcacttagcatagtgtttctagggtttacctccattgttgcatgtgtcagaatttcattctttttcatggctgaataacattacatcgtgtgagtataccacattttgtttatccattcatcagttggtagacattttatttgatcaccagttgatgatcatttgggctgtttctaatttatggctattatgaataacactgccatgaacgtttgtgtacaaatttttttgtgagcatttgtttctaattttcttgggtagatgcctagttgtaaaaatgctaggtcatgtgattactctgcttaactgcctgaggagcagacaaactgctttctgcagtggccacattatttacagtcccatcagcaatgtatgaatgttcccaaatctctacttcatcaacacttattgtccacttaaaaaaattgtatccattatagtggatgtgaggtgatatctattgtacttttgatttacattttctgaatgactaataatgttgtgtatctttttatgtacctatgggtcagttgcatactttatttggagaaatgtctattcaaattctgtgctcattttaaaaattaggttttttgtctttttaatcataagttgtaaatattctttatatattttggacactggacccttatcagatatatgacttgcaaatattttctcccattctataggttgtcttttcactttctttatagtatccctcaatgcacagaaggtttaaattttggatatgttcagtttatcttttttttttttttgctttggtgtcttgtgtttttggtgtcaggtctaagaaaccattgcatagtccaagttcacagagatttacatttatattttcttccaagagctttatagtttttactcttatatttaaatctttaatccattttgagttaagttttgcataaggtaggggttcaaattattttgcaagtttaggtccaggcaaccatagtaatgtgaatatcacaataaagctaatcatgctaattttttggtttctcagtacatataaaagttattttatttcgtccactgaagtcttgaacccctcaaagtcgttgatgagggttgtaatcaaccttttccagattcttattaatgttgatattttgaccttttctcatgaatcacgaatgttcttaatggcatctggaatgtgaatactttccagaaggtcttaaagttactttgcccagattcctcggaaggatcattatcactggcagcataataagtcttaaaagtcaaaatttctcctcgatccatcgactgcagaatggatggtgtgttagcaggcaagaaaatgacattaatatccttgtacattttatttttggagctcatgggtgaccaggtgaattgttaataaggagtaatattttgaaagaaatcttttttttttctgagtagtatgttgccatagtgggcttaaaatattcagtaaacccaattgtaaacagattgctgtcaacaaggctttgttgtttcatttctagaacataggcgtagatttagcataattcttaagggctctaggatttgtggaatggcaaatgagcactggctccaacttaaaagtcaccagctttattagcccctcctgagaaactcagtctgttgtttgaagctttgaatccaggcattgacttctcttctctagctatgagagtcctaaatggcatctttttctaaaagaaggctgttttatctatattgaaaaatctcgtttagtgtagcaaccttcagcaaaatcttagctatatcttctggataacttgctgcagcttctatgtcagcatttgctgcttcacctgacacttttatgttatggaaacatcttctttctttaaacctcatgaaccaacctctactggcttccaccttttctcctgcaatttttttcacctttctcagccttcgtagaattgaagggagttagagccttgctctggattgggctttggcttgaaggaatgttatgggtggtttgatcttatatccaaatcactaaaatgttcttcatatcagcaataaggttgtttcattttcttatcatttgcatgttcaccagagcagcactttaaatttccttcaaaaacttttcctttgcattcttaacttagccgtttggcataagaggcttagcttttagtctgtctttgcttttgacttgccttcctcattaaacttaatcatttctagcttttgatttaaggtgagagacatgaggctcttcctttcacttaaatgtttaatcctacattcacttaaatgtaggattattagttggcccaatttcaatattgctgggtctcaggggatatggaggcctgaggaaaggaaaagaaaaaggggaacaacaagtcaatagagtgattggaacacacataccacatttgttgatgaaattcaccaccttatatgggcatagtttgtgttgctccaaaacaattacaatagtaacattaaagatcactgatcacagatcactgtaacagatataataataatgaaaaagtttgaaatattatgagaattaacaaaatgtgacacaatgtgagcacatgtagttgaaaaactaacacccatagacttgcttgacgcagggttgccatgaatcttcaatcttcaatttgtaaaaaatacagtatctgtgaagcacaataaagcaaaatgcaataaagcaaggtatgactgtatatccggtggttccagtatttgttgaaataaactatgtttttctactgcattcatggcttttctccctgaatctgccaaatagaatttcctcaagtatggctctttatgatttacagcattaatgtggatgaacaatttgttttttattttcatggttacatatttcttttaaaaaatatctttcacattttatgcctggtttcctatttatgataaaaacaattatgcaagtaaaactaatgttgttttaaagaaaaaatattaggaaaaccataatataggaggtacttagactggcaaatataatgacagtgaggtagggataagaaaactgtggaaaatgctgtttggtaggttgcaatcaactaatctttagattagatattaggagttaatacattttcttccatcctccctccctccctccctttctttattccttctttctttccttccttctttccttcttttttccctaaggcactaagaaacctagaatattaatatataggaacagcttttgagttagtaaatctttttaatgatttaaattatctattaactctcttttaattaataaaagctaccagtttgtgagtgtttaaatgccaaacaattatctaggcacttcctcaaaaatttctgcatttaattcatactcaattaactttcctgaagtcccacggccagagaaaagtacaaccgattgtgaacccagattgatttcacctctcagccaacacaatctccttcataccaggctaccttttacctcttcatccacatgaattaaagcttgaatgtagaggaatagctctactaatcatagctcaggccatgtgagtgctagaggtctgggatgaaaatagctggtggggttctcagtcccttctcaacactgttgagaaagctttttgacctgcagtttcccttcctccttaaccattttctcccctcacttttttcttctgttttctcttctggaagataattatgaatgaacattttattgttttgtgaatatttgtagttacttatcatttaccaagatccatatttgaaatagagctatagcaaataaagattacatattcattgttttattagtgattataaaaaatacataccctcaggttctgacatttcaccatagtttcataaaatcgtacatctttcttgctttctctctcctttcctctccttccctccctctccctccctccctccctcccttattccttcttttcttcttttccccctaagatactaagaaacctagaatattaatctataggaaggaacagcttctaagttagttctcattttcctaagaggtaatgagatgaacattggcttttgagtttaaatcctgaaacattcccactaattattaaatttttctgagcatttttttcatataatataaggtatagagtttgctaaacagtgttgtttcgaaaattaaatgggatatatttatagtccctagtgttacaggcattataaatgtggctgtacccaacaaatgttgccattattaattttgctgcatatcatattatttttcatcattgtcattattaaaccaaatattttgttaaaaactagaataatttagattccatgcatgttgagaaacatgggtggtctggtgattgttaactggctcccagtgcagattgttaagactttttgatgaatggaaaccctctaactattgttgagaatgtacaaagatgggaagtgtgcttgtggccatgaaaacatgctgtgttttccttttcatatcaaatgtgatcttaattaagtctgttggcaacactgatttatattttaataaccagagatatattagctaaaataagagtaaagagttaagattcttaactaatctgtttcttaaagtgcctggctgggttttgcacattttctttggattcagtaatatacactatgcaagatttacaatgatattggtatagaaggatttccaaacaccttgcaaatcattatcttctgagtatagacagagaaggtgtagatattgttttgtcactataacctggcttgctatgtacctttatgatgatgtaaaatatactagtgcagttttcaaacattttgatctgttacatagtaaatattgcattttatattgctagctagcacacacacattcttagctggaaaaaagcgccaaattttacctttgctatgtgcaatgtcctcctatattttctgatctgtcttattctatttcattttattaacttatgccattagtttgattttataacccagtaatgggttacaacctgaagtttgataaatattttgtttcaagaagtaaccacttcactttggctctctaccaaagtttcagattaaggaattttatgaaatacctaggaaaatcttaagaagattatgacattcttcctttccttttttttttttttttttttttgagatggagtttcactcttgttgcccaggctggagtgcaatggcacgatctcagctcaccgcaacctccgcctcccgggttcaagcaattctcctgcctcagcctcctgagcagctgggattacaggcatgcgccatcacgcctggctaattttgtacttttagtagagatggggtttctccatgttggtcaggctggtgtcaaattcccaacctcaggtgatccacccgcctcggcctcccaaagtgctgggattacaggcatgagcatctgcacccggcctagtattttccatttttatgccagatcattctgtttggtaatatggctcctctctccctttcacattggttaaagacattttatttactttatttaaaataagagtacaaaagcatcctggaattgtatttattccctttaagtacaataagagataattccactgaatgtatattacgctctttcatttttttcctccagtttctactattttctacatttcataaggtttgcattgcgtatgaacttcttaatgagtgatttgtattgggtgtcatgttttaaatgtaaaaagagtaaattatcacaatgaaaacgaaggatgtcgaatgaaagagcagacggacagagcttgattgatgttcggaagttatttttgctgtgaactcctgtcagcctagaaatcataaaacagaaagaaggcttggttcagctcacatgcccttaggggatgtatggaaaagaatttaaaattctgatagagtaacttcaaaaatgtaacagctgaaataatttatttcactacagagccaccaactgaacttttacgttgaaatgattctttttgaagtttcacatggtagcaggaaggcacagtggtctctgcaccttggttgaaaatgcccaggctgctcagttatgccttcctgccggaaccaaactgtggccgctgctctggttcttctggcactttctcactgatcacttcctgaataatgggagaaaacaactgaaagtccatgatttcacaaaaagggtgaaggagaaaaaagttggggataatatgggtgtttttctttttttattttaaaatgcttccaaatattaatttggggcattgtgtgaaggcaatggaaaaaatattgggactacttagtccttgagtattttaatccataatgactactaccacatttgactagctagattgtgatatttgagctggctggatcttagagtcatctcagaagaagaaatagaaaagaaaatgaggcagtgccactctagttggtgatacatgacatttctttctgttctcttttatttttatcaagttatacctgggcagcctgatgtgtttgctttttctaggtgacattgaaatgatatccaccaaggaaaaagaaaatctgtcatccctgtacagtgtttctcaacctgactccatctgtgatagttgtatgtttaatcgtagttaactaaaaatatgcagaataatgatgatgaggctaatacaccttaaaatgaatttccactgtattaaaacaacaacatgcattttataaacatttgtatctacctatgtatggtttatgtattagagtgtataacctaccatatatccaacctatcaaatacattcacacactggaattctagattccttacaaatcattccacatatctacagtggtctgtaactcaccagttgaaaaccagtactctaaaatgttaaagatcactatgccaatcagatgagaaaaagaagcaccaggaaattcctgaataaattgtttaaatggtcaaaactataaaataaaaagagtgtgaatttaaaaaaatgtattatctaatttgtctgtattggtatctataccttgagacaaaatttaacattttcctggtatctacagatttttttttttcaaaggagatccttctatcttgctttggtgtaaagaaacaacagaaaatatgctgttgctataaataatatttataattttaataatttcctatgctaattacctaactgtgctctattattaaaaattgctaaggtagatgattgcacatgtaaaaaaagacacaatgacaaccacaaaaacaaggcttcacatatattttcagcaaaggtgaaagaactagaattatacattttcaatttgttactgaaaattaattttatatatatattttaatatataggtatttctgttcttatgaaaaatagtttcatgatcagatacagaatttgaaacatggaaaattctgctttgaggtaggggttaatattgaatcattttatggttcatagttaactaccatttattgaatgctgaaaagatatagttaactgaaaagcattctttagttaacaagcttttacaattgagggtaatttttgtctcctgccaaagaacaacgagattgaattctatgctaatgaaactgtttttcagtggagcatacagtgattttcataatcctagtcctggctgggatgttgggaaagtggcacatagccagaataattaaaatgggatttaaggccatattttggaaggctttcatttttcaaaatggtatgtttgtgactgaagttacttctgaagtctcaaaaatttcagacctgaaagtaaacttggtgtcaaggaaagtcttgacctttaatttaaattgcaaccaactttgctccttctagctttctgatcttgagcaatttgcctaacttctctgagattcaacttccttaattgtaaaataatgtaatatttatcttgcaaggttgttaagaaggtccttataatctctcaatcacctgtcacgatgtactcaataaaccatagttgctattattatcattagtattatcaccagtataatcaaatagttattatttctatgtgatttagcagatgatcttttatactcaaagtaaactcctttctaatggagccgtcaggttaaatatggccaatacaagctaaatgaatggggctttgaatacatctatttgatgaacccatgattatgaaatggaaatgctaaatctgcctcaatttctctggtgataggacagatgagattcttgagggacccagattgtcacgtgtataagttatttgctcacctttatgaacagtcctttttcaaatgaatattgctcctttggtaattgtatactagattgtaaaatgtctttacatccctctgaataattcttccttaaaatggtcagacacagtattgatttttcctggggtattcctttgccttgacccagctcacaatgcactatccattggacaaaataaagcatttcctttatatgaagaaaagagaagggtaggtagagacaaaggaaagtctgtctggaaaaatctttgtactttgatgggctttgtatggaaaaaaagaaatcaaagcttagggcagagaacttggacgtggtaggtgtaggtctctccacaagatggcactcattctccctcttcttttttcaattgccaaaaataaattttgtcactttttattttttactcagtcacagaacaaatatgttgttagtttgtgtatcaaatatacctggtttcacatattttttaagtgttcgatcatgtttctgactcttagtagtaatgagtgtattttacctcctgtaagtctctgtcggtgagtacactgttttgggaggaaacactcacccctactcccagtcacaaatctaacaaaacttaaattaatcttctaaaaattttctgttaaaatctccaaacaaaactgaagattaactgaaaagaaccagaatgtctccattgttgtttttatcattattttaaaatttaagtggacatgcctttcaattttagggaaaatctctatgatacttccaatacttccattttgatgtaagaagcaagtttacctccaaagggccttgggtcttcttacccttgttagtgatacgagatgtcacaactctcttctagtcactggaagttaatgtcaattggagtctttataatcatttaatttttcttaatacagaaaaaattgatctatcaaatgatttttaagttcatatgcaaaagtaatgtatgttacttattaaaacattaaagaaaaaatgttaggctactgtgagttcactaaaaacaggaatttgataaatggtaagtaaatacataaatttaattgataattttgcacttatatttttatatcacattatattttctagttacttttctttccaaatacttagaaggtaaagaatgtatgtggacaaaattatagcctacttgatttgttaatgtgatgataaagatctatttaaaaattctggttataccatggtttccagggtctagattttcttttagcccacttcagagtcagactttagaatatttatcatttctgtaaaacagattcctgaaagttaaggtctttcataccttcatcataacagttattattatggaatctttgcctcacttttcagaatgctaacagtgttggacgctaatattacagaatgcttgccaccctatcgtgaaagtcaccctttgaaagcaggaggaaaaaagaaaaatctagagaaggccctaagaagacaaaagaattattgtagtaagaaaactaagacttatcagaatattcataggaaagcaaggctacggcttgaatgatttgataaaaataaccactactgccataataacttgttatgggttacatgctacaccaagcaattcagaattattagatcctttacattcctaacattcctaatgaaacaaaaaacattatcccctttgttaacacacaggatagctgagaatcagaaaggctaagtggcttggatttggaggcaggatttaaacccaggtgtgtcttgttccaaagcctgtgccttgaaccattatatacccctgcttccctgacttgtaaagacattgaatattggaatttggttactggcttctaagataagcaatatctttacatgaatgtagattggttattgcatcttttccaattttaaaggaattgagaagacacattttcaacaaactcaagagattttgatttgatgaagggaagaagtttttgattctcaggctgtggaaatagtgaaaagaaacaaacaaaaaggattatgtggactctaaaaggggtgtcttcaagaaacaagtagtcaaaactacctttttaaattatgtgggtcaatcccccaaacgaacataaggagctgcacacaggtatagcctccttttagacatttttattatgatttaaacacctttatgtgaaacatatttcatacatattgaactcagtcaacatcacttcacattcacttcgtatctctgtctgtatatccctagacctttaaggagtttttcttacttgttgtaacttttctcattaactgtttttgtgcattctcatcaaactaggcacctaacctactttcatttgttatagctacgtagaagtttcttctgttgttgtgtcttagtttacctggatatttctgtgctgttgggtatttacatttttcctgcttttttctctattatgagtaaatttttttaaggggggagtgggtacatgttggttctctttgaaataaaatccctaaagtgaaattattatataaaataatactaatagcttttcaactcttgttaaatatttccagattgccttttagaaagaacaaacaactttttaatgacttcagtaatagagaaatcatagatcccaaactcaaattccgaataaatgggcttttcctagttttccaaactggcaaaataagtgagtgtaactgactaggtgtttgacaacagatggtagtgggagcaacaacaacctggagggccaggcaccagagaaagggggcagcagcctctgcaaagtgaagggggcagcagcctctgcaaagtgctgcctgactgttgctttggttatgtcagtgtgtgtattggtcaggattctccagagaaacagaatcagtaagttattacaaaaggagatttattatgaggcattggcttatgtgattatggaggctgagaagttccataatgtaatcactggaacctggacacccaggaatgccagtggtacaatttagtcccatcccaaaggcctgagaaccaggggaggtgatagtgtaattcccagtcccagggttgatgatgagatgttacatttcaaccaggcaggaagcaaaaaggggtgacttcctccttcctctaccttctgtgctgttgaggctctcagtggattggatgatgccacctgctttaggaagggcaatccactttactgagtccaccaattcaaatgctaatctcatcctgaagcaccctcacagacacacccagaaattgtttaagctgagagatttgtcaaattcacacataaaattagttatcacaagtccacctttcatcaactaggcacccatacagatcttcttaaaccatacctaatctttgaaatatgacaacaaggctatattctgtctaacatgacacaactatcctgaatacaactgaaaattcgattcctagatgagaaagtaaagtacttgaatggtgtttactctttgtttgatatcctatgacttaaagactattatagaaaattaagagtactaaaatactataatataaattcaataaatcatattttagttgatgggggaacaagagaggaaagaaaacatttttacttcctttcctctcgtatatctcttatatatctggcatacaaatgcattcatggcaaaataaggaggaaatactcatgacaattacattcctggcttctgttactggtcactggtatttataacgaccgttttccaaactattctgtattccctttgccttcagaaagtaccctcgtgcggtaaacccaaatcttcattcctagagggtctgagccattactagtcctgcttgaatgagattgctgtgtttttccattggctttaattataaggcatagtaatactaagaaaggccctagaggatctcctgtattccagacatactcttccttatctccattgtggattaatagtccaatttcctttttatagtcaggatcaatcccccttgtcaactctcttctttgtctgttaattcaaaggcaggaagagtacagagtggccaggcagcagtcttaacttccagttcagtggaatcattgctgggtctcctcatggaagcattcttcccttgggaactaagacctctaggcctaacagagaatagtcacaaaaacaggaagcaaaaatagatgtgtgtgtatatacatccatatgtatatatgtactatatatatgtatgtatataacagtatattttaatgatgtatttattgcatggtctcatgttgctttttttttttttttacatgttacagtttggatgctttagttttccatatctgtacttatccatcttgtctctgttcagatcctaatcactccatttctttagtatcaggaatttatctcctctccaccgctggagaagacctgttctttattctctagtttttaataaaacgttttactctcactcagctggaatacagtacaatttggggtatgagaaatgactctaaggtaattttttccatactgctatcacattggcccaacactatttattaaatataatttatttctatattgttggggattcatataatcatttaaattgatttttaccaatctcagttgtatttcatcagtctggctttatgggctatgaatttttcttaatatgtaattattgctttgtgagtttaatctctgatataataaatcatacagagatatatcaaatttctttattatttagacaaggtgatctcttcatgtcctctaatattctcttttgcccctctccctaaaaaactgtcatattctaaagccaactaatatgggaaggagaatgaaatgatattagttgagaatgaatgacagactacttaggataacatgtatgccaagtgagttgaatcagctgatgtagtagtatgactgacagtttttgttgaatattttatgaatctattaaattaagaaatgaaatggatggtctctaaatatccttataatgtggacattctctgagtttttattctaacataactctaataatttggacaacctcaatatctgacagcatatttcccttgtgatataaagtcagtctcagacatggtctcctctagggaaccttccctaaatgccactacaactgtccatgcccaaatctgaagcttctcctggctccttctctttttctccttgacactgtgcttatattactactacaaaggccccaaaacacagcaaagaataatttgttaaatgagttaagtccatttgagacctgtaaagtgactttcactgttaacaatagtccccctctgtgggtagaagcaagaatgagtttccaaacttgggaggtttgaggttctggcatcacaggaatactcccagattgctttcaggaggcaacttcatccttgccatggctcagatgtttgattggagtgaaagttaaaatgagaactgacctacctgataatcatagtgacaaaatgaacatatatggggttattttaattattatttcagtccaagatggtcagcagaaactgtacatgtatgacacatttagaaacttagaatattttcagtctttatccagaaaaccatagaggatattctaaagtttaaagcttaaagctgctgcatcttcacactgcaatttattgttcactgctgatgataaactggttattcctgtcacaagagtgtgctaggctgagactctgggaattgtatttatctagacaatgataatataacatagtaagtagaaatgaaattttcccatctagcatgttttctgattacatcttaaagaaaatcattttggtaaatatatctgaaatgaaggtggggatattttacagctgtaaactatacctacatagcagggatgtagtccattaattctcaatgctcgaggtgaggctgacaattcataagtggtaaatccagagagttatgaagatattaaatctcacatctggtgagaaaatgtgttatttcactgggttgattgacggacactttcccattacagtgcaatttgggaaatcgcactgttaattgctagggttttagcaaagctctgtagttcaattccaattactttagttttgaaaaacagaacagctggatggtaaaattgcccggagctgtcaccaagggagggcacaagccagcaacccaacctctaccattcctgatttggattttctacagagctattagtgagtgaaattgaaggcttctggcaccggaggtctccctgccatgtgccttcttctggctggaagcacgtttgtttgcttaccgctcaggtgattgccaccgtaatcatcaggcacgctcccattattactcatttgcttccctcttcacaggggagagatgagaaaagcaagtctcatcacatcttgatctcctcaccacagggggatcgcttccttgctttagagccaagtggagtttacactttctcctcagagatttcttttgctgtcaaattgacctttgagtccttcgttatctatgggggcgaattacatgtttccacacacacagtctctttgtctctggctaaatctagaaagaacaactccagttgtggtttggaaattacctagcatcagcagctaaatgtaatcaaactggatgattcagtacatcccaccactaactcccacatcgacctcagttcactgtgtttgaatcaggtgagtgtcaaatgttttctttggttaaggtaacgtggaccatatccagagcctcctggctccgccttgcttggtatagctgtgaatatgtaaggggctttcttcagtagcttcaggatttaagagcataatgaaatgggggtgtcacacttctgataaaatctcagtgagcacacagttgaagaaggatttcaagaagaaatatttgtgagaagaaaaaaagcttagttatgcacatgggaaatttaaagaaaacaatatcttgcctttctagaatttctttttaatattcattatttattttttatattgtaaattcagactaataatttttggtgtccctcaaagtcaatactcttgaaatatgtggtcaacacattttgacagggacggctgtggtgggggaagggaaggcatacatagactggcttcaagaacaagtacctttcttccccagcaatgtagctcccaccccagacttgcacaataatcatctaaaaaatacctgtcctaactactgttactcttagaatgcttttttgggagtcttactcccccttcttctctgagaggcttatcaataaggtgactatatgcttatgtggtctgcgccttgtcctaatacaattattaataatataccttgtattagtccattctcattctgctaataaagacataccaagactgggtaatttataaaggaaagaagtttaattgactcacagttcagcgtggctggagaggcctcaggaaacttaaaatcatggcagaaggggaagcaaacatgtccttcttcatatggtggcaggagaaagaagtgctgagcaaagggggaaaaaagcctcttataaaaccatcagatcttgtgagaactcactatcacaagaacagcataggggtaattgccattatgattcagttacctcccactgggtccttcccatgacacatggggattatgggaactacaattcaagatgagatttgggtggggatagagacaaactgtatcacccctataactttcaaaagaatacctaggtcagatgataaattgtatagtagttctgtttatcgatgtatgtcttaatcatatacaatatttaggtttagaggaaacctgttaagtaacatttcctcaatctccccagatttaccgttctgttcttaacctttgtaaattgatgccccagtaagtggtcccatccttcaatcaagccatacttaaaatccctgagttatagaaaagtatgtctgaggggaaagttaaaacaaattgtatgcaaaaaaaaaaaaaaaaaaaaaaaaaactcttggaaaattaagaggctttatttaccttcaaaaagcaggacataatggtttaaaagtaaatactcattgttttcgtttgtcattatttgtgacttgatattttggatcaatggcaaatctcttctgaaatatttgaaatgccactttttaaagctgtttttatatctcttctcttttcttacatttaacgagctcatcgcttttactcctctcttgtaggtcctcttttccgtcttctcattcctgtggatctgtcctgtagcctttccacgctatcctcaggctcatctgttttctgaagatgggaaaagccctttggacaaggtaggtatgcctgatgataagcagaggtagcattttcaatgtggaacatttttagcaaacctgaatactgccagtgtgttaataatgtgtctttatcaatggaaactctttttttttctacttcattatatacctctaaagccatttatcatgggaatttattagttttgtttaagtgtatgtaccggtatttttcttcagtgaaattcatttctatatacttctaatgagagggaccatttgtttagattatagtccatactcgatcctgctcttctttttgaaagtctttgaaattctattttgttctctccctttccagacctgctattgcacagaaaattggatttgtttttttaccttagtaacttagttattcataattctgtgattattcctcatgtgtgatttctgtctccttggctatatttaaagtttactggagacagaagccatgtcttcatataccttttagatctcttacagaactgagattcttgttaagtacgtgaagaaaattgcattggttagcttaacaggttcttgaccaaagatgtcagcactgtggttgtctgtaattcttgtatacagaagctgttttagccaggggtcttagatttcaggcatgagacaccacttttagtttgcttaagcaaaagtgagaatgctgctggaatctgttgggaagttatggctgtgttttagaaaattgaaggaacaaagaaaaccctagtctcagaaacagcagtacccagggtggcctagggttccaagtaatcattattaatggacaagaatccttagtctttgtgttgtttggaattcaaagtctagatataagcttgggtcttatgctgtcattttttggacaggtgttgtctaggttggtgttgtcttcatgtcttggacccatgagtggacaaagaccttaaaaagccctagctctgaagccgttcctttctatatgctacttcagacaacgcatatctaaaggtgcaatgatagcactaccagcccactgagtgtctttcatttcatttcattgctggattttttttttctttttccccaagcagacatgcatgtattctctcccactctgccatgcattttatttatatctcaccctagggcacttctccatttagagattctattgtaagctgttatcatctgtagcattgactagatttctatgcaggttaaaggaaggaatgataatgcaaagttgctagctctaacagaatgttattaaccagggaaaaatacatttaaaaaaatttcaacttttcttttagatccaaggggtatatatgcaggtatattacatgggtatattctgtgatgctgaggtttggggtacaaatgatcccatcatccaggtagtgagcatagtacccaagaggtagtttttcagcccttgcccccttctctaccttctccctccagtactccccagtgtctgtttttctcatctttatgtctatgtgtactcaatgcttgattcccatttgtaaatgagaacatgtagtatttgtttttctgtccctgtattaattagcttaggataatggcctccagctgcatccatgttgctgcaaaagacgtaattttgtctttttaaaggctttatagtattcctagtgtatatgtaccacatggcataaatacatttatggatgacttgaaacttgtagttatatcatggttcaaggcaatgtactcttctgtgattcctgctaaatttttaaattgaaatttctcccttttttatattacctcttctcagacagatcaaccttctccttcctaaaaattaacagtttccccacagtacaaatagagtataaatagccaaaggcagcctcttgatgaacaatcaaaagatgtgatagaagctgaagtcattacatcttgtacaataatgttgtttctttctttggacttaaaagatattgtgctaggtataataaaaatagcttttgttattttgtgtcatcatattgtaatggatttcactgacattttacttattaatttttaacattaatattttattacaaaaatgtcatcttgtcacgcgtgaacaatttaaaataagttctgctttttaaagtataattgaattacattatgccataacgcctccttttttttttttttttttggttacaacttgtctgatatttttaaaagaaaatctataggaaaaaagctaatataaatgttttctctgtggtataattagaatattttgaagtacttttatatttattatttaatttgtggtcataaatgtgctatgaaaaagacaggtggtttaggatggcagctttgagtcacgaggtatcagtcaacctggaaattgaaatcaaccatgtggataatcaggcaatcatacaatgaagccccaataaaaactcttaatgttgagacttgggtaagctttcttggctggcaatactctgtcagctgtcacacttcaatgccaggaaagtaatacatcctgactttgtggggagagaaacatggcaactccagatttggtacttccccagactctgccctttgcccttcatcccttggctgatattgaactgtatcctttccctgtaataaactgtaaccatacgtataatagtttctatgagttctatgagtccttctagcaaattatttatcataagaatggctttgggaatccccaaacttgcacttggtgttaaaagtgagggaggccttacaaaccaactttgcagttgcctaaactcccaagaagttgacttaaatgctcacaataaggtactaaaattattgatttctcctattccctctgtcagttattttgtgaaagagactaattggattcagtttttgtctatccatgacagacttcatccctgaatttaacacccccgaatttaacattttccatatttattgaagtaaatgtatttgtttaaagaaaccagctaatgaggacagtaacacctaaaaatattttatttctttttgaaaactaggttttgttagcaagtttaaaataactaaagagaaagagaagagaggaaaggaaaggaaaaggaaaaggaatggaaaggaaaaaattatcacatatagttaaagttcaggccatacaaaaattttatctgtgaaaaagtaaatcccctgccttcctcctattatagaatcttttgttgctcaaaacaagacttgtatccctccttttaattcttacatttatgtatttattaatgttaaacaatttctttcagattgattgaggccctaaaggttatagtttgtgtgtgaaatcacaagccacacattaataatttatcagtatttttttctatctccttatcagcaattagcaggccccactcattttttttttctaatctctacatacactatatttttattatcctttttcttgcctgccagccaccacttctttagttttattgatttggtgcctcttttaaaaatatttgccccttcccacaatataagttcaactactggttggttactgggtgcctagtgtgtgtgagacaccatttactattttgaggatcatttattggaaaaacctaggtcttagttaatgagtctctagatttgatatgtatatgtgtatatatgaatgtgtgtgtgtatgagtgtgcatatgcgtgttccagccttcagaaatgatctttacttttgtagaacatcccaacattctgtgatgtaatctttaattaatgataagggggaaattagacacatatctctaaaactcactatgaaagtctgaaataggtatagtagaataaattagatggaataaactgcattatattatacttagagaacagtacactctaagtaagtatcaagatgtcaatgataagagcatactctcacagcaattaaaatacagaacatctaaagaaagctgaccattagcataaacccttttgaaaattctgaagtctttcattttcattggtaaatcttggattttcagaaaatctaaagacagtagcttggctgggcactgtggctcatgcctgtaatcccagcactttgagaggccaaggcaggtggatcacttgaggtcaggagttcgagaccagcctggccaacatggtgaaaccctgtctctactaaaaatacaaaaattagcagggcatagtggcgcatgcctgtaatcccagctactaagggggctgagacaggaggattgcttgaacctgggaggcagaggttgcagtgagccaagatcgtgccactgtactctggcctgggcaacagagtgagactctgtctcaaaaaaaaaaaaaaaaagggacagtagcttgatgaataaattgcttaaattaactaatttgagacagatcatgaatttaattagcaaaaatctatatttgttaagttcttgtaccagtactcttatcccatttaaccaatatagaaaggaattataatgctatcataataatataaagagaagcatagaattgtatgatttttgtttgattaataatatatatcttgtcatagaatttcccctctttaatttataaggaaaagaagatatgttactagagatttcttaagtcctaattacaacaatagctgacgtgttttgagtgctacatgtatgtcaggaaaagcattttatgtgttttgatgatgtcattattcaccaaaacactatgaaaaaggttatattattatccccattttactatgacagcaaagtcagtcccaggttggcttaaatatcatgtttgagaggaaaatatagctaatgagtaagggagcagtgtttgattccagtctgactccaaatcttcactattaaaagctttagggctggaataaattgaatgatcatctcagcaaatattgttatgtttcagctaaagatactgagaaccagcaaattaaatggcagctagtttatggcaaaataggaaccagggtgcaggtatctggacctcatgttagtgcatttagcgcattttaattgtattcccttttcttttttacccactattagttcaggacaatcccagcctcaaaactttcaaactggagacatgaaaagcatcatataaaccataccttgtctatcttcaaatacaaagcctttcagaaagaaagggatccatggctctaaatatttagattttcgaccagtttattagggattatgaaaacttatttttaatgtggttgctaattcatctcaaactctaagcaagttactagttgacataattaaatgcttaccctaaaatggatggaaaagattcacacctgaagttgtttaaatatggacaactataactgcagtttgcattcacaatgacagtgaattatacgtgatttctgcagaagataacagtgggcaaacaagctttaacaaagactgttttttctccttttctggttatttttaatggccatattcaaacctaagaaggtgtataaactgccagttttctcaggatttcaggatcccatttattctaaaaaattttcaatgaaagttttatttgtggcgaaaagaagtggaatctgggtgtggggtacagcagccttccaaaagcaaaagtgctttgaagtaataaccttttctttgtttaatttaaaaataatgttttacatatttaattatttaataaaataacaattaaaattgtcactccagaagtatgtaccatactttagcttgcagttcaggtatttctgtcacgtagactattgtagtctctgtttaacttgagtgaatgtaaacgccagtttaacaagcacaggtagagaatatgtgaattttgagaagcatgggattaaacaaacaggtttcttgctgcagaacttatcaggagtttggcgtattagtatagactgagagtcaaaaagagggggagacctgagcatttccaaaatatgtttgaccatataacctttttcacatggatcgcttaccagcatcttatggcgtgagtagtccaaagaacacattttgagaaagtctgttctgattcattgttatctctatgttttattatgtaaatacgtttttcttatttttttcatttaaaaattaagtactataaatattctatagtgatatcaaaagagatttatgttttggccatttctttcaaagcctgtcattaaactttgtttgtatgtgaataaagcttttgcacaattttctcagtgtttgaaaataatgtcactaggtcactagtctagaaatatctcctggattctgatgcctgccaactctgggactccatactttctagtcatgtaacctttcttagtctcgattgcttatttaattttattttagaaagataacacctgtcctatccaattcacagtgttttgagtattaaataattacatttactgtataaactaggaaatatgagagcaatgtgaggtattatcaatattattaccaatattatttttactatataacatctcatttccatttaattctctaaaaagtgttggataggcttggtggagacttactaacattgatgaaaacaatttgaagtaaggattgattgattctttgaattaaatgtgagttttttctaataggttcttctaccaacctttgaaaatagatctgtctatatttttatataggttatgtagctttaatttgtttcttcttatttgctgtcagctgtcatagctaccattcccatgggaggctttctttgtcttataatttatttttaagtgagaagacaaaactgttttagttaaatttttttttcaagttttctgtaagtggcatttatgagcaatttcagatttattctgttataatggcattttaaaaagattatccttaggcattatgatggctttagaataaatctagctaaaaattttatctttgctattaaaaagaccgcttctaaatgtctttaaacatagtccatctttcagagacccttttgtttgaagataagtttgtcccgtgagtatattgaacaacagtaatgcatggcatttattcagcattttgtattttcaaagcaatttgcaatcatcaattcatttaaccacccaacaatcccagcactgagaagcaaatgtgacctgaccaccacctgagctggtattagcaccccaaattgccttctatgctcacattattgagacttgctttggttaaaaaccatccttgagacaaaagaaaagctaaatataagctccttccttctgcttctttgtcatttattttctcacaagtggaataatctattgccatttcagtgggagctgtctgagtccccattactccttagaggtggttttcatttaaagataatgacaagctgttatggtaagatccttttagagaacttcatgtgctcaccctttaaggtcgaatttagatgttatttcataactgaaatgttccataaaacttcttttttggtcttcctaggatttaatttctttctcctgtgctcacacagaattttatatatacttctgttatagctcttgccaaaattttggtgtagctctaagtctagaatgggagcattactatggcctgtaaccatgtcttctttatccttctatctattgttgttcattagcacactgtctggaatatgtgggaactcaagaatcttttaatcccatgttagaactcaactgctccaggtggctttcacccagccacccaccttatgctctgactgatgtgcggagtagaaaatgggaactgaattagatgagtccaggaaagtcttcctggatgtatgaatgatttggctaatttctcagactgatgaggtgttattttggtaaagaacataggaaacagtgtgtgaaagctctgaagcaggaaacagcataacgtactggactatgaatagtcctagtaagagtggccatcacatgcaagcatccccttcattgccgtcattgccatcatcatcttacaattaccacttaatgagcattttcaaggaacccactgctgtcattggtgtcttatagactttttcacacataaaaatcaccatagacatacagtgcaggaattatcctcataattttttcaggtaaagaaaggttcagagagactaagaaactttttcaagttaatgcagctagtaagcaacgtagccagcccttgaaccttaagacacagggattgtatttttgtggattgcgtagtgccacttgcataccatctcgagactgcttgctccttggaatacctgctgattgtatcatttctcttttctcctttgtctatgaacctgcaagtggtgagcagcccagaggctacattcagtggaacttttcagttctgtgattctgttcagaatccacacgtcctctaaaaggcctcctatagaaggagtccccattaactgtaaatggagctctgatcacaggaggaatgaggacaggagctgagaccattattctctattctaagatgtctaaagcagaccataacagcttttatgttttcattccttgctttgaggcctacaccttgaaggctacctttcttctcaggttcccaaaatggtttttattctcagaattataaaaggcaatgctattagtgcacactcatgctgtttaaggaagcaaaaacttttcaaatcttgagtacaattacttatggagtgtttaatttaaaacaagacagattgagctttattgcttgaggttaaggatgtgatatattccttacagggctttggaccatgtagtggctcattgcagagtcaactagaaccatttgagaattgcctgacacaatatagaataacttacaatttatatcaaagaaatcaataaaatttgcaaagctttatggctctttgaagacttaggtattacctaaatttaggtgttacctaaaatttcagcaaataatggtttactgtattgaagggttccattccatcttccatcccaaacacactatattataaaataatgcaaggaacatttaattaatttgagaataatatagaagtgtgtaatgtggatgtgggtatatatgtatctgtatttccatgtcattttgggatatggaatgtgcattttaggatttagaaaacatgttctgtgtaacatttctttgctcttttttcttttatgtatatattataggttttaagagcagttttagagtcacagaaaaattgagcagaaggtacagagatttatcttaaatcccctgccactatgcatgtatagctttgtccattatctacatcctccaccagagtggtacattttttacaattaaagcacctacactgatacaccattatcacccaaagtctatagtttacataaggtttcactcttggtgttgtacattcagtgggttgaacaagtgaatagtgacaggtatctaccattgtagtattacatagagtactttcactgccctaaaaatcctctgtactctgcctattcatttctcactacccagaatccttggaaaccactaatatgtttactgtcctcatagttttgcctttctcaaaatgtcatgtagttggaattatagtacgctccctaatacatgtagtacgtatttagtgctaaaaagaaattgctatcaagtcatgaaaagacatacagaaaatttaaatgcatattgctaagtgaaagaagccaatccaaaaaggtaccttctatatggttctaactacagtcataccacataatgacattttggtcaatgatgggttacatataccacagtggtctcataatattataataccctcttttttactgtaccttttctatggttagatacacatattcttaccattgtgttacagttgccgatagtattcagtactgtcacatgaggaacaggtttgtagcctagcagcaataagctataccatatagcccagatatatagtaggttatatgatctaggtttctgtaagtacacttgtattagttcgttctcatgctgcaataaagaaatgcctgagactgggtaatttataaaggaaagaggtttaatcgatttatggttcctttggctggggagaccccaggaatcttacaattatggcagaaggggaagcaaacacgtccttcttcacgtcagcaggagagagaagtgccaagcaaagggagaaaagcaccttacaaaaccatcacatctcatgacaactcactcactatcacgagaacaacatagaagtaactgctcccatgattcaattacctcccaccaggtccccttcatgacacctggggattatgggaactaaaatacaagatgaaatttgggggggtgcacagccaaaccatagcaacactgtataattttgcacagtgacacaatcaccccacaatgcatttctcagaatgtattccatcattaagcaatgcttggctatatataactttcatttattttaatttccatcagttacttagatggccttgagtaaatgttgaccctttgacaattgagcatattaatgtatatatcaattgtgcctgattcaacttacgtggagttttttttttttttttttttttttttataaatatatcattaaaggttatgtgttttcttgatcttgccctgtaaatacttttttagattgtaaatgtctgggctaggatatgaacaatggcaaggcacaaaactttggaaacactaagactcatgaagtctttaacaagtgatttcactcttagtcttacaaaattttctaagctgacattataattgatggtatgtaaaaacaccataggacaaaaataatacagagcattgaatttgtagccttgtcacattagtggctagaaaactatccattgatattaaaatgtgttatttagtaccataagatttgtgacattaacttggaaattgtcaatatcattaggttaacaaaggctaccttgaattaaggcaaaaaatatggtggagttacaaaaatatgaactggccatttatgaaattgaggaaataataacaggttataaatgttctgctgggtaaaaataatataaatgaatgtcttaaatatagtggcaagtgaagggttaggcgtagaagttttttttttttttaatacctcaggaaaactttcacagaatatttgactttcagaagtaatttaacaaaaacaataataataaattacaaagcagaaaatatgtgagatgtatttgtcataatgattaggtttttgaaaacctctgaatagccaacttagtctttgaattatttgatgtctaatgagaaagaataggatcaggagatagaggtaaggagtaaaccgctgaatgcacttatataaatattttatgaaggtgaaaataaaacaattaaggcagcacacaatatacatcacattgttacaattttgtaggccttaaaattagtaaaaatatttactatatttaagaatttccatttaccaatcccttgcccattgtgtaaatttaacgtattcattcactgtcttaaaacaatactcttaaatgtgctctgctttgtgttagttacggctcttttagccaccagctcaacatttaatgagttctgactgaatcactcagagttgttgaccctttgtcccaggctttttccaaagccctttgtctgtgctcttgacacaagtctcacacgttgctttttcccaagcgtaacattgtatgtatgcctctgaggctagcaggtctattctctatgtctatgtgtgtgtgtggatgtgtctatctttccctttctctctttctgtctctctctctctctctctctctgtgtgtgtgtgtgtgtgtgtattttttccttcaagacttcatggggagagtgtgagagatgcagacctcttatttgttctctgtctttcatcatttttagaaatgagagtcaatagctcttgtttcaattatctccaactgtaaagactaggcatttaagcatatttgaaccatttctcatcgttactaaccaagtatttcatagtgaattcacatataccatatttgactttagaataaagaactccgggttggcaagatttcgtacaccacatgtgtactaataacaataaacctaatttattatttatactctgaaccccttaaaatggtagttttagaaaattttccgttgtactagatgcaatatgctatatttttcaaacattatagagtaatccttatagcaaggaaccagtggtttaaaaacgctttttaagagtttgtggctgatgccaaaacttaggggtcaatacctgaagtttcttcagtcgcttgagttccctaattctgcctttcttgcttttcctcttcctactgccttccctttcagtactttcacttgttaccagaggataaagcagatatggagcctcatggcaaatgcgtgactaccagatctatgactcatctgtggggacaatattcctaaaaaagagtctagaattgatgcacagagagcagagagtacctggcttcagctaaaatggtgacaacatgtattgtagaagggtctagttatgtgctgagcttttgcgctcacagctctagaaagctggaggatggtgagggctttttcagacttgggaaggaatgtatgtgcatgagtagcacctttgttttcatgtaatttggagtaaggtacacctgctggtcttaaattgttagaggttaagactccaggaacaggcaattcaccagtgatttaaattcaaagtgataagatggcccttccctgagtattttccacattttgaattgccatagtatcaatatgctaaaataattaaattggaggctattagatggaggtgtctttaacaacctaggttcctactttaggaaacagaaacctaactcttaatttaaaagaaaatgaaaattaagttcatgtaatcacagggacccaagtagacattagttatattgtcttgaactttctactgggataatccaaatagggcaactgatcaaactttaaccaagcaaatgattttttttgccttgcttcagtattcaccctataaaagccttcccctaggactcctttggtggagcaccaaacccaattcatgaattgctgtctgttcaaataaatttttaaattttaatgtgtcagtttatcttttaacagatgcatgcacattttatatcataacatctacctacatgcaacttttctgtttcatatttagggtgagaaatggctgagagtcaggcttctagagtctagtctcaccagaatattaattagctcaccacaattaattaattgtggtttaaggaaaggtactacagactcattcgtcatgacctttgagagaatttactgcttaaaaggtctttaattccatgcattcctggtccttagatatatctatatattataatcttcatgaggccatggcttctatatctgacatgtctagaagagttctgcttataatttaagcactcaagaaattaaattcattctaaggaaataaagtataaaggaatacacttctgccataaattaaggactatcttttattatttccttgttctcagtgatttactattagtgtgtggaatggggttaactctgaagctgtttactgtgagaccagccttctttagacttcaaattgaaagattatcataactggatattttgagctttgtgagctgtatgtctagacagataaagtacagagaatagtagtagaattgtaatgaatttgtgtaatttcctactaggcaataaagaacctacccccatcaaagaaagcattcctagaattaagacaattagttatagctcataatttatctagtatgatttaccactcacctaagaatgaccccactttattttacttaattggagacgatgtaaatgaagaatcattgtctggtaagatgtcaagtagaactggttaggggttttcatttatagagagaataaatgccacctgttttggtgggagttgtttttcatttttttttttttttaagcatgagttcctgaacttcgtcagttgaaaccataactcccacagttacagttaagtgtgtgagaatattattaaaggtacattttcagtagaggaagtctccagaatgtgttactactaatcttcttgtgaagattgtggtattaatcttcttgtgccattagtggtattcacacgataaaatgttaatgtttttcttctaatttaagtgcatttctgaacatacctcaaagccaagccatgctgggttgaaataaggaatgtgattggatttgattttaatagaacataacattgatggaactgagattgacctcattatgattctcgattccataagagatctttgctttaggcattaaagagcatatggtaataagtttttttatgctttgctgttaaagatttagtgggaagattatctggaatactttttatcaaatatcttatttaaataagaggaattctttaaagcattagcattaaaaattcacagagcctacaaaattaaagatagaaaaatctattaggttatcttccgtctcccagaaaaggattacttcagaggaaagaagctatgaaaatgaaaataaaaactgaaacaattatatcaatattacagatgagtgaagaaaggatgtattggattgtttagagaaatcaaacgaaataattttttaacctttaagaaatcttttacctatttttatatattaagtttatatgtctaaagcctttacagttaaatcatgttatttttgttgtttctaaacctaagtaattttgaaacctttttattacaaataagcagctaatattcaaatctgaatattcgcaaaacaaattatgtgcttgcagtactttaacatgttttgccttttggttttgaattctcaatacaaaattctgtttaatcacatttatgtgatattttcattttgttatataatatgcacacagattaaaataattttaaagatgtgtgtgttagaaagcaattatcagtgtatttacagattttttctgatatttttcttttcaagaatcaatgagctacttttgaatgtgaaatagacggactaggaaacaaactttacatttgtcagcatatgatatcactgatactttcaatttgaatgatctttttttgatgattcagtaccttttagaaaaatgttcagtgttttagatacctaaccctgaccctgttcttctccagcaagacatatgtggctttgtttcttgtggcgggaggagatcttatctagccacagtgtggctgggatggtctgctcctggggatgaggtatgactggtccaatctggatacttgagtggaatgctgccacccgcagtcagaatctatagccccaacaaagtgtcaccagtattgacgttttatgttctctagctgttatacaccccttcttcaatttcaagattgatcctacagattgaggtagaattgatgctaagggtcgagtagttttaaccctggagagagaaaagatgagggggatgggtaaaatagatggctctgaaagttattttaaaaatgatattaattttcatacctgaaaggtattaacttattatgtgccagtaaatgtgcaggtcctaataaattataaccaaccaagcaagaaagccctatagaatttgtcctatttgttgccccaaagttgtcctcactccctactgtctgccagttacactggcctcctttctgtttttcatcttcatagaccccttctgaaacaggcccattgcactttcttgtctctctctctagaaggcttttgctcggaagttttttttaatccttcattgtctcaacacaaatatttcctcctcagtggtctatgtctttcattttagttctgttgtattttgctgctgtatccctagtgcctagaatactgcctgctatatataataatatatatatattgatcaaatgaaagataaagtgatatcatttagtcttcataataacatgaggtatattttgttattaacagttcataatgggaaaacggagtcttatggagggagatttagtgacttttctaaatttaacctactagggtgaggcagatatagaattcaaattctggtctatatatggaagttcatctttaaacactgaactatactgtctatactgctttggtagtgtgaattttgtcatctgtttcaagtagcttggttcacatgccaataaactcatattattgtttgttttcactatgtgctgcacagcataaacatattatgcttataatttgaagtagatccctttccctacattttatgtgagagcagaaccacatttgcacattcttcttaaagcctcctaaaagggattgttgaattgtgtcttttaaaagtaatgctgaaatcaatgtcatatccacacttaaacaaggaaataattctcataaataatacaaagaaatggaaacatttttgagtagtaaaaactttcttctgctctcaaaaatgtaaaatttcttacgatatttggatttcatgctcaactccaaatgggaattgccatcatgatgttataatccatttcactcaatgaaaagtttaggtagaagaatataagattactaaggaataactggagactttactgataagttattataagttaatttgtttttggacagagttccaggttttctttgtgaccatagttgtacacacttcttgttttctagaccactggcacatctgcacaacaggtgatatgtaatttcatcaaataggttttatcactttccttataatgagatatattttttgtgcctctccttgatatacttactctgaagcatttctggctgaatacctcttttgttattttatggatgagaggagaaaaaatacaagattttttccatcaatttttccaacttatacgtgttttgcttcaacaatttatgcagtgagaggtggaaaacctgagcagttgctagggtgtgcgctttctgtagatcgatccacacaggacagaatagagtgcattctgaagaggtaggaattagaaagtgatgccaaatcagcaaaacaaaacgaagcaaaaagcctgaagcaaattaatcatgacaaaacctgcacaaaatctggagagcaagttgctgtaccttgaaccttcaataaacaaattcactttgaattttagtaggataaaagatttaaatgcaaactgattcaagatgtaaaacaaagtcactcaaataggcaagacagactagcctacataaggagatgttgagtttgagaaaaattaatagtaacatttgaatactttaagtattttacagtttagagacaatttactaaaacattattattgtaagatcagaatagtaacatatttttctttagaatacaactttttctgcctttatttaaataaatatgattctactaaaatggaatattcatgtttggtaagatcataatattttagacttaattcttaacccaggaactttaacaattttctatgcaaaactcttatggcaatgaacaagataaattctattgtaaaacaactaattcttgttttttacaatcatgtatttcagcttgttagaatattttctattatcagaaccggctttgttagtatcatgcactggtaaccatctatattgatcacatggtaaacaacattagaagtggttatctgtttgtctttacatatcttggtggaaataccaactgctaaattatgaatggcatactctagaatttaaaagcatgtcgttttgatatcttctcaaagctagtaacaggttattgtaattggaaagtctcttttgaatgagacatagatgcagaacaacactagctcattataattacatgcaaagggaaaaaggtaacatgaggtagtctttgctgagattcatattttatgtagttgggcggataggtcttaatgatatatgcaaactctaagaaagtatctttggtatttttaaagacttaggcagaaaactggatttgggaagcattgttggaggtttcattgcttctttcattaagtggctgggacaatgaagagagaaagtttgggaaataaatgtttggctacagagatggcattcattaatgacatgaagaatttttagccttgctgaagacacaagtggtctctaggtacagaaaaaacaaaacaaaaaggcaagaagacagacttttgtcactcacaataactctgtaatagttatatatatatataactattgtgtgtgtatatatatatataactattgtgtatatatatatatatacatacacacacacaatggggctgcatcagaaggtaaaatttcttagtttgggggaatattgatatcagtgaacaacttcttggtgagagaactgtaaagagagttcaaagtgtaagtgataataccagatgatttttaaatttccttataacttgagattttacaattttatttatttttctatacttcaaaaaatttgtacaaggttataaaatgtcctaggttataagatataaatataaatttttctcatttaaaaagaaattgtctctattctaatccaatacacagactgtaaaatgtatagaaatttaaaaatatatatatttaatatactgcatcttctccaggttgagattttttaaaacgactatttcatgtgaccccacattagagaattgtgatactgcaggttagctctattagtcaacacttatgggaaaaaaagtagaaagaaaaatctagaacaataagttggggatggagaggggactggatctccatgaagagaggaaagaccaataatgagggtatatttttagatcctgaaaaggcaactatgtgtgtcttagaccaatgtctggatttcatgatgccaaacaaattcttttatgacaattgtaatagtacttcaggttcaatccataattcatcaaacagtttaagccaatctattctgtatttaaccatgtgagactatatactgaaaatctgtagaaaatggaaattatatattataaagttttctgagatatattctataaaagtgaaggatttttgttacatgttatggcgctgggttatgaggttcctaaaatataagtaataggagtcatctgaatcactgtattctaatttaattataaacagttaaataaaaccccaagtaaaatctaaacatccataatttatattttaattttcatttttgaatcatttcagtgaaaaacaagttattacatgggacatattgcagtttgaaacctcacttcatgacgactgaaacaaaaacctctgacctaatatgagatggcatattttttattgcaatcaggatgtaataactaccagcatgaatacttagaactgttctcctccttctgttttcagcattgggtttatctacatttttaatgaattggatagcttattaggtcgtatgacatctgaggtcctttccagcctgagattctaatattctattttatgtgtcttttcttgagaatcattgtttttttctctagtaagatttactgtttcctgtgctaataattcaataatttagaaaatagttgtcaaaagattgagaaattatgtgaaatccttaaaattgggccagttactttgccaagcatagccaataatcttggaagtgcacattatcagttagttttgattacagctgaagatgttgggagaataaatgggactggaacaacatattcatcactactccaagggatcctattataaatatatctcctgaaacccaagtgactgttgcaaagaggggaaactctcttattcaatataagcagcaccagtagttagctggtaaatggacacattggtaacagtatagaatccaaaagtcattaatacatataaccttaagcatttattttaactgagtatatataaatatactttagataacctatcttttgattaatagtcaggactttttctttgataattggttttctcttggacatttttttgttgtatttttagtataaatgacatccattatgtgtttctcccatctctagtttcatgttcttggaaaataagtgagaatataaacatacttgcaaagttatctgtgaaaaatccttctaggtttttatgcttttttttaatacctaattcaacaaggctttttcaactttccaccatgagtctgattctcaaaactttcaactactcgtttttaatttaacactcaagtcttactgatttttataatatttaatcaaatttatatcattataattaaatgtacaaaggacagttgagtttgagagcaaacacaactgactaggcatacaacccaattgagtgaagaagctcatggtgaaaatgtagtcactagtgtgagtgttcaacatgctgtggacattagtcatatttaacaaaggaaatgctaagtaaagattagttcagtgtatcagataaatgtaggttagttaagagagccttcagtgttttaatttctttgattataaactccttgaatgaagtgactgtttcttatgcatcttcatatttcctgtttacctagcatagtacctagacataacatacataagcatttgttttttcatttgagttatagcattgacaacatgtaattgtcctaatgagatgctgtttcctctgaggatatgagtggtggtagtattttactattattttctctatgctcagcatgtaaataaagcaatgttaacatcctgtttgtatttcattttgattgccatttggtagcttgagttggagaaaaatttatgcacagcgtttaagaggaccaatttatactgaaagctttggaattatcttagagccaccgtgaagcccctacaaattgcaatttcagtcatagaaatgctagaaatcaaatgaatagagtaacatttggtatgtaataccaaaacatgtttgtattactctcttgaacacaagcagcaaaaagagttaaccattagtggactataagatttttactatatgtgtgctttctgtaaacttgtcattgcgttttatgaatgtggtacatgttcatagtttttaaagtcaaagagtaatacaagacttattatcatttttgaaaagctatcttcttacccaccactcccattcctctctccctatttcctagactgaacctaatttcaactctttcatagttgtttcttctcatatgtagtttcatagtttgtgccagtaatgaccacaaggcagttttctgatatttcagtttcaattatggtctaccatcttcctacaagaaatgatgagtgcttttccttacttcatgtcttcctccacaccttgttatatacgtttttcctctatcccatccttccaaatcttgtggcacatatttttattaaattcacattcaatagtttgtaactatataatcaccgatcaaagataaaccattcagtgtaccatgattaaatttcttttctgacttttctgtggagccaacaatttttttcatttgtttattttcctatgtaaacatcactaactcagtgcaaactttctgaacttatagattcatctcaacagggtcaaattcgtgaaggaatctagcagtcctattttctctttaaagacagctccttagggcctatcagacactactccagtgaagttggtttccctcacgtctgaatcacagttgttacttaagatttctcttggccgggcgcggtagctcacgcctataatcccagtgctttgggaggctgaggtgggcagatcacgaggtcaggagatcaagaccatcttggctaacatggtgaaaccctgtctctactaaaaatacaaaaaattagccaggcgtggtggtgggcacttgtagtcccagctacttgggaggctgaggcaggagaatggcgtgaacccgggaggtggagcttgcagcgagccaagatcgcgccactgcactccagcctgggcgacagagcgagactccgtctcaaaaaaaaaaaaaaaaaaaaaaaagatttctcttcatcatcacagtgggaattgcctctgcctctttcatattgttttatgaatctcatgtctgttacttgagaaagagtgattgaagggcaaattccttgaaatcttgactatctcaaaaactcttttttataccctcacatgtgattgatcatatagcttgttatagaattctaggttgaaaaaaaataaccccctgaaattttgaaagctataatactccattctattcttgtcttccttccagtttgagaagtctgataacatttggattctcagtctattgtatctggttattttctaagggttttacaattttttatttctacctggtgttctgaaatttcataatgttgtgtcttggtgtgggccttttttcatttatttgtgctatgtgtttggatgactcttttaatccagaagtgtatgcccttcagtactggaaaattgtagtctgatttcttgggtcatttctgaccctgctttctctcttttatctttctgaaaacttcactgatcaatgttgattctcctagattgattctctactatatgtgtatttttagtctcttattctccatccatttgtttaatttttttactctgagagatttattcaacctttatattggattatttttaaacaatcattttaaatgtctaaatgttctttcctgttttctaaaagattttgtattttctgatgaaattacataggtataatatctacagtatcttcttttatctctgaaagtacacatacacaaataccacctccccccaccacaaacacacttatttaggttttctatttttatcatttttttttcactgtttattttagtctttctctcatagtagaggcatttctcaaatgtaatccttgactgtccacttacatttgaaaatgaagtacacaaaaggctgatgggaagttgtgtgtgtgtgtgtgtgtgtgtgtgtgtgtgtgtgagagagagagagagagagagaagagagtcatctttgggtaaatgaacagggactagctatttttttttttcagggagtacatgcaaatgtcagtcagaatctgtaggttttttttcttgggccacttattttccccagaaaagaattctccattctcattcaatatggagagtatatttaacccctgtttttagtgtagtacttcatcctcacctttagctagggtccttaaacctttccagaaagcaaactttatgtagggagagtagttcagctgactgagtgagccaggggttctgatagtctgtattctcttatatggactttaaaacaaaaatactcctgctctgtcccacccttcatcctagacttcaggggtccctgaaaaataatttctaagcctggcagggatatggcatatgaatctggcttccatcctcctggtaaacccactttacttacctaagcagtgaagtttcttggttttgctaactcagtaactccacttccatctgctatcctctttcaaaagtttatcccttatcttctgatatttcatttccttttctctgtacactgctgtgtttgtactggatttccatattttcattttagtaagattttgggaaggaatggaataaagattaggaaattttcttctctcactagtaagagaaaactgctcaatatttttttaaatgcaaaatgtgctgtatagtcaactactattgttttatcagttctgacctttggttaacagtattttaactttggatgttactttctcaaacttcttaaaccattacaataatttatcatttacttttataacctgaaaaataatgtctgagctctcataaaatgaaaatagttaatttgcatgctattgcttttgaatgttgtacttcagattatgttcttaaatttgtcttatctattctataatgtgatgttttaatgcacatctgattccctatcatcttaacaagtatttgcatttactgctttgttttctttatttgatttaccctataaaatagtccctttagcacagattagaagtagtttattacttattgtctgagtcaatgagatttcatacatgtaaatattatattctagttatattgtctaaatactctgcatcacatacttgaatcattctaataacaataatgtcaattgaaatatattactttcttttgcagataaaaagtattaagggtatcttctttttaaataatgtatgaattataaatctatgcttataactttatgatgccttcaagtaggcaacattgtcagtggaagaactatagtgtacatttgtttttatgctgctaataaaattaaactgtgttaggttaagaatacatttttaaaatgatagttaaagttaaataggaagccactaagttgtgtttgtgttcaagtttaaacagaaagcaatatttacccagcattctttgaaacaaccattttggatgaaatttttattcaacctggcaaataaatgatgacattcatgttcttaagtagaataaaatgctggaaaaatgaacagctccaccttatgaccagttttgctatagtttttaaccagtcagattttggcttaagccaagcttaattgatgatttaattattgcttggtttaagcagaaagtttagtgtatattgtagaagatgtgtaaacaaagaattttcattacttttcctcaattgagctagctcaacacagaaattacttggggaatcttgaccttagtggcaaacagtaaacaactaaaggcagtgtggtaggctaaataatgcctccctaaatccatattcaaattccctgactgtgtgaagatgttaccttacatgacaaaggggactttgcagatgtcattaaaaaatctggagatgggaagattatcctggactatccaggtgggcccagtgagatgattatagatgtccttaaaagggttggcagagggagattagactacagaagaggagaaagtggtgtgatgttggaagcaaacagatttggagatgctgtgctgctggctttaaagctgaaggcagagtctatgagccaaggagtgcaaggaatgcaattctagaggctggaaaaggaaaggaaaaggattcttctctagagttccagagggagagtggcccttctaacagtttgtgtttagctcagtgaaactaatttcagatgtctgccttccagaaatgtaagggaataaatttgtttaagtgtaacttgttagagcagcaatagaatagtaatacagtcaatagaaaactattacagtatgagaaaactatccccaaatcacacaaaaaagtgcaagaccaaaaaatagaaaaacgaagccacaaagccatatttcccttcagccatagcctaaattcatgctcaaagaagattcttacagaatatttgcaaatatcctagttaccaccatttttgcagaaaggtttttgagggggttttccattaggtggaatatttagtgaagtggtttgtaagtaaaagttatcaaaggtaaccaagcttgaaaacttttgttataatccctcctggaatttttctttttataccttgttctctaggagaaataaagtgaattctataaacattgttattataaagcaagtttaggctaatttgtttcctgacttttgtagagatagctatggcacttacttttatcctacacctaatcatggagtaaaatgaaaagcaaatgtattacttttgtgaagtttattgggggagaggttgaattgaaaaatactttatgaagctaagacttcaaaaatttgctatttataaattgcatgtagtatgtgtatatcaaagtaaggacagtagttattagttcttttgaaatattacataaatttctgtatgaattatctctttgtatataacaaagcacctcaacccttactggcataaaatagcaactgtttatttgctcatgattctgcagtctgggctggggctcagccagcagattcttttgctggtcttgctgttgatcctgcctgagttcattcacataactgtagacatttgacagctcagctggggctgggtaataccaaatgacctcactgacaggcctggcagttgatgctggctgttggctgtggtgcccgagttctcccctgcattccctctcatttttcagtaggctggagtatgttttttcaattgataatgggagcattccacaaggacaaaacaaaagctgcatgtctcttaaggcttaccttgagaagtcacacaatggcaattctatagcattctctccatgaaagcaaattataaggccagtccattttcaatggacagagaaatacagtctacttctcaatgggcagcgtggtaaagtcacattgcaaaggacgtggatatgaggtgctgtggttcattaggagatcctattggattcacccaccccacatctctaatgcacgttatcccatgtttttttttgttttgtttttgtttttgtttttttgtttgttttttttttttttttgagatggagtctcggtctgttgcccaggctggggtgcggtggcatgatcttggctcactgcaacctccacctccctggctgaagcgattctcctgcctcagactcctgagtagctaggatcacaggcataccccaccacacccaactaatttttgtatttctagtagagatggggtttcacaatgttggccaggctagtctggaactcctgacctcaggtgatccacccgcctcggcctctggaagtgctgggattacaggcctgagccaccatgtccagcccattatcccctggttttatctttatccagacaacatgggtgtctctatttttaatttttaattttatggtgtttcgttttgttctgttttttgagatgaggtctcactctgtcacccaggttggagtgcagtggcacgatcttggctcactgcaacctccgcctctcgggctcaagtgatcctcccaccttagcctctgggagtagctgggaccacaggtgtgcacaaccatgcctggctatttatttatttgtttattggtagagatgaggtttcaccatgttgcccaggctgttctcaaactcctgtgctcaagcagtccacccacctcagcctccaaagtgctggggttacaggactgagccaccacgccccggcttatcggcttttgttttattttgttttaatcggtgatgagtaacggtggggaatagtatgccagtatgcatgggaggaaggattgtagaaatctggctggggaaatcacattacttaactatttgagggcgtgtgtagtggacatttatttcttcttgttactgtttttttcaccactttctttcaaatatgctgttttgaatatgcaaaatataaagtactgttctgtttgaatgtagaaagtactgtgagattgttcaaattatttgatagaaatatattgaaaactgtcatgatttgatctctgattccatgtttgtgaagggaaagtggttagctctacagttgggtgaaattggatgatacaactactaagacatttccttacggcagtgattctcaacctggctgcaccttagatcacttggagagcttataaaagtgtcgatgcttaagtcctatcccagcacaattacatcacagtttataagtgtctgtattttaaaaaaaaactttacggaagagtctaatacatagccaggatttaggaccactcagtgctttaacggttagagatttggaggaatggtttgaaataataaggtttgtgcatatgatatagtaaggttgggtttgtacaggggcctccagccagagctgatatactgacaatgcctcaatgtggaaaaactgtttaccttcttgtttgattggataggagaaaaatgtcctaattttctgatggggctcctaatttttaaacatacttgtagagagcaaaatagcaccagtggcaacacattattttgaaccaagtaactaatactccaatggagggatagctagatataaaataatgctataagaattgtcatgtatcaaatgcatttttatattatctatttaaaagaaaaatatttataactagagctttgtaattttcactttctttcaccagtggggttatttttaactcacttatagctggagttgaaaggatattttttagaagtcagtgagacttttcaaaggaacaagaggctatggtatcctctaatactcattcttaaatatattattctcaggaaatggaaaaacacatctgattgtatgcaaaccatttgtccagttgcactgttttatataggagacaaaactgttaatgactggagttgggggatttaccaggctctagagtaatctgggatggatagaaatgtagcttctatattgatgctactgcaatgtggcttgttatagaaaagctcctttctcactgatattttccaaagtgaacaagtgtttgaatcagagcttctcacaaaagacagaaataatggaactcttcatttgttgacccgcaaaagtggctaattaaaaacagtgtcttgatttctccacactgtcatcccaaatcaagacctgactgtgagtggggagagtaatctgattctgtacctgaagtgaaatattaatgtcccagactgggtgaagccatctagtagataatatttctttcttttttaaaaaagtaattactggtagagtaaagaatatactcaggcatacaaaaatttaagatgacatgaaatctttggagttacagttataagagttgatttattctagagaatccagaaaaatggttcaataaaaccatctctgcgtggtgagactgtgcatttcaacccaagcctttaagagggaagaatcggtattgagattaaaaaaaaaaaaaatccatctaaggaaaacgctctacgtaaaggctcaggatttaaaaaataaaattaaataaaattacccttgctttgatcctgaggctaaatctaaagtaatctgcaacaacaggccttttttgtttaaggattcctgtcctttgaggtgaggtatgtgctgtgtttaataaagattatgtgactgattacttttcacgtactgacagctccctgtggtgtcttttatgtggatgggggagattatattaaagctctgtctttctgcgtagtggccacctgctcttaaaaaaggttgtagcaaacttccttggaaataatgttaggagtccaaagcatgatacagaaactgatgggactgatctgcatctagactgagcagtacagtgaatagcaatgaagacaggaggattgagccccaggcaagccactatatctgctcagttgttatatttatcaaggattacactaaaacctaattctgattatgagcaaagtgctgtatcctgaagtaaagatggtgagtaaacaagaacaagggataaccttctttttctgtgatgtgtatgcatttgatgagctttatgaatgtatttccctaattgatttcaaggaagaattttctagggttaatgtatgaaaagcaatttttacatgaagccttagtgtaaagtaaagtcaatgattagtagagatcctcaaagcaattgtactacatagaaatcaatataaatactgtattaaagcatttatttcacttgtgaatctgcatgtgtgtggctggaaataactgcagtattacaataagctaggctgaagtttgcatttaaaatagcaaaaaggcaaatgtcttctatgtcactgtcaactatagttataaattgagatctgataaaacatcaaaaaactttgtaagctttaaaatatttctgtagggtaatatgacatcccatggtctgtgtaaaagttagcatgctctttctcttgatattttccccttaactttctccttcaattggagtacttggttttcagtcctccagtcattactctgtctctgcatgctgtccttgtgctgtcctgactatattttttggttttaaaatctaggatcttcaagtctatttacttcaaatttaccatggttaaaattgagctaatttcctaccttctttaaatctctttatgatttctccttacctctgagtaaatggtgtcataaccaccacgttcagggggctggaaacccatgagtcctcgtgcattcttcctcaacatccaatcctcaaattctattggtgttcattgttttttgttgttgttgttttttgtttgtttgtttgtttttatcttcactgccacaagtctgattttatactctcatttttcacatgaaaatggcaacagctttctaactagcctctgctgtctcaccacttaccgagaaaacatccaaattccctggcactcacgcatggcctttgacaacatggtccctgcaagtccgatctttcctcagttttctggatctctcaccaggtccccccttttacctgttctctggtgataatgaacttccaggagttcctggatcttccatacttcttacttgctcacccttctttctctttctctctttctctttggaatgccctgttttaattgcccacttggaaagttccttttcatctgttgtatcactagttccactcctctaccccacactatgcattaatgaaggtcccttggaaggtccctattatgtggcccatgccctttgagcaaatgctaccttgatgtaaaactttccacaaagaagttaatgttggtaaagtgccactcggaaattaaagcacagtgctttgaagagttaaatccaatgaccttgtaaagaactggaaattgttaacaatggtgctgtctgtcaaggctggcatactagagaggctccgtgtggacaccaagatctgagctcgtgaggtaggtgggagggggaggcatggtgattatggtaaataggggggcccagacaagatgagtctttctgtctcaggaaggaaaaaaagatcactgaagagtaaagctagggtacagaatggcaacaccaagtttaagtgttgatgcaagggttgatggcaatgagatgaagctgagcagggaaccaggtagaaatggaactgaacaggtgcagggaggcaatggagcaaagaggtttctgggccactctcaggatcagtcatgaaatgtccttagcttctcatttttgttggaggatatgtggaggcatagagcttggtcacattgagctgacgcaagtcactgattcctgcaacctctagtgatgcatttccaaactcaggttaaaatgaaggtcaagaactcctgttttgccatttctaaattattgggattaggctatgagcttatttcgaggtatttttcagttctgctatgctatgactctgattttgtttttatttggtaatcttatatggacaataattgcattttgcaaatttaaaagtatcatgccaacatggtttgtctgttacttagctttcatttttcttttaatgttggaaaattgtgatacaaatttatagatcctaaattaacaaattactcaagactttagaatttcttaaaatgttatggtatgctttttttttgaaagctctacattttataaaaccaaatttgtcatacgaagttttaggtatcaagaaagaattctgtggatttttgtgttgtcagggtatcttagattgtaattttatgtattttccttttggtacctcataaaaactagaagggctttcttgaactgcatactttgtcaatacaatttgatgatggagaaagacatttaagtccagaacgattggtgtaaagtacactgggtgagactgtatagttgaattttccagatgatcgaaaattgacagtaaagaaatatatacaaaatagattttgaaagaattgttgaatgtttacctgtcgctacatattatcttggatacagtacagataatccgaatggaaaattgcactgaaaatgtcttcccctgagttatatttgctggttcttacataaaatgttatttatacaacagattttattgtatcttctcttgctttactcctttatcaccttctagctaactgtcctgacttcagacctctgttagatctgccagatgtgctctcctggcccatgaaatcaagcgtgggtgagacctggtgcagaacgggaaggcgacccatacttggtttcagaggctgtgagaataactgcaatttagagggaataccatttatgtttatgcaggacttccagagaaaaaacaaaatttattatagacataaagaataagagatgaaattcatgattatattgcatttctgttccaatgggattaaaaaaaaaaaaacacgtattctaagtaagttgaaccaggttgacagctaatgatttgatgtctctgttaatgattttaaaacattgtacaaatccaaaactgtttactccttcaaggtatacctccttttctcccacttctccagctattgtggtccatttgcccttgctctgggctagttccttggtaactaacagaaatggatggacagagatgccatgacaggagtatggattttgctgggtcctcatttatgctggggcatctatcaactctttttccaacatatttttgtttcccacacagccccactcacagatgcttgcctatagggccaaaaatctctagttagcaatctgccagagtcctgcttttttgtgtaggagattggagttctttcaaataacccatctggtaagatgtagagaagtagagaaactgaggtaaataaaatgtatattgttaagtactttattgcatactttgtacctttgctgataattaatttatagactatatctgttgagctggtgttggttaaggttgtatttgcttgtttgtttgttctatactctttaaaaacttttgtgggtgggtagggagggtataatggtgttgatgtatgttgtcatcccttaggccagaggaaccatttcacaattactttttattttctcaacaagaattctgaaggcctgtatctttggcacagaaaattaagctataaaggcaagttctgccaagtatatattacatatctcctggccatggattttggtaggctgtgagaaaaatatgaaagtcatttccaaagatttattttgtatttccttaattgactttcatatttgtaatacattttctatttataaatggtatttctttgttccacttaaggtaccttaatttataaacacacaaaattaatcaaggacatttccccattttgttaggttctgagaagaataaaccaaattcttcgccaaggcttttccttttttggaaaatgcattggataaacatggttttctttgaattatctcaatgaaagagcttctccctggacattctaaagaagtgctgtctggtagatttttctgtgttgacagaaatgacctacaatctgcactaatttgacagacattagccacaaggcacttgaaaaatggccaatgaactaaatttttaaatttatatagcagcgtgtgatcagtggctactatattgtagagcatagttctagagtactttagttatttagataattttttatagattacaagtttaccaaattcatctttatcaattctcttatgaatttgctaggttttggttagtagcttaagtttatgtattttagagcagttttaatacatcaccatgtgttttgacttagtacttttaggctgctactaaaccaaacacaataccataaattggatagcttatataatttttttctcacaactctggaggctgggatttctaagaacaaggcaccagcagattcattgttcaatgagggcctgtttcatggttcctagataatatcttctcactttgtccttacgtgatagagagggcaagcaactccttcaggcctcttttatagtggcactaattccattcttgaggtgtctgtgcccgtgacttaatcacctcccaaaggcctcccctcctaatgccatcaacttggaggttaggatttcaatatacaaattttgggggcaacacaaacattcaaaccatagcattcttatacaataaactactcacaaaatagagagttaactaaaacaattctccaagttttaaacaatttatatggttgccactttattttctatgaaaacaaattaaatttctgctgaaagctaaaagctggccaattaccaagtgatcccacagttattgagtgttactacttggacagcattaaataaaccattctttaagttacagaaaagatttgaggtgattcctctcttcagccatcctacagtcttgatagaaaggcaaaactggcagttatgaaataattaaaaataaatcagtgctaaactctattatgtaaaataggagtatagatgagggagagatcagtgtggatcatagtagccaatctctgcactttaaagttaaaaggacccttagaaatcattcatttggagttttagaaatcatgaaattgtattttatcaggtttacacactcaagatttcacagccagctaatgacatgtccagtgcttgaataaaggtctcttaaccctcaatttcgtgatcactttttactagttagccttatacctcctcctggaggagtttgtccttaacaattcattaaaagatagcttggggtcagcaattatagaccgagttctattgcaaatatcagtttcatctagcagagtgttccccaaattttcgttgtttactcaacacattcataatgtttttttcatatccttctaccatttgtactattatttatcctttttttatttgaaattcattaaaaggaaaatgaaaggccagaattatttgtcataagtaaaagataactaggaagtaaacacctgaaaaataaaagctaagctataaattcccagccaggcactttgtctgcctaagccagaggcctgttctctttcttataaaggagattagtgagtaatggaaaaacattagatgccatagtcctacattactataaagagcaatcctttccttcacctccagtttcaaaattgtgagatttacaaggtccaactgtggaagctaatatctcctattgacctccctgtggctgttttgtgactgccttaggaagaaattagccatggacctgcagttctgcatgagctcatgtgcatgtctgcatgaatttgtgtgtctgtattggttggtggcgggggttagggaatggtggttactttttaaattatgcaataatggcgtatatttcctgattttctttcttcattaaaacaaagctcttttgaactggttgcttttgtcctttacaagggaaagtaattgtatagttaatcctatttgtttctaatgtaattaaatggaatttagatagattatctctccatatacaaacatgcaattcttatcatttataaagcaaaaaaataaaaacccttttattgtttttggtggagcagtcggggcacattagtaactctggcttatgtaagaatgacatgcatttttctcttaaagatgaagaatgctgtcaaaatatacttttaaaaattaagaaaagtaaatgattcctacaaatatcaagtgaggatatttcacagcttatttaacccattgatgagaaccctcagtatggtgactcagttttaaagagactttgaaaagcagatatttgtatagttagtttggaaaagtgtgatgaaatatgtttgctgagttagagaaaatgctcattaatgtcccacaggataataaaatcataacctttgaacatatattttcaaccagagaggaaatggtttgtatcactaccagacaaaaatatacaagttaaaagtacccagaacaactctgggtacttaccaatagtaaatggtaagtaaaacaatgatgtattttctggttcttgggaacccaggtaatttttccccttagggttttttggcaaagtctggtgacatttttggtcttggcacctggagggtgcgaccatcatccagcatacagtctaaggatgctgctaaacatcctataatataaaaatatcagttatttctgcctcctctcatacccccagaaaaaattatcccggccaaaatatcagtggttctcaagttgagagacactaccctagagacttaaatcacctttgtacaggcctgatagtgctccagtgtgacactgaaagggcttgctgccattcttttgtctgttctggataatttttcttactaatgccataagattttccatgcagtacgatgtttttgtattgtctgaatgtacccagaggaagcagacatagtgagctaggctagggctctgcttggttataacatttcttgttcctgtctcattctattgttgttttcttacatttgaatggaaaaaaaatctaaaaataaatggtgaagaaatgttaaaacatgcattatctgtcactgtgaccattttaatgaatgtcattccattttctacaggataacattattttcagttggctgtgtcctttcctgattgacactgtgattcttgaaaaataaaaattgatgcacaataatgtagtataggaaagaagtacatattagaaaagcatagactctccctgctcctgactaatttctttcagttagaaagttaaggaaaactgacatattctctctaagaaaatatggaattggaaacatcacacctcattcttttcaacccttcaataggttgaattgaaagtcagcaattaagagcagtcttttcttatacctccaatttagtgaaaaggtaaaaacagaaggaaaattcatatataacatactacgatattccaggaacaaccactataatttttgtgtatttgttcagacttttactaggaacagcctcattttcttttctatttaactgaatgttttttaatgtaacatatgcttcttggaataggcacaagcatactgagatgagggtgaagacttgcttctgtacccaagaaattcctatgtcagtacccagagttctaattgtagagaatatgcaatagtatatattaatttttcacttaatatcatactatcagaatttttttcatgttgccacattgttctcctaatcatttaatgctgggatttatatagatttaaaaacagctcaagtttcctgtaagaaatatgatgcaatttatagttgcatttctcatataagtaagcagtaggatcacactcatatacaggagtaaaattatcctccaaataatctgcacagggcctggtacttgctaggtgcttaaaaaatgttgattttcttttattcaagttctagcatttttatactggaaggaatcatgacattggcacattccttttttctctttttatcttttttaatagtaaaggaactgagaccttgttaattattattattattattattttttgagacggaatctcgttctgtcgcccaggctggagtgcagagaccttgttaatttaactggggcaatgtagaactctgtacttgaacttaaaatattaggttcaagtgctatctctgcctcttattgactgtatgataatagatgagccactttacttcttgaggcatttcagtatatattggagagagagttgcactaggtaaaatacgttgtttaagatttaaggaattttgttttttgcttcaagagctcatgctgataaaattgatataaatataatggtaatgtgaattagcacaaccactagggggaagaatatggagttcccccaaaaaactaaaaatagaactaccgtatgatccaacaatcccagttctcggtatatatatatatataaaaaagtatatcaaagagttatcttcttcccatatatattgcagcaccattcacaatagccaagacatggaattaacctaaatgtccatcaatggattgatggataaaggaaatatggtacatttacacaaaggagtattatttagccataaagatgaagtccttttatttatacagaacaggaagacagtatgtttagtgaaataaatcaggcacagaaagataaatattgtatattctcactcatgtgggagctaaaaaattttgaactcatggagatagtagagtggtggttacaagaggctaggaagggtagtagggaggaaaggtaaagtggggatagttaatgggtacaggtatacaattatgtagaatgaataaggtctagtattttgtagcacaatagggccactatagttaagcatatttattatatatttaaaaataactgaaagagtagaattggaatgttcctaacacacatacataataaatggttgtgatgaatactccaatttacttgattattgcacattatatgcctgtatcaaaacactacatgtatgccaaaaacatatacaactactatgtacccataatcattaattttttttaatttaaaaatctatgatctctttaaggacaaaagtcttccaaggcaaatattaatctactaaataagctcactgtatagagagcccagagtactgtaaaataatatgcattcatttggaaacaaaaactaatattataagagcacactatgtattaaggatgccttcaaacattttatgtgggtttttactttaatctttagttacactttcaggtagatgatatgcttctccgtttatttaaggaaacttcaaccgagtgaagttgccacatttttctaaataactcatctagtatatatttcattatgccaaagtctagaaaactgatgtgttcattcaaaaacattacttcaacctgtcagtagcagtcttttttttacctctttacagttttagaaaggccttttgggcatggttttgtgatccatgactatttaaaaatctcgtcagggaagtaggaaataattttcttcttatctcatatgaattgctcttgtagcaaagagactgtcaaaaatattctctccatcattcttcaggaaaatgttaagcattgagggcaagcaagcctcttaaactagagacccagaggtacagtagaaggtattccagagttgagatgagagttctatgctcctgtctttgcacatatactgacttgtgtgattcagctaatttccaggaagctcaactataaaagtgagggaggtgcaccagatgatctccaagatcttgtactctgtttgtactctactctctccttgtgtatcttccccacccactctgctgttctgtgcggggaagggagatctgtagctctgttgtattaaagtaaaaactttagaaaaatatagcagagtttaactgagcaaggtacagttcagtgtgggcaggcagcatttgtggataaaaaatggaggtgaagtacagaaacagcttgcttggttttgatttgcatttgtctcgcctcaccgtggtctgatcagttggccatctgtgattgactgaagcttggctactgggactgactgagatccagctagttattacaaaagtatactgctgtgttaggcttcaagttagtttcagtgctgttaggttgcattttattatgtgaagagtcaagtacagaggcattcacaggccaaatttagttgaagaatcttccccttttggtcagcctctcaattttgagagatttgaccaaaaccttggacatggattctactctctcttaccatcataaattgacttatttggtctcagtacggaatttccaagtgagttcaataattctttatgatcttgatgatctaatcaaagtgagactattcaaggattgctagatggctgcatacaaaaatttaatacttgagaggagaccacacatcatggggactattatataatgatcattaggataataataccaaaagacttaagtatactgcacaacagaagcccctacaaactgaactgatcaaaatcaagcacattgaagttcagctaatatagaaagttcagtagtatttgagtccaattgatcatagtcggtgttcaggatgtgatggtgattaaagaccacagtccactgtggaatggtctgatttaagaggaatacagttttgtcattaaccagttattttaagttatagtcacctggagacccactagaagatataaacattagaaaaccttggaaaagccaagcttgccactcaccacttaggatgtctacaaaccaactattagtggttcctataaacacattgtgtgttcttatctcttgagaaatttccttgattatttgatgtcagggttttaaaaaacagaggtttcagccaacttttaaattatgctttctgtagtagcaaaataaggggaaatatagatacagcattcagttttgttcaataccttacacaagcccccagcatgacaaaaaaggaaatctaaaactgcatgatgtttcattaagtgctttttgctgaacatgtatgtttttatccaccattcagagagtgacttctatcagtatgaacccctaggaggccttgttggccacaaagtccaagatttttttccagtttacagattagtttcaaattccgtactaccggtactccactactacccaagagtgagccctcagtaacctcattggagtctttcctcattggaaactagattatctttacaaacccaacaattgctccagttttttgctagaacataaaccttaactaaaaaaaaaaaaaaaattcatccacaaattgtggttccacagatttttctgcagagaaaaggaaaagattaggacagcagcaaatgaggaaaaaagaaaaagggtagtcctttcataatggcatagaaaagaagcctttgtctgtaatctttggaaagccattcatatctaggatgccatttgcttctgcagagaaacttccctggtcggctttccctaaaagtctccaatgagtgtgcagctctaagagtctggagggtcattttcagttgtaagatgtggacccaaggtttgagcccccaaagttttgctgcagtgagggcggtgaaaagaagttggtatgatccctttcaatggagttcaagggcagtctttctttgaggtcatttccagaagccccaatctctaggttctagatcttcaaagatttgattgttctcagttggtgtattataaaaagcttcctttacccggtgaaaatacacttttgcaaaatgcattaaagccttagagcatttagtcatatcagggtttaggagaccaagagatacatgaggtcccatcattaaggacagaggcctttcagtgactatttcatgagaggtcaacttatgttttcctctgagggtggatctgattgccatcaaggccaatattaatacctttagccaaggcaatctaatcaattcagttaactttgccagtttcagttttaagataccatttgttctttcaacctttctagaagactgagggtgaaagagatgatggtaattccattgtgttcataccaccttatttaattgctttataaattatccagtaaaatggatacctctactgctggagattttgccaggaatgccccataagggaaacacatttttgaatatccttttagctactcttatagtattggacttcctgcgttgacagttccaactagggaacataaactatttaaaaaaatacagggccgggtgcagtggctcacacctgtaatcccagcactttgggaggccgaggcaggcagatcacgaggtcaggagatcgagaccatgctggctaacacagtgaaaccccgtctctactaaaaatacaaaaaattagccgggcgtggtggcaggcgcctgtagtcccagctactcaggaggctgaggcaggagaatggtgtgaacccaagaggcagagcttgcagtgagccgagatcatgcctccagcctgggcgacagagtgagactccatctcaaaaaaaaaaaaaaaaaaaaaattcatatcccactgaagtagcaattaaatggaatctctataaatgttgaaatggcccattaggtagcagaaatgtgccccctgtggttttgattgtcttttcagaattatgagtttgacaaaccaaacattggttatgaattatttcagtaattttataacagtcaccacaccaatattttttcgtaatttgtatcattttgtctactccatgacgagttatagagggcagaacttttaacaatggaagctgtaaggactcagaaaagaccaggccgacatccagactttccataagtccatgctgaacattgaatttacatccttctaagtatcagttttgtttctccaattcaggtgcatagcactcttaagtaagttatcttaggtaatgttaaaataaaaatttagacaaaataaatttaataggtgtatttgagcaaagaacaatttatgaattgggtagtgctcagaatcaaaagagattcggagtactctgctacagccatgcgggtagtgagctttcttcacatggagggaaaacaagtaaaatatactagattagtttagagtagaaagacactagtcagaggttagacagtagttcctgattgataatgtctctagtttcattatagtctttacattgggctctggtttgcttataggaacctaaagcactggggctgtctcagtgtaatggtttctatattaggattttttttaaaaaagaaacaattcccccttttttcatcttctcatttatgagactgaccaaaatataggcataagcaccactccctgctgccatcgtggctgggttgtctttttctcagtgaggaacttgtaagtcatgacgtcaggcttgttaaagaaaggttccttttatttcatttttgtactctaattgcagtgagaccatctgatgtaccatcgatggctgtggacatgtgtttaagactcttgagagaatacagtgcacaaaggtgattgtaatgatgactgtcaggaggataatatcaagatgccaacatattctctttagttcctaatgaaccaaaccagctaaaataaaataagtcaaagaatcaaccagagagggattcaacttgttttagccatgtggcctgttaacttattgtaattgagtttctgcaatacaagaggtatttattcagatataacaggatatgttagttattgcactgacttctcctttttcagccaatagatggtccaatgcaatctgattatctaaaacaacttaagtaagataatttagagatttttcttgggcaaacatagccttagatgtagagtcagctatagtaacttatgtcaaagacaaatttctgatcatcatgttatttgcattcaccccaagccacagggaaagatacctaaaaaatgatgcccacctggtagggttgacatctgctgtaagtttctttttaatctatgatgtagttttagaggggtggatccgtgtttagcttctgattggttgtagtatgacaatgatactattaaaatacttagtgtgcattggcctttcattctctgtcaaggcatggggtggcccaagcatatggctgagagttaaataacctccacagataaagatgtaccacaggggtgcatataaggcttctccttgggtaattttatttgtggaggtattagttacaatggaggcactgatcatttctaaccaagagtctgatactgagttaccacatactggaagtctgcaaaaatacataggtgtatacaaattcttgcaaaagagtctattaaagtcctttttttgttgttgttttttaaccaggtagcctccatataatatagccaactaacttggacattggccatcctagtccatggttgggttagattaaaacaagtataagaataaatgggtctgctgaagtattttattaataataaaagtttgtacaccaaacttattggattttatatggagataatataatttaaaaataataaacattttctttctccttttcaaaaaaaaaaaaaagaataaatgggtctagaaattcagtcacaatgtgaactaaaggatctctaaaatcataggaggattttggcttagcatggcaaatccagcattttattaaatttcctccagaagctattgactgtgatattccaattatgacataattttgccacccacagatagaaaggaagaacaagaaataggagagaaaaaaataggggcttaataatagggagaggagattcttgatccatgatcttaggaaaatagtcttcattcaaggtaccatctacttctggggagagattttcatggtgagttttagtgaaacatcgtcagctggtgtacatttccaaaagtctgagttaagttgaaaaacatgaatttaagacttaaggccttgaagctttgttgcagtgtgagtggtgagaagaacataatatgctcccttccagtgaagctcaagggaagccttcccttggtatcatttccaaaagacccaatctctaggttgtaggtcatggaaaatctattgattgatcaatgggtcatggtaggctttcttttacctggtggaagtatactttgatatgtatcaaggccttgcaatactgaattataccagaggtttcaagatacttcaggtttaattgttaagggcataggtctttcacttactatttcataaggtgtcaacctgtgctttgattttcagtaggggtatatctaattgccattaaagctagtagtaatgctttttgccaaggaaatctaatagattctgttagccgattttagttttaggataccatttgtttattcaacctttgcagaagacttgggatgataaggataatgctagtgccattttgtacatcttaatttagttgtttaataatttgtccaataaaatgagtttctctatcactgaaaatctttccaggggcactccataagggaaatgcattctctagtaatttttttgcttcttttgtgtcattgaccttcctgcagggaaaggcctcaatctatcccaagaacaggcatacaattatatgaacatactgataactcattgagggtggcagctgaatgaagtgtacttggaggtgttccagtggtccagcaggtgattgtagtatagtgccagaaaccttaattgtttttccaggattatgaatctgacaaatcagacattggttataaactgtttttgcaacaatcacttcagcaatactttttcataatttgtaccattttgtctacactatggtgagttgtggagtatagagcctttaattgcagtgattttaaggactcagggaggaccaggcagttgtctgggccctcagtgagtccatatttagtactgcgtttgtattttttaggtgccaactttgcttttctaatttaggtgcaggacattgtttattaaatacattatcataggttatttgaatcaatcttatgaaattcatttaaatggcatatacaaacactttcagaaatagctaacttatcatggaaattcactagggcagtttctccatattcagggtcagttttatgagtgtgagcttcaattttaataatagtaacttgtgagggccacaaagcagcagaaagaagctcattcacttggggtcactttttttttattgaggtcctactagaagtgaggaatcttctttgtttccataatatgacaacattacggaccaccccaaaggtatgtctactatatgtataaatgttgactgttttgcccttagatgtttcacaggcctaaataaaaacatacaattctgctggttgggctgacttaaattggggaagagtttccttttctattagtttatattgagttgtcatagcacatactgcttggtattttccttctgaatttttggcttaagatccatcaaaaaaaagtattagaccagaactatataatggagcatcctataaatcagtgtgaggggtcaatagctatgatttcacatttacaccattgtggtcctcatcatcactagaaaaggatggtaaagtagcaggattaagtagtttgcagtattttagatggagactatgaagaggcagaagaataatttctcaagatgttagtctgcttgttgagaaatcttgagtttgaatgaaatttaatggtctttccacaacatgtggagcttgaaaataaagtttatgtcctaaaactagctctggtgaaacctctaccaatctgactgctgctgctactgcctttaatcaatagctgctgagtctaattgcaggctataataaatgatggatgggtctgtgttttcctccatgtttttagcaagaactcctaaagttggctgtcaggttcataaataagcaaggtgaaaggtttgatgtaatttgagagttctgagatgagaagttgttgtagggccagtttttattggctgaaggcctgctcatggttgttctcccaaggtaaagactctgggacaaagtattttgtaaattaataaaagggaggtgccaaacaaaaaaatttggacccaagacttacaatacctacaagtccaaagaaacgcttaattgtcttttagtcatggttcttaggaaactttcaagtgagagggagttccttctgcagtcagattatttcccaaataatgaacctttttttttctggaaaactgtagctttcccatagaagccttatgccctttgtaagctagttgttgtagtaagtaagttgaatctattcctggaccttctttagtaagagagcacagcagtagatcatctacttattcattaagagtagaattcctggctgggcacggtggctcatgcctgtaatcccagcatgatttgggaggccgaggtgggtggatcacgaggtcaggagatcgagatcaccctggctaacacagtgaaaccctgtctctactaaaagtacaaaacattagccgggcgtggtggcggccacctgtagtcccagctactcaggaggctgaggcaggagaatggcatgaacccaggaggaggagcttgcagtgagccaagatggtgccactgcactccagcctgggctacagagaaagactccgtctcaaaaagaaaaacaaaaaaacaacaacaagagtagaattcctagggaatttaagtttgccaaatcctgatgcaatatctgagaaaaataggatggcacttcagtaaacccctgtagcattacaatcaaaatacactgttgattttcccaagtaaagacacgtaagtactgactctatcaactggagtactaaagaaggctgagcaaagactcactactgtcaaacatttcgaatgtgtggttacattagacaaaaaaaatagagtttggaaccactggaaatcttggtattacaatcttatttactatatggaaatcttgaacaatttcatccattgagtttttaactggtaggagtggagtgttataagggctagtgcaagaaatcgtaagtctttatttaagtcctttatgatggtgagaactactaaatagctactggttttagtgggcattgaggcaatttaggtaggggcttacaataatctactaggatttttataagttcagcacctttaatttttcctgtttcagttgaagaagcccacaaatacttaggtacttcagaaaggtcagggtttatataggtttgagcttccatgttacctacatgttatgcctataggaaacagaaaaattcaggtttagaagagttaggaaatttgaagattctatctccttctgaagaaaattttatgtgactacttgatttcgagagcaagtcttgtcccagtagatgcattgaggcagtatcatgtagtaagaagatatgttcttctgaaaatggtccaagtgtcaattggacaggttcagacatagggacctattgcacttgatttcaaaccccaccacagaaacattctctttactttgagggattcattgatttatgaggatggggtttaaagtagataaattttctatcaataatgtacaatattcccccattaatcttaatcttagttttgttttgttcattcagaggtattatgcgaggcagtttaggggagaatttcttgaagccctatcagtgttggtgattattctgggagtcaaaccccagggggcttcctgaagtagagaaagtctcggcaaaaataaatgggtgtatcagatggctagtgtcagagtggacagtttctgttccagtggcatggctgtttacagtaaagacatctcaatccacaggtttcttaagtttgggacctcttgattttgatttacaatgcacacaaagaaatcctcttggttcctgtagttgttgtaactgtaaagacatgagcctatttgccttttgattattcccttattctagaatcttctcaaaatgttcggctagggtacaaaatgttcagctagggacactaattcaatcatatatatataatttcccatcctggtttatgttttctaattaagccactaaattcagggcaaagtccatttatgaacagagcaattaaggctatttcaatccttgtagaaaacatcccttgttgtatttcaagcctgaagagtatgtgtgtgtgtgtgtgtgtgtgtgtgtggtgtgtgtgtgtgtgtgtgtgtgaatgtgttttgtttggttggttggttttgagacagggtctcactctgtcacccagcctggagtacagtggctcgatctcagttcactgcaacctctgtctcctgggctcaagcagtcctcctgccttagcctcccaagtagataggactacaggtgcatgccactaggcccagctattttttgtagtttttgtagagatggggtttcaccagattgcccaggatagtcttgaacttttgggctcaagcaactcactggcttcggccttcccaagtgctgggattacaagtatgagccaccacacctggccccctggccccctggccccctggccccctggaatgttaaataaatattatttctaaacagactgtaatctgaaaccagttcaaacttgttcatcctgtttttttttttctataagattgtatgatggaccaatcaatctggaaaattcttaggaactgaatataaaagattttcagcaattatttccagctccttttggccctcctctcaaggagatattctaggggtctttaatattcttgagtttttccgattccacttctaccatctgtttgtgagtttcacagggtcccaatatcatatgaataaattgataaagatcagggattcctggatcatatgctccaataaggattctgactttttcagtaaatttctagaggttttcctctgggttagggaagtcttttgccatggctgtaagctcagttttagaacatggagtaaaggtggttacagaaggcaggcctgactgatcagaagatttcactttgtaaggcatttgtttgacttccttttggccattatcttcagggtaaaaaggtagttgagcaaaagggttagtggactcagaatatataggtaaggacaaagtgaatgaatagtcagggttaattcagtcaaggtacagtccttttatgtaatgttttcagtttgttgcttaagcttttcatttgccttagagaaggaagattttagaaaggcaatttttgattcatttaatctggtagacgtttctgcgtaccaattgaaaaatatatcacattgcttttgaggagttttggatcctttcttttttaatgtgccccacaagtgaccagttttacctaggttaagaccttcttggctgggcacagtggctcacacctataatcccagcatattgggaggtcaaggccagcagatcacttgaggccaggagtttgagactagcctggccaacatggcaaaaccccatctctactaaaaatacaaaaattatctgggcatggtagcacacacctgtaatcccagctacttgggaggctgaggcaggagaatatcttgaacctgggagacagaggttgcagtgagctgacatcacatcactgcactccagcctgtgcaacagaatgaagttctatctctaaacaacaacaaaaccaacaatgatggactggattaggaaaatgtggcacatatacaccatggaatactatgcagtcataaaaaatgatgagttcatgtcctttgtagggacatggatgaaattagaaatcatcattctcagtaaactatcgcaagaacaaaaaaccaaacaccgtatattctcactcataggtgggaattgaacaatgagaacacatggacacaggaaggggaacatcacactctggggactgttgtggggtggggtagggggtagggatagcattgggagatatacctaatactagatgacgggttagtgggtgcagtgcaccagcttgtcacatgtatgcatatgtaactaacctgcacattgtgcacatgtaccctaaaacttaaagtataataataataataataaaaaccttcttattgtggctactctgatactctaattctaaattatctttgataagcttaatccatttttctaaaaatatacaaattatgggtctataattcttatacataatatttgttggagtcccagaaagtagagtatcagactcctttgattcagaaaaacctgttatcaaaaaataccttttcaaggcctttaactgaatttcatccagttaatcattgaatccaatctgattctggaccctgtccattctaagaattggtcagatgaagtccagagagttcaaaacacaatcagtgtaactcagtctaccactgccttcagttacaaacaagagagcagtgagcacggtggattcccagggcacctcacctggtcacttagtcttactagggatcatcagagatctcctttgaatctcacttatacatcaaaactgataaaagaaaaactttagacaaaatgaatataatagagtttatttgagcaaaggataattcatgaattatatagtactcagaataaaaagattttcagagtgcttcactgcagcagcatgggcaaggagctttatgttgagggaagacaaataaaatgtgcttgattggcttagagtggcaagatcctagtcagagattggatagcagtttctgattggtaaagtttctagtttcattttactatttatactgggctctggtttgcttccataggaacctaaagcaccgggactgtctcagtctaatggcctctctgttaggattttttaaataggatttcaatttgtatcagtcttatggagttcattctaattgtatatattaacaatttcagtactggctgacttagcatgaaaatctgccaaagcatttccttggtttcaatgaattcttgttctgcttgacatttggttagcagttttataaaattagtttcttcattaggttctaggaattcttacccagtacaatggtatgatcagatttttagaaatttcatacaatttcgagaacacatactactcacacatctatacaaatataacgcaaagtttagtatcacttattagttgacaatgcttttcgtatagtttaatataccaagtaagcccaactagttaacacctctctttttataaggagagagacaaatctctttgagaagttccaagggcttattgggaaaatcccaaagttaatttgagatcaagaagagaatttaaaattttatttgaaggagtttgtcaaaaatatcaaagctttaaacatttgattaaaatagcattacaggttactatgaaataatagtcatttatttaaccagtgataattaaatatttcaaaggcaatcacaggaagtttcatagttataggataaaccttaagtttttaatagagacaacactaagcacaggaaatcatcttgataaaccccagaatctttgttttctaggccaattacttaaaagataaagaaaaaattctcacaatttcctattaagagcagatcagtactccaaaaacttgttttagcacaggagaccaaattctaattttgcatcagtgtcctttttatattaatgctcaatttttagaaaactcatcaatagtttctttctactattatagccagcttgatcacacataaaattcctttcaaaagattacactttcagaaaatttctgcagccttcttatatcccttcatactttttttctataattttgttatttagttatttgttatttgttctatactttttctctttctcattttagaacaaccagtgaatctaatttaggacaaaaaaatactcttgttttctcttaacaaaaacacatcttccaaacctcatagcctcacttaccaaaaacatatctcactttcctcacatgtagagttgtttcccttatattgtttctaattttaatgaccatacctgttgattagaatttgtaactcttagtaatgttaatttatagtgaaaacccaggaagtaaagcaattttgaattttcatatatgaacattttatgaatatacattttataatttctaaaaatatgtgcttcctcctagaacaatttttcatgtttgctaacagactgaaatatatttaacttttctatatcataaaaaaacaagatgctgaaaattatatacttaaaacttgttcagcaattactgtttcagtattttaacttacttcgaaatgactcagacatttcacaaatatccattacttaatttaacataatatacttcaaaatttcaaatttctgaaaaagattttttaaaccatgattggtttattgaaaaactttgaccaggtgcggtggctcatgcctgtaatcccagcactttgggagaccgaggtgggtggatcacctgaggtcaggagttcaagaccagcctggccaacatggtgaaacaccatctctaccgaaagtacaaaatgtagctgggtgtggtggcacatgcctataatcccagctacttgggtagactgaggcaggagaatcatgtgaacccaggaggcggtggttgcagtgagccgaggtcatatgactgcacttcagcctgggcaacagaatgagactctgtctcaaaaaaaaaaaaaaaaaaactttgatgccacattcacgtaatgtacttgttcttaacaattatgcttacattgctcattaaacaaagctagcctttgaaggatttagtaaaatatcaccccaaaatttatatattggtttacatatttttggtatattgattactttctagtgctgaaagcacttgaaaacagcaaaatgcataggctttctgagtgccctccatttgcctaaagagatcctacaaaaggaactaaattgctattaattgtccaaagattaacttttatcacagaagaggaggttagaggtccaccacagccaaacagaccttatcacaaaccatcatctattcttctaagggcccattcatcttttcaaaaatcatttaatctgaggatatctttttgcttcacccctgaccatcgtatccattctagcagcagagttgaggcaaggaacagtcctgtcccagcacatatgctaacttgtgtggtttagctaatttccaagaaggacatctccaaaagtgagggaggttcatcagataatctccaagatctaatactctgttttcttctctctccccaggcatcctttttttcccttttgctgttctgtgtgtgtgggatctacagctctgttgtgttaaagtagaaactttagacaaattaaatctaacagtttaactgagcaaggaacaatccatgaagtacatagccctaagaatcagaagaggttcagaaagctccactccacaatgtggacagaaaatggaagttaaatacagaaacagcttgattggttgggatttgcatttgtctcacttggccgtggcctgattggttggccacctgtgattgactgaagcttggctactgtgattggctgagactcagctatttattttaaaagcatactgctgtgtagtgagctgagatcacgccactgcactccagcctgggtgacagagtgagactccattctcaaaaaaaaaaaaaaaaaaaaagtatactgctgcgttagacttccagttaatttctgtactaagttaggttgcagtttgttacgtgtgggctcaaatatgggtgtgtcttcagtccaaatttagtttaacacttggtaaggttttaagtaatcccttggtttttagcctcatatcgcacctcaatcatccacactctctgattctacaaggaccaaatctttttatgtttttgtcaggcaacttggcttttttctggcctttcccccttctatgtccattctgagttttgacttctacttctctttaacattttctctatctgttcaaaagaatttccgaaattgtaatgagagctgccattcagagccttcagagatgatcctttccctattccctctttctctctttttattttttgagacagagtttccctctgtcgcccaggctacaacctctgcctcctgggttcaagcgattctctcacttcagcctcccaagtagctgaggctacaggtgtgtgccaccatgcccagctaatttttgtatttttagtagagatggggtttcatcatgttggccaggctggtctcaaactcctgacctcaagtgatctgcctgccttggcctcccaaagttctgggattacctgcatgagccattcttttttttgtggtaagttttattatcattattataccattccaatgatttcagcactatttctggacacaaatgagataaatacatgcagggctacactatgttgtaaccttgggaaagtaagctgggggtggagattgttgataagtcagagtgaaagacagataatataaatagaatgttccaaaggaggtgcagatccggaggggctcataaattgctggaggaaggtcatcaaaagaggaagggagagttatgatgaaccaccatagaataaacatatagactttttgcactgtggaagtagatttgagaaggtaaagtcatttattaactcaacaaatatttactgagtgcctattatgtgtaaactctaccctggctgctgatgttctgatgaccaataggtacaacttctgtcttttgtctgctcatgacattgaagtaaagtcagagactactcaaacaaagaaacccaccaacaaacagatagaagtacaacacagtaagtgctgaagacaaggcagcagaagttagaaacagctaattgaccacattgaaagagaaaatcatgtaccacatattctggttaatatattgtagagtggatatcaactatttttaaacgaatcagggggttgaaaaatactcattggaatatggtttctatgatacatccaatctaagattaatatgagatacataattccaagaatcatgttttgggtatcccattattagaaatatgagatgcagagctttagaaaagagttagttatggttaggatttattccatgggaaagacagtaaacaagaggcatgaagtataattatgcaccaactgtaacagcttaaggcatggccagtgctctgtgttgggatgaactttaatgtaaaggtaccttataggggttgggggcccaggtgctctttgatttagaggaacacatatttctcaaagggtagactctcctgaaatattcacaaatagatcataactgcttatatctaggctttgaaataatggggttttgcctatctgtagacaggatgttctgggaggaagatagcagcattaacctcaggatttctctacctcttaccataccattattaacatacgcaatctcctttatcctgtaattggaaagagaccacagagcaccataaccatgtctcccatcctcttcaaattctttccagtggtcaggaggatgaagccatgaaatagaaaacatttacttccaggcactgcctttattcaattttaataagaaattgttaccaggcacgccatgctggtattaatttcaaattaaaacttagactatgtatgacctctttaaacagctattttccaattcgtttattttggctgtaattatgactgattgctcaattcttactggaatagctatgtgtagtttcattttagttgaagcttttacagtaataactggggaatattttctacataaatgtataagatacctgttttttaccttatagttaaaagatgacagacttgaacatctgatgtacttctccttactgcattgtaaaattaatttgtcttttcatgtggctacatctaggcagtttcaacaatttgaactttgttttatataagaaataaaggaaaataatcagccatgaagtagttaatttattgatattttatgtatgtgtgtgtgtctatacatacacagtcacatatataaacatgctcagaagtcagaataaaagtattccttgataagacattaaaatacaaagccatatcgaggtgtgcatcacatccccatttaaaaaaatcagacccctgcattttcttttgcacattgatactagaaaaagaacttcattgattgtttttattatgttaaaagtctcagcctttcttcttgacactgtattctatttaagcccatcctttgtcatcccaaagaaatccattttaaatattgttttggaagctagatttctgatgcattctacttctactagaccttatttttgtgtgtgtgatgtactgcacaaaattgtctattgatatgaagcaggcgttggaacgatttttcagctttgatcactagaatgaatcgatttttaacaaaccctcggtgtggcagcagttgctgatgttgtgtgtctaacaacttcattgaagggctgcatttgatttgctattgctaagtgctgtctttcaatgagcttgtctgtgaagacttcctcaactaactgaaggtcgtttatcaggttagaaaatgctgttaaatgttatttactgattaaaatataattataggcagtctccattacacagaatcatcaatttgccattagtgctacttggtgtaagctttaaaaatgctaatgaaactgaaaactagctttccagctgaacatgctgattacactaaaaaggtatttgttcactttgaatgtgcaaggttagtgacaaaatccactgtggtgttacttttttcttagtgcttactattttttgtgttcagccagtagactagattataaggcattgttgtcttcacagaagaaccatgcaatcaaaagtctccaaaactgtgagcattctaacaactggaaacatgaaattataacaccactgactatttatgtcccatatgtgagctacaccatggggcaatatgctaaggtaaagaaataattgttgtcactggattcccgaaaatagcaatataattgcttgatctgcaatgagattgtcagtccttcctcttttaatccttatttgatttctacagccacttaacaagccaaactgtgtaaaatgtcaataaagacaaagtctttatttttttaagaattctcattaatattactgaaagcttattcatcaaactattttactccattatcataatctgttaggaagtaggaagtaatgcattaggagacttatgtgtataagtagtgtgagtgtatatatgtaatattaactctttgaagcatggagtttgtttttctaaaacaaagtttttagcctagtttttaggtatcttagcattgtccttttcttgttggattccactaagaatttaatgtcctttaaatatattgacagcatgacccaagaatattcatgatttcctcttcccttttaaaatataaactttaacttttttcactaatctagagattttcattttgacccaagactgacaattttaagaggatttttgacagctgtgactgtcaagaacagaacaggataaatgattaaactgggtaaatccaaaaaaccaactgcccatagcaaaaaatatatgtgtgtgtgtatatatatatatatatatatatatatacacacacacatatatatttatttctggtttttagaaataaatatgtcaaacgaatataattgtatttgtcctgagccccctttcctgagaggattgagttctaactgcttatcagccattgttcactgccatgcaaggatttagaagagagaggaaacaaacattctatagtttcataggcattgatccgtataaaaatttactctcccattaaaatagtttaaattactaaaaagaaactaagatcatagtgaactttgagttttattttacagtcaaattatgaatgggaatcagataatggcatttatttatttatttatttatttatttatttatttatttgagacagagtttcactcttgtctctcaggctagagtacagtggcgcgatctctgctcactgcaacctccgcctcccaggtacaagcgattctcctgcttcagcctccggagtagctgggattacaagcatgcgtcaccaagcccaactaattttgtatttttagtagagatggggtttctccatattgggcaggctggtcttgaactcccaagctcaggtgatcctcctgccttggcctcccaaagtgctgggattacaggcatgagccattgcacctggcctaatggcaatttcttttttcttttttttttcctttttttttttttttttttttgagacggaatctcgctcattgcccaggctggagtgcagtggctcgatctcggctcactgcaagctctgcctcctgggttcacgccattctcctgcctcagcctcccaagtagctgggactacaggcgcctgccactgtgcccagctaatgtttttttatttttatttttattttcgtatttttagtagagatggggtttcaccgtgttagccaggatggtctcgaattcctgacctcaagtgatccacccatctcggcctcccaaagtgctgagattacaggcatgagccaccatgcctagctggtagtctcttttttattcaccaaatcacagatgcttattgatttaccacttaccacttttatcacatcttagtctaaaattagacacttcctttaagttttttatttccctttattcttctttgggagaggaaaaatagtttgtcccaattgtcacatgtttgaagactatcttttcttgaataattttctcagaaaacacagaaaatttccatcactcctttaaaatggcaattatatcttactctctgaagacttgttagaataaaagattcctgacagctgattaggaaagtgacatatattttacttcctttcagatgaaaccttctaaaaatgtatttacttaccaggggcagtgacagcctgtctggcaaaaataattgatatcctttctggttattgtagaaggggaacaatgaaacaagaaagaccttgctcctatcttcagagatgaataaactggaagaaactcattgtcattaaattaaaattttcttttaggtacatctggccgttgacacattcttgtataatgttagtaactctgcctcatcaggcttggtgtagtattttcaaaacatgcatattctgcctttgagataaggtaaaaaatatctgaaatatctggaagtcaggaagtttatatattaccatatacccctgaaatatcatagaagttaaatatagtttgacttcaataatcagattaatatatacaagagtcttttgaaaggatgttcacttttgaataaaatttgagctggaatgctggttctagtattcataagctaaatgatcataaggaagttactccttttgaatttttacttttgacatatgtaaaatagataaggctatagtgcttccttttctgtagtcacgcataagaaattttataaatattattaattatgatggggtagccttaaatgtggtttcgatacttatctttacaaaacgcaagaataaaaacagcaacttctaagaaaggatctctctcttctgctttaagaaacaaattaaacctgcttgttactagtatattaatgatttatttttaaagggctacagccaaagatgttacaattgttcttttaagcaccattattttcagagaaatatttacattaatttttaaagatgttgctgtaaaccccccttttttcttagcactttaaccccatctagatcaaactattatctgcagatgtattgatgtatatgctttcttggcttttggactgccatcacaactcagcgtttctcatttataacttggtacagagaggttattcattaatctagaactataactaattcatggcaaacttgggaaccaggatctgagctactactctgccaaattccatatttttaagcattatagaatatccttatttttatagtaaaacattctactatacataaatcagtatgtggctgatgccacagaacacagtcatggggcatctgtagaagtcatgctttgttgacctaatggaatctctgtcttcagagaagtaaaaacttggttgtttctgtaggttataaagttccaagccattgcttgccacctgagagcattaattccattatattggttgtttccatagttaaggagtggcttgttagagtgctaactgtctatgtctcttccccaggccattaggtaataaattggatataatatataatttttaagttttttcaataatgaaagatattatgtaaaattctctgcactcaaatgatcttcagccatctcatataatctcattttctgacctgtgaaaactacaaaagctcccaggtttttagaagagactccattttgccactaggcttgtcacttctctccttttagaatgtttgactttgggaactcataaataggctttttttacttgcttagatgaatgttttattaaatttgaccttgagtcctttaacttctaaatagcagtctaatttttaatgactcttgagagatcaatagcttttctaaaattttatattgttatgctaataacttttccatgtgtattctttataatcttgatggttaatattataaatcataaatttattaaaacattaaatactgacattgatttttaagatccaatggattagaatttcatatttttcagcatattataacataaaatacattgctatattttgtcacttactttgcattattgtttgtctcattatgaaatttagtactgtttgtctcatttgtgaattgaggtaactgaagtgaggaggttgacctgaccaatgaaaggtcctataactagttagtgaaaaaacaaagcaaatatgtgttagaatgccatctccactgttaaatactgacagtaatacatagttcctattaacagggtaatttgtatctagtagatcaagttttattccttgacaattatgccctttattgtttcctgataacataaaaggttcatgctgctgatgaattttgcaaatagtatctgtccagtgtaccgaattttcagatttagaatctgccccatagcagttacaagcattctgtgctactacatgaaaaaagtgtgaatgagtatttcttgaacaataacagatttcagttgaaatgttagatgaatatacacaaaacaattccatttaatcacttagactagagcaaattctaaagcatccattatattcccagtcaaaattcgctacgttattttatttctcctttgggagaacaatgtaatttccatcattgcagattctcaaaataaattatagttgaaaaagccacagagtttccaaccaaactttcaccagcctattgcatcccccttgttttggtggagaatcaaagaagggaaactgtatttccagtggagaagccacaataaagcctttatgtagaagccaaagttaaaatgatgccaacaggcagatggaaaccaagtctgaatgaggaaattctgagccaggcatcttgctgtggctgtaatgtagcccggttgtgccctgatttctctgtccttattactgggattgcagttacttatgaattgaattcccacgtagttatcttgctgttattgtaaaatgccacatgatattttgtgctaagtcaataaatgcctcatgccaacactgtgtttattttgggtttgtaatctctgtgcttttaccctttttctgacattttccaagtctctctctgcaaatcagctggccatgaagcagagcttcctttcagcaattgacagtctgctgctgcagacctaaccaccaattcacaccccaggggactatccaccccaggaagagatttgctctcagtcctctgacacctcagttagtttaaaaattactcctagaatttagacttcttgcaggtaattcttagagaaacataaaaagaaattggttgtttgaagtgtaggtttaaaaataaagaaaagcaataaagcaggatcatttgaattggaaaaatataggagatttcaaagaggtcattggatacattttttaattcattgactttcaaacacttttgagcatgatccacaatatgaaatacagtttacagtgttacttattatatatccatatatacatgataattgaaaccagttttatcaaacaatacttacctagtattatataggattgtcaaagtataatattaaaaagttaaaatattcttataggtgatgcttatgcttcaacttgactggattaagggatgcctaggtagctggtgaaacattgtgtctgggtctgtctgtaagggtgcttctggaagagattagcatttgaatcagtagactactcactagattcaagaatatttgctctcaccagtgtaggcaggcattattcagccaatccattgagggaacaggtaaaacaaaaaggcagagaaagggtttattctctccctttctctctcttcttcagttggaagattcatcttctcctgcctttggacaccagagctcttagttctcaggcctttggactctgggacttacaccagtgcccccaccacttcccctgcactccttcattctcaagcctttagccttgaaggtgaattacactattggcttttctgattctccagcgtgtagacaacatattacgggatttctcaggctccataatctcatcagtcaattctcattataaatatcctcttctcatacctatatgtattctattagtcatatttctctagaaaaccctgactaatacatcatagaaaagtaaaatgagcacatccagaattttatttaacttactaataagacatccaataggattttaagattataagattatttgaagtgctagatgtttatgaacaatttaatgaaaagatattaagattactaggttagatagaaaactgattaatgtactaaaggacaattaaccataaaatttagtgttatctatttactggacagaaataatttgcatctatacttaataaaaatgtataatttaacatgcatttttactaaatcttggattctttattagtagtgagtcaaactaagttcatttccctgaataattcttggttgtaacaataatgggccatatgagccagtaatgcccatgggtgatatagaaagatatactgcccaactttttaacttctttcttccaaatttgactaattttttaaatagaatgtgttccaatattttctattacagtctgttgtattcgggtctatttcatttttcaaaatactggtacagctcactaaattatcttcataagccgtagtaggttatgacccaacttaaatgatactacaatataaaaatatcatgactgcaaatactgcctaagagaggcaagtttttttctccatgttaagaataaaaaattaacaagaaaaaagagaagggtggggagggagaaagaggagaagcaaggagagaagagagccccagcaatctatcttcagggatgtcagcattttttaaagtgataagactttttataaaagtcacatttcttttccctcacagagcacaaattttgtttacgttgcaactgaggctctttttctcctatttagaggggaatttagacaatttgtagagatttgcagctgtgagagaagatttttttagaactactatttcattatacaggttagcaaactgacttaaaagtaagatgacctgcttcaacacccagaaattccatagggaagtccctgcgtgtaactatgtatgaggagaacagtccctggactcaggaaggtgtgggcctcagttgtgagtgagtcaccagataggaaacttcaggcaaagccattatatttctggtctgaattaccacatctctaaaatgggacaaaagccattattaagattaaaagatgaactatacatgaatgtccttgtaaaactgaaaatgtagttttaattatttccgagatttttatccagtgcacgttttcccatccctggatatcctgtaatacataaaatatagatgatggactatttgcatatacttagagtcattgagatcatatgtacaaggtctaggcaagtctagttagttttataagtacattctctgttctacatacaggtccatatttaaatatacaaagatgtgatagctattattactaatagatcatcactgtaaaatgctctaaaatttccaagttaaaaagcaccattctgataaaatgtactattattatataaggctttcaacctgtggagcttctaattatgcttttcatgcataaaaaatgcaactggaaaaactgataaatggccaacagctacttccctgctgattacacaaaatttcattatggtagaacatttaagaatttaattctgagctctctcaggaatagtctgtaaaatgttttgcttaggtctctttttaagcacagaatctcagctgaaataaaaggtgtattgagcctttgccataagcaaagttaagtcattaagtcagaaaagatgagtttgaaaatgacaggtaaagacagaagcaataaatatcaccaaaacatgcccaaatgttttcttctctcatttttagagtgacaatagttattgaggtagaaatgaggtcgttttactgcaaagattactctcctgattcctaattaatattttttttaatttcccataaatattaggaaaaatattctagacatatttgtgccttttacaaagtgctttaggaagttgctgtaatgggcttctttagtattgtgtttttcagtgtcttctttcactccttccatcttctctgattctcctgtttacataaaagaaaagagaatatttaagtcctaatgtgtctatagtacttgaagcttcaacattgggcagatgccattttcctgttttttaactggaaaagcaggtcccagacagatagccttgggatctctatgggaatgtggaggctgcatctgagaaccagcaacagtggagcctaggctagtataccacagagtatttatccctagctttgaagcatgaatccaaaatgtttatatgccattagaatatcagaaatcttcatttggtttctccattgtgttacttgagtgtacaccattttctatgtcacttcctgttgctatgttctggacatcttattctcttcctttccaagaatgtaggagaaagatcagttacttgatttatacctgaaaaactgtcttcttttactcctactgagatattctgaccctttgctgctaacccattctcagtcacactcctgctttcctctctacctgatgttccagccacagaacacaccacacactttccttcctgtgtaaatgcaaagcatttggtgtagggaagatcacagggttagaatcagcttaacctgtgcttgagtcctgttgcttaccagctggataaccttcacaagtttaccatttcttgtagcctcagctttctgctctgtaagagagatgaaacctcacaggacttgtggaaatgagtgactactacctgcaagattcatgctgctcaagagccccctttgcagggcttttgagaaacgtgcttccctatgaccagtgctcctggattttacacatcctttcctgtctcttctcttctttttttctattaaattaatatcctgtagttggaaaattctattcagagtttgggagaaaaaaaaagatgaagaaggataaagtgaagtggtaggagactgaggaaatttaaacattcataatttttgtcctgcttcataaatacatagtagctgtatggttacttttacctataatgtcctctttacccgtcatttcctacaaccacaaatagcaccattctagtcccattgaaagcctaatctatattttatatctttattaaaattttgtttaccataactggaagtaacatctctgtccccaaacttcatggagttttcttttttaaaatttcactttatttcattttctaacattgacagataaaactgtatgtatttattatataaagcatgatgttttgaaatatatacacattgtagaatgactaaacctagctaactatgtattatgcacgtagttatcattttcgtgatgagaacactttacctctattctcttagaattttaaagaatatagtaccgtattaacaatagtcaccatgttgtgcaattaatcccttgaacttattcctcctgtctaactaaaattttgtatcctacaaccaacatctccccagcctgccacccacctcacccctccccctaacccttggtaaccatcattctactctctacatctacgaggtcaaattttttagattccacatatgagtgagatcatgaagtatttgtttttctgtgcttggtttatttcacttaacataatatcctccaggttcatccatgttgttgcaaatgacagaatttctgttttaaggccgaatagtattccactgtgtatatgtaccacattttccttattcattcattgatggacacttcagttgatttcctatcttggctattatgaatagtgctacaatgaacataagagtgcagatatctctttggcagactgatttcatttcatttggatatatacccagcaggaactgctggatcatatgataatatgataattgtatttttaattttttgagaaacttccatacaggtttccataatggtttcaaatacattttcaccaacaatatgtgagagtttcattttctccacattcttgtcaaaacttatcttttgtcttttgataatagtcattttaacaggtgtgaggtgataacttactgtggttttgatttctatttctctgatgattggcaatgttaagcatattttcatatacctcctggttatttgtatgtcttctttggagaaatgtctattcaggacccttgcccattttttaatgaagttacttgttttctttctgtagagttgtttgagttcctgatagattttagatattaaccacttattagttgtataatttgaaaaaaatgtattccattatttgggttgtctctttattaattgtttccttggctatacagaagcattttagtttgaggtaattatttttgtttgtttttacgtttgttgcctgtgcttttggggtcatatacaaaaagtcattgcccagaccaatgtcatagagttttctccctatattttcttcaagtagttttgtagtatcaggtcttactattacgtctttaatccattttgagtggatttttgtctctgctgtgagataagggcctaatttcattcttctgcatgtggatatccagtttccccaacactgtttattgaaaagactgtcctttccctactgtgtgttctcatgtcctttataaaaaatcagttgagtgtaaatgcatggatttatttctgggctcttcattctgttccatttgtctatgtgtcagtttgtatgccagtaccatgcagtttgggttactatagctttacagtgtattggaaaatcaggtagtgtgaagcctccaattttgttctttgttgctttagattgcgctatttggagtgttttgtagttccatagaaattttggaacatggagtttttagtttgtatgtatatatgtatgtttatgtcttgattacttttggcattttaggtcaggtccacatgtattaagtttcttgtttgtttgatatacagaaccgcccctttcctgagtgttttgcaacatgagaattagataagtgtttatattcaagtggttgaactcaggtttctaaatagaaatactagagttaactaattattacatatgtgcagcattctaccatcacagaatattgcaaaaggaaataattctgaaagattaattttttttctttggcccatgttgactcttttcttgccattaaggtagtctgttgtgccaatacttttgcaatgaaagaggtgattacttttcttagatgttttcctgcattcactgattggtagcaattccaacaactgatgacttgggcagaattcaaaccaggaactttatagggaaaactgtaataccatcattgaatttgtgagccctctcatcttgtagattggaaggtccaaaggaagcttttttttttttcccacacttcacatgcactgtgttaaattaggatggacgtcaaaaatctgaccttttcatggagttttagagatggaataaaaggaagctagtaactgatttcattccagctgtatttcccacagcttgtgggaatgttttatgaggagagttgtggatagtgttttatgtcatttgatgagaatgaatccatgataatctataatttaaagcaagataaatttccctattatggcaactcggtcttgtattaaaagctgacacttcaccacaggtcactgctttatttcttcaagacttttggtgaattgcccttgcaaaacaccaagagcacatctgtaagttttagtttcttaatgactgaaaggacaatgtgccctatatttaaggagaaaagagttatgctcggtaagaaaatggagagagatatatatatatatataatttttaaattaaactgtgattcaattatctagattagccaataaatgcctttgtattactataactgcttccgtttgcaaattacagttttgcaaacaaaactcacttgctactttttaaatactattaattttggacaaggaaattcatatatatgccccaagggggaaaaatagaaaatatgtcttcctttcaccgtctatctctgtcttagcttaaatttgtgattattctcctaagagaagactaagcatgaatgattttccttataacacaaaacattctgatttaattgtttttagtagttggttctgatttctgacttcagttgtattcttcctgacaaacctctatttcctgatccccttaactttctgtcctgtagcttgacaggaaaacattaaaagactgatgaaaaactgctgtatgcctctagcattctttattttaccttcacagttactcaaaacttatttgttgaatgaaagcttaattttcctttttatgcaagatttggtgtgtggcagaaggcagtagcctggaggtggcggcatacatagacattgaggggctggtgaaacagtgtcccagtcaccagggaggcacaggaagagaggcatgaaaactgctctgcccctgactgtatgggaaaccccaagagcatcatctcgctgtccatgaccactggatttgtaagatccaagggggcctgactcttcctttgttcttagtctcttatatctcatgcatctcatacgcctgacatggggacatagaagaatgctattaataacattgctattaatacaaacattctctaaatgcaaaatggaattaagtgattcctcttttaacctctgaaatactttaatatgatttaagaaatactttaatttgaaagatgaatctcttttgataaaagacatgttcatataaaaagaagacaggcgactggataattagtacataatcaaatagtaaagttgcctttctgtttatctttagtattcaatggtgttgcagtggctcatggtgtaaaataaaatatttgtcaatgcagacacagaaggacttttaaaatattcattttgggagcaaaagtaggatttgtaatcagtacagcacctttaaaatcattggatagatgcttgtatgtttagggagaaaagaaatgaggaacatgaacagatttcctgagagagttagagtgaagagtgattaagctcagaacataaaattaccatttatgattagttcagttcaattaattccatctatctatcctttaattcatttatttaatcaaccagcatttgggcactgtgcagtgccctgtggatacagggatcaaagacaccatcaaagaatttatagtcatgtggtgaagacagagatgtaattgaagtacctaaaggcagcatgattttcatgctagggaattacaggtgtctggggcacacaaggcaggcaagtggtgtagggtataggtcacaaattatttgatagccacacagaaaatgagagggggaggcattcaacagtgaccaaaacattgtccctactgaaatagaaaatgtttcctaccctcagggagcttgtagttcttaattctcttagttttagtgcatacgtctgtaagaaattttctttgaaggtatttttagctctgagaggcttcaggaaagtttctagtaataaacactgggtatttaatcctaggactcaattgctagtttgttcaaagattcctgatttgaactaccattcccttctgtgaagaatttcatcactatcatgatttttgctcaaagctgtattcaaaagtcatctagacataacaacaggaaaatccaactaactaatgttaaatttggtgactgtgatatgctcataaatttttccatattatctatgaaatgctgtaattctgtttgtcccaagaaaactcttgcattcctgtcttaattaaatctctcaagccaagcaggtttctgcagtatacaatccattcattcaggtgtgaaaggccggaacctatttacatatttacaaccccgatagctgtgcctgggataaagtaaatttatttctgagttgtctaggttctgcagatattgcaaatacaattgtatattcaagctttctcctaaaagactcattttagggcagttctgaaaaatactggaaatatgaaaatagattttaagctcttggggtgaagatcatgttttgattttggttctctttactgctctgaaagtgctgtgtgtgtgcctatagccctttataaatatgtaaataaaaataaaatatttagctgaactagagtaaagaagagagactcttatgtaatagaagaacatttatgtgaggaaaataacagaatttcagaaaatacagccattgggaaaagagtgttttggattatatacctctaggtttattttcttaacgctcattacaatgggaataatatttgcttgaagtcacagcaatggcctgaaatgaaagaggctaccagcccaccagtaattcaatacatggcaagtagagtaattatagtactgagccaccttatcagtcactaatagtggggaaatagcagatactagggaaggcaaaggaataaagaagcagaattcagagagggataaaacagacacatgatagagcttagcatattgaggagactgtcccatggacactgcctctcagaggaaaagtgatgcaagagagttccgggaatttctttaaaagtaaaaagtatgacagtattaaaagcaaatcatagagataaccatgctgatgaaaagaaagataaggaaaccataggagtccaccatctgtaaggtatagtctgtttttaatatctgaaatgcaaaaagcaattatctgttgaacaagggcagatctgcaaggacgagaggaagagaacagcagaagcctgcagggcagtcagaaggccaagacacaaaatgagttccaattagagcaggtcaccaaggagaaggagaaaaccttttaaaacacatttgaaacaagagcaaggcaaaaggaaatacaggctccccagttaataagaaagggaaacaaacaacgataaagagaagtcttaggttttatatgtatgtatttatttttagattataggcaagaaaaaaatctataagaaattgaatataacccacaaataaaggctcaacaatagttactgaaggaaagatcaagcaattaaaactttactcatctaagttcaatagagagattgcctgtagtgataaataagatggacgagaatattcttcagaagactctacttttctgtgatcctaactgtgactgagttgcagggggttggacaaaattccccaaaccagagacttcacaggctttttgggctgcctcaccctctatataaaattgctagaaatgaattcattgtatctaattttaaatataaaagatgttggaaataatattttaaaaacatatcttcatgcttagaaactggaccatttcttcccagctcaagcagtgatgtatagattagtaatgaacactggtttgtcagttgaaaattaggtgaaataactcaatttcttcttagaaaattcctaaacgttaagctacattcatgtctgtgtttacattttccttatattattttcaattagggtaatataaaaaataaggccagtaatattgttttatatctagaaatatatatgtataagggatagatggtcccatctatcctagtcccttcagaattaactcatttcagtcaacatttcttatgtgtctcatacggatatgtaaccagtttattgagcagtgggataggaatatgaaatggttttgtttctccttaaagcacattttgtgtctctgtagcctcttaattgtgagaagtagaaggaaatggtattaatagtgaggacctgagccacctgcttctaccacgtgctggttgcgtgacctcagaaaagttacttaaccttttgtgtatcattccacatctctaaaatgggaatgatagtacttactttaaagggctgttgtaaagttgcaataaattatttaaatcaattaaaacagtgcctagtatatagtaagcattcagtaagtattagctatagtgtgatctcagtcaatttctatatttttccagtccctgctcagtttttgaatacttgccccaatctcatttaaaactctcatcttgtctcttctcttcttcctagtttagttttgaccctagacttgagggaactgctttaaagaagaaagtgaggcctggtgcagtggctcatgcctataatcccagcactttgggggaccgaggccggtggatcacctgaggtcaggagttcgagaccaccctggccaacttggcgaagccccgtctttactaaaaattcaaaaattgtctgggcatggtggcacacacctgtaatcccagctactcaggaggctgaggcaggagaatcgcttgaacccaggaaccgagatcatgccacttcactccagcctgggcgacagagtgagactccatctcaaaaataaagtaatgaattagtttaattaaatgaagaagaaagtgagttctctttcaatcctctttgaagttgagattcttctggtactgagatagacatttagaacctgtgggaaaaaggcaagagtcctatgaggaggccagatttggggcttctgccacatagatatgatggacaccatagttagtagtaggagaagcaggaattatgtggtaggagcccctcccctggcttttcatgtattttggagattactgtgagaattcctcaaagcatagttccttgacatagattctggcttctgctagacaattttgaccctcacatttcccttaattcctgctaagtggtgaactctatggatgggattctctcaactgccagcccgcagtgttggggaggcactgacaagacagccaggatgctattttctggaagtctctcagctcccacagtattgccctataaaatggtagaaatgcaggctacttcactctagccttagccttctggttatacagattgggatgaccagtgtagcagtgctaacatgacacccttttaataagctctggccctcatcgttggcaggtctttctagaacacagaatacttgatgtctatttggcctcagcatttggggtttgtcatagattccaggacaacaggaaaagttgcccatcaacttgtcatacatattatggccaaggccttgtagcctttcagcttgagattctctcaatgttccattttcccatgttttgatcagtaagaacaatccttatttgggtattacatatctgatttatctcctctttctatctgtctgcctttcagtctcatatatggaactcatttttaattattgacatcttgggaattcccacagtgaacagatgttgcagaatgacttatgtggaaaatgtcaaagattacagtctattacagtttttccagccttcacatatggtttgactccattaaacattctttaatggtgaatgttttaaaaagaaaacaattttttttggttgatgggcaaaagagtaagattaagaagattccaatcactggctccccattcctgtactcctggcaccaggtctcctctcataatatttgagtactgtggatgaatgtggttgaatagaatataatgaaattgactcctcctgtatcactgctcagctctttgcatctaattttctatatttataggagaaatggaataaacagtaggtttggaccccaggtcataacattaatggcagaaatgtaatattacctatggcatttcaggaaacaggacatagactttttataaggcacatctccagactttggtggtgttgggtagagccaacttttcactgggtccttccccaagactgttatccttgaaacaggatgttttatcttgacttaatgactttattccaagagtcacgtggaggaaagaaggtctgatactgtgttatatgtttaatgatttagaactctaagaatatagccttagtttattccttcctttaaaaaaaaaaaaaaaaagcaaagggaaaatacccataaaggaaatttatctaatacagagtgagaactgctttaatttttgtatcatagccaccaagttttggtaatcaaatagaaaagtgtaagaagtcttttcagtaaggcactgccatttctctgggtgtacatcccttatcagctcattacaccaacttttcctttgatgttgtgtggtagtcccttcccaacttaagtctggtgtgagaaaattgggaaatagcactttaatcctggaggactgatttcattaaagattttattatatattggtgatccagccttgctgtcttaagtatggctctgagatgacattgatgaaatttctcctatcattagaagtcaggtctagcacagttgcaacacccagaggcacaggagtgctgggtcatgtcaagagaacacagattaagaattgaaattcttgggttccagcagttcagaaaaccactcagtctctctgggcttcagcccaaaatgtaattcagcagttcttttctgtagctattaattaaggtgggtctcagtccaagttggtcctgtattttgtcactgaggctcacaaataaaatccgttaatactttactaatagttaatagttatagaatatttattacgacctaggcattgtgctaaatgcttcattatctcaatgactctttgaggtaatattttacatatgaaaaaactgtatgctatagcaaataagtgtcctcctcaaagcctggaagtgtgtaaatgataggatcaggacttgaatccaaatctttccggattctgagtccacagttttaaccacatcgataatattgctgttgaatttgagctgtgttcttttattctttttttcaactagatcatttattagagagtgacatgataaagttgacaggtttttagatttatgttgccaaataatatttttgactgcatctctctgatactccagtaaatcttcatgttagatttgagtgctattcacatatatctctgatactccagtaaatcttcatgttagatttgaatcctattcacatatcagagtttcatgttctcgcctagaacaaattatcaaacttatagatgatatcaatagtttaacttatttagtttctattgttcttctgtgtgagctcagttctgttgctttagttctgttcctgctgccatttctattttctgctctagaggcctaagacttgatctgtttatctttgttcattgtagttcatttagttgccaaacttttattaagtgcctctgtcagttagtgttgtaaacctcaaggacaccttgttaacaagtgatttaagattactacctgaagtggtttttatctgttgttagtggggtaataccaaatggaattaaaattcagagaaactgccaacttatcttttaaggaaatggtttaaaccttttcttaacctggaataagtgtagttgatactactattaatagcaagtggtgctattgactgttactctaccctgtggcaagtggttaatgtggaatattctatcaaagttgctgttacactagcacttctccttttcctatggttccgcccttatttgtgatacaacagcagcttcattacaaaagaagaatcacataaaccaggaatggtttaaacaaatcagagaaaaaatgagggaagaaaaagagaagaattcttcttgtaagcagaacctcagctggctagagataactatatacttcttctctttctagccctccccaaattcttgagggaatcttaaaccttggggccatacagactaggtttgggctaatccagatctaatatctaggcacttggccttaggctattcctgccatcattttgcagcaggaaatttctggaattgattcagatttgggcatggggagggattattgtgtgcctaactaacaactgcatagaatgtgcacattatccttttcttatgtttgttagagcatatttacaaagtaagatgagagcaggtgccatcaaaaggcagggacactaagtgggaggtatgttcgggaaaagtggctaaagaattgtctttctggcagcatatcccagaactttgaatatattactgtgtaaagggaatatcttagagacaggttagtgagtgctatggtctaaatgtttgtgtcctccccagattcatatgttgaaatcctaatccccaaattgttagtattaagagatggggtcttttaggaggtggttgggtgattagggttctgccctcattaatggaattaatgccctagtaaaagaggtcctaggagctgccatgaccctcttacacagcaagaaggcaccatttatgaatcagaaaacaagctggttgcttgatctgggacttcccagcttccagaattgtgagaaataaatatctgttcttataagctacccagtttatggcattttgttatagtagcccaaatggactaagacagtgaatatgtgctttcataatatttgatcaccaacatcgtcttcagaaagcaacaatagaaatgagtattcctaggaatactctgtggaaaagaaatattattgtagaaatagatatttaagtggctcccacctacttcagcctggaatgtcatattccctctgtcagtataaattcttaacaaatagttttcatgtatttctggtggagcatgatttttacaaccattttataaaacaagttggcagtgcgtataatgtgtcatgaaagtcttcataccctttaacccagtaatctcaccttggaaaatatatcctaaagaaagaatctaaaatagagaacatgataattttttagtgtagcattttaaacaacatattatggtattagaaacaacttaaatgcccaaagaaaagtaagaaaattgtactatactaaatatgaattataatatagtctcttaaaatgatgatcataatgactgtgacaacatgaaattccttacaaaaagtcagttaaaaaaccagaatatataattacatacacacaatgcacttgtaaaagaagcaaaggaaaattttaccattaaaaatacataaaatgtgtatagtaattatgtttttaataggctgacagatttatgtctgggttttcttccctctattttctaatattttaaaactttctttctgcttctaagtttgacttctgaatgagctagattcttaattttactcaggatatgcaggttccatcttttcacccaatgcaggcagctttcctctgaggagtaaaagaattcctccaaaaggctaaagatggcctaggccttcactgttagaatggggaaatgttagtgtacactttcaattatttgtgaaatctacattcatggatcacagcactctgcttttggtgctctccatgagtcatcaggtaataaattgaaaaatgaagagaagctgacacaaacatttctgttttattttattcacatgagctctttttaaaaaaaatcaacgcagatgagctcttcgctgtctaaagttatttaacacagactttttaacatcttattgaaatgaaaggagaaaaatcaatgataaacatcctgtagatgggacgtttgatttcgatttgcaccaaattgttagttattaaatccattatgaagctctctgccgtttgcttgaatttctcattcttggctgctgaacaagtgcctctgagctttttgataattactgacaacttttttccatagtatatgacttgttatttaaagatgcaccagagaagaaattttcaaaatatatccacaataaatttgacatcagaaggtgtatttgttggtttgactgttgaaacagtaaaagaacaggaatgaatcattttatagtaacacaaggccctttctctctctctctcggcttgtgtccttcggaatatttccttatattatatatccttttcattcttccaaagaaaattgaggtacaagttactaatgtactttggttatacattttccctctgttcatatgaaactttcttcagcaatttggaagtgaccttggctgtattttgtaattctgaaatctccttggggaatatttaaaggtagaacaaattcaatggaacctacatgtagagaaatggggtatactgaggtatggtatagaatatgtttaactgcaaataaccaggagaagcttaaacaattagcagtttatttgtttcccattccaagtggttttgtgggaagtacacatgcagggctggcaaaatgactcaaaaatgcctccaggtgcccaggctcttttaattttcccactccaggatccatagaatgttcatttcatatcatacttttcatctatgatttcaaaatggtttatgcacctccacacatcacatctatatctactaaagatgaagcaggaaggaggatggcccaatgcctgtcttaggaaatgtccccagaaatcttataaagacttctgtttagattccataagttggcaccatttcacatggccactgctagctgcaaaaaaacctttcagggctctgtagagtaaaaaagcagacaggggtctgggcatggtggctcacgcctgtaatcccagcactttgggaggccaaggtgggcggatcacgaggtcaggagatctagaccatcctggctaacacggtgaaacccagtctctactaaaaatacaaaaacaaaattagctgggcatggtgacaggcgcctacagtctcagctacttgggaggctgaggcaggagaatggtgtgaacccgggaggcggagcttgcagtgagccaagatcctgccactgcactccagcctgggtgacagagcaagactccgtcaaaaaaaaaaaaaaaaaaaaaaaagcagacaggggatgggaatggttgtcaatagattctgtctccagtaattgcctcccaaacaaaattagatgtttcagtggtcagatacttaaaattctgaactttgttctcatccatcaagtgtgttgcccagttttcaacaaaattgtggcagggagaggaagaagccagagcaaaggaactgctaccagctccaacctgatgcattcatagttgataaaactaaaggataagaacgtaaaattaggagaataatcctgcagaagaattcaagacatagggtagcctgggttcatttaaaatagacataagaagtttcttatctttacactagggtacaataaaggagcataacagtggcctctgagttttcaagaagaaggaaattatgttcagtattttttctaataaagaggagatagcggaaagatttatcttctgttttcatagttaaaaatgtgatattatgtaaaaatgcaaactctgataggccatctggacaactttacactagagaagagtttctgagacttttagattttacaagactccacctttttttttttttaacaaggaaacaaatatgtgaatgtactggaaaaatttcatccgtgtttaccatcattttatatagaaggtcattttagtactcaaaagaattagccatacaattttaaaattaaaagtctttcagttgaggaaaagttaaactttatgaaaaaaaatcatattttttcatttttttttccattatggtgcaaatgcatgcaaaaacttggtcacagatcagcaccagcccagggatgaatgttgagagactgctgtgaaggattttgaatatctgggatttgcttttttttttttttttaatcttttccaagcatatatgccattcctatttgcttggtagctgttgtgtgttaccagcccactgtcagttacatacatgatgtgatttgttgtgtgtggtgtttctcctctgttgtctgcagtaattgtcttgtttttgggttaaggttgggatggcagacactatgcatatgctatcattgactccatcctatgccaatgtcaaactattcacagaatttttactgttaagactaaaaatgataccagatcctgtctcagcacaacgtttaggaaagccacatccaatccatcaaagctagcacataaaatccctctgttcttcttgagttagatattattcccagaaggccttcatgaaaatgtgcttgttatgtgaaaggggaaacttattgacatatcagttcagaataaccaggttgttacatggcaaagagaggagtaccaatggaataaaatagaagtcaattatcgtttaaagcccttcaaagagcaacctgaaggcaacttctgagtggaggtgagaatactatcaaacgcattggcattgagctcatgcagctccccagctcagatgctcccgatggtttctcatgcactcatcaaatttagtggagccttctcaatctggatttccaccaaatatactggacaaacttcagcaaatctgtcattgatcccagatgttgatgcatttccatctctgggctttgatgcttaagtgttctaggtaggtcattgcatatcagtacaactattaggagaatattgtgtaaatccatctcttaagcaccatctcttccatgagttccttccagaaatctttgcttttttcctccctcctaaataatgtcataaaatgacctttcctatgcttccgtaaggagcattctcaggattagaactaaccacagtgttaaatagaacaacctggaagtgttcaaactgtggtaggacagagtctaaaatatatatttattgtaatcataattttacttaaatccatttaagtaaaaaatatatatgtaaggacattaggaacatgaaaaatagttacccataatcccagaaaacaaacgcattgacattttgttgcatttctttcctgactctttttttttgggtgaggggagttctatatattgttatatatttatatttcactcacacaacaagtacttattgtgtgagtgctatatgctgtgtgctaggcacacttttctagacaaatacagaaacatgtttgttttcatgtaatgtgattttatattcatatacatgcatatgtgtgagatttcatagtttctgaaacatcattcaacattagtgtacgcaagtttatacaatattgatggattggatgtggctttcctgaatgttgtgctgagataggatctggtatcattttttggccttaacagtaaaaattcttgtgaatagtttgacattggcatatgatggagtcaatgatgcctatgtatagtgtctgctacctcaaacttaaactaaaagcaagctatttgtgttgttattaatttttcaattaatagatggtatgtatgtttcttacagcatttgattcatattgacatatttctttccaatacattagacacttttttttttttttttttttttctgagacagagtctccctctgttgcccaggctgcagtgcagtggcacaatctcggctaactgcaagctccgcctcccaggttcacgccattctcctgcctcagcctcccatgtagctgggactacaggtgcccgccaccacgcctggctaattttttgtatttttagtagatatggggtttcaccatattagccaggatggtctcgatctcctgacctcatgatccgcccaccttggcctctcaaagtgctgggattgcaggcatgagccaccaagcctggcctagatacatattttacctctattagcgatacctgacaaaaaaaagctggcttcattgtcccttaacttatattttaaattaactcacattttatagggtaaaaacatgctacacaatcatagtattaatttgcttttgtttgatttctaataaggatgatgtttttaaaatattgactagttggaaattgccaacttttatggatttaaattacccctttctagattgttcttagttattctcccattaataattgtgttctctttaacaaggatggcaatctgttatttttacatattttcaaacattacagttcattctttcattttatctatgtttttataacatgcaaaagcttaaaaaacaatttatgagcacagtgtcattgcttgtcctctttgtgatttttctcttctacagtaattataaaaactcttcttctcttcagagatttgatgaatatccaacttcagtttttcaatagtttgttttaaaaaaatatttaagtatagtccagccaaatctgttttggtaaatgatgtgaggtgaggctctaaatgggttttccctcaaattactaaatatttattaaaataaaatttattgaataattgatcatcccctgtgatttgtgttgtactatccaggatttaaattttacagagagtacactacactctctctcgtcaaaagaaccagtttgaaatctaaaaatcaaaatacttcttaaaaatgcaaaatattgtgatattcatgtctaattcagggtatacatggcagatattttgaaataactctccaagtagagaaaaacattaaaatcactattgtaccaatttcagaatatgctttcaatgtctcctttgtagacagaaactttagactgccgtacaaatgacagggtagcttcagttgtgcaagatagttttcagcaacattatggagtcatactataggcatgaattattagcacaaatatttattaaataactagaaggatgttaatagtaatattattggtaatagtgtaaaaataaactaagcttcataaagaggaaactctctctaaaaaccaagcattacataacaattattaaaactgattttagaatgtcaataacctgaaaatattcatagaatattattaagttaaaacataaagtagttcataaaagagaaggtacagtatgacctcatattggtaagacaaaaaatatatagtgttttatgctcaaatgttattttttctatgtaaatcagaggaaaaatatttgaaatatctctaacacatcattatgaagatcacctaattttcttcatgtggatatagtatatatctacataaacacaccaggattaagtagctgcctgcagtagttcttaccttgattctaatttctaactatacatggacaatttgcattaggggaaattactttgaagaggttggatcaacagcataaaaacaccagattttactttcttaggatactgggtttttgttcaaacagtaaagtgaaactcaaacacaaacctcctgtcttcctttgtctgtgccattaacaaaattttgtgataaactttcaggaagcactcagcatcctctcaaacacaccccaaaacactataccattcatttctaagctaagcagaagaaaggcaaaaagtgcatcccaataaaaaaaccttggggtaaatggttatgttgaagtatccatgcagaatctcttgttgggttttttgccttgttcttaatgtacttcatggccactgtctggagttacggatcaactgatggccacaggaacaaggcactcagtataatttgtttggcctttaaaaattctgccctcataaaaactgtatttagtgtgattctgctatttttgtcattttgtatttgctgaccactagagacattgatagtattctattatgccaggtaaaatatcctgctcttagagcaaaatattttaagatagtggtggattaacagtgcaaaagaaaaaatgacgagtaaggctctggagttctctagagatactaaattttcctatggaaagagccctcacgaatgtgacaaagagaatgtatattttatttgggggatgtaggaaatctttttgcccagaaagctagtttttacccactgactaatacaaaacatgactaaaaagtaatctgagaaatcccacaagccacatgtgacaatcagtttcatcacgttatagtcacatctcatattccctttatctcatgctgtgccaatctcagaaagggccactggaattggaaacaataattgaagctttgaattcaatgccaaacagtaatgttaatattccattttgttagcattatagataagggtgatggtggggggtgaggaaagcttatatttttgtgaagtgtatggaaaactagtatgaaaggaaggactgttatggtgaagatggaatggaaaaaaaaagaacagtgtttcattttaagtgttagatttacgcataagtgatattaaaagtatttaatatcccatacagcacagaaaatccacaaattcagagtaggtgccagagctgccagtgtcttcaaggttgtctgctactaggcattaacatgccaaaggtggactgggagaggtctgggaagtcctggacagcgggtgagagcagccctgaaggtgggtgctactcagggatctcaggacagagactattttccagtcagtataaaaatatatcaatattttaacaactggaatgcatagaagaagctaaagttatttcagagaatttatttggggagttgtgcccaggatttcagattcccaagtattgttcagagcttagaatccaaatgtttttaattttgagagagttcttccaggaatttcttgctgtccctttttttgtgagtcccaggatcctcggactgacctttcagctgactttggttgctcatgcttcccggcacaagtcctaagagaggcaatttccattggcctattgaaatgattaacaagatcattttcatgttgctcctggtagaaacagctgtcaagatagtgaccttgtcctaggactgctggcctcctctgaatccctcctctaaggctgatggcttgtgcccacagccacctatcagtgcttctctttaagttcctgagcagctctaatagccatgctgagccccaaaatctgggcctgacttggaggaaacaccacttaccataggcacctttttaaattgttcattaaaggtgtcaaaacacacatttgttccatggacagaaaactccacttgccctaggaagatacactcactgacaggccctggtgtgtgatgctccccgccctgcgtccatgtgttctcattgttccattcccacctatgagtgagaacatgcggtgtttggttttctgtccttgtgaaagtttgcttagaatgatggttaacataaaattcctttaactttgtcagaaggaagaagtaggagaattgatctccagcaggcttccttaaacccgctaatggcttcacctacatttgtattttaacacatctgcccttatctaatatttggattttcatcttagtgttttgtttgtttgtttgttttgtcacttttgggagcagagatcgtttgtttctgagcatcatttgttttctacagaacatatgcctgatttaaccgtaaataacctgctctataaagtaagtttccacttattttctctctctctccctctctctttctcattttagatagagttttctctaccttgcccagactgaacttgaactctggggctcaaggtgatcctccagctcctgaggggctggtgattacaggtgcatgccaccatgctcagctcttatttgtctcattttttcttgggaagtttaactttaagccaccctaaatacgtctccatgatttttacggtcgataaaattgtttccatttttaatcaaattgaaaaaatattttattttaaaatgttttcctcaccaagcttttttaaattatttatttcttttttttttaaattatactttaagttctagggtacacgtgcacaacgtgcaggtttgttacacaggtatacatgtgccatgttggtttgttgcactcatcaactggtcatttacattaggtatttctcctaatgctatcccttccccagccccccacaccccgacaggccccggtgtgtgatgttccccgccctgtgtccatgtgttctcattgttcaatgcccacctatgagtgagaacatacagtgtttggttttctgtccttgtgatagtttgcttagaatgatggttaacataaaattcctttaactttgtcagaaggaagaagtaggagaattgatctccaggtgaggtaattttataaactgatgattacacaaaaagagaaagaaaggcggcacaagtattacacaaaaaggtagagataatgataaattctgttaaaattaatgtagggaaatgcaaatcactctgagaaaaatcatagtagaaatatttctgatagatcgatgggatctctttttaattgcttttcagttctcctattacttgtcttcctaggctttaaaactttaaaaataagcaaagaataggaatcattttccaaaagctttcaaaaatctgacattgattcattgatatacaacccattagcctagaatttcatctcttcatctatcatttcaattatcccctgatttctctggggcatttgataaatgggagaccatttacatttggtgcattaatgaccttggtacattttgaaaatgtgtcccctgcccccattatatatgtatgttttttaaagctacctactaggtcttcaagcatgctaagggacagaatgacatccatgtaactccattacttggacatcattaaaaaataaaattctgaaaatgtggtgtttccatgatgatatgatgttattacatctataaaaataagtaactatttaagggttaaaagatacctatagaaaaagaagcagaaggatattgttccaaataaatgtggacattttggttttcttccacttttgagtctactgcccaaagcattttatattagagttcgttacaaaacaaggtgtttttgttttagtggtgatttttttaatctatttttttttaccatggtgagaaatttgtttttctaaaatcctttgttggcttgcccccaaatgtacaacaaccaaaagccacattatatataagatatatagtaaatatattgtttatataaaatataaagtatatataaactatatatttatatataatatattaaatattttatattatataatacttaatgttaaatgtttacatatgttatatattgtgtgtatgtttctttcagggaggggagggtggtgtggtagaggggcacaccagtaggctgtgctctaccattactctagcagcctcagatgaagcagagatgctccaaatgaagctgtcacccggttttcttgaatataatttggtcatcaagatatttgaattggaaacactctggaagaaataagtgtctactatgaaggagctattgggcatttctactgcctttgagctcccaaagtttaaattttgtgagcaatagttaacagtctagttctttaagaatactatctctctacagaatactatctaactagtgtgagaccctggctttcaattttttttatattatttgaaacacaccaattatcttcattgaaaagaaatttatatttcttcaatgaacttatatcaaatatgaagaatcatttatgcttttgtctcttttcctggttttttgtctttgatttcctggttaattttgtgatgttgcttgccacatctttgataaaataaaattctgtaaaataagaataaacatatttttgttaaaggtgctttgaaattattaaataagagatttgagttgaacactttagagaattggtaaatcaacaacatttctgagaaacaaaagctattgatatttttctttgaatgtaatatttaagttcgtatctcaatgcaagcgaataattttagggctaaaatagtagcttacaggtcagttaattcaccatcttcactcccttgtagaaactgagatatttgaggtaagactgtgggataatatttattactagacaaaagtttctttataactttgtcaaaatccagaaggtaatggttggatttgacttgaggagaactcctgagtttcagctctgtttcccagctcttcaaggttacagtctagtctgttttgacagatggctcctttatgtccagggcctctgagcggacatgtgcaaacctggaatgcactagaaaaggtcaagtgttcattgcgatatagccctcaattgttatcttttcggatgacaaggatatattctatttatctatatatcttctggcacctaacacaatgtttagcacatacaaggcacttcataatttttgatgagtgaataaatgagtgaaagaatggctgaatgaatgaacactttgtttacttagaggttactagagccatttacaaatcatatgggaaatactcaggatgcagatagtaaagaaaaaaaaaaagactcaatgccagtgagccacagaaattaaagtcaagagagaaaattggaaatcatgagatttatttatgtgggaaattttaatttctgttcaggtaactcagatttacttctttggcttttctcttttgggacaggcgtcaccggagcaccagccaaatgtcgaagttgggaactgggttctttattgttaggcgtagactggtacaagcattttctgccagaagtatcagttgaaatctgggcccaaggggccagcctaggaaaagagaaaaggtgaggttcagctaccagaaaggagctgaacaaggagccaaaagagagaatccaggtcaagaacacaaaactaagattttaagttctgttagacacagggatcacagtaaagcagactgttaacaagcaaggaggaggaaaaggtaaagagtcctgaacagttgcctcaaatttcaacctattattttgtctcaattttctgaactcaccgatgaggtatgtggaaagatcaagcagagttgacaaatgttttcagacttgctactccactgatgagcagccttgaatttccaattgcatgctggactttctcccgagtgtttctttggcactgcatatttaacatatctaaaatgaaaaataacttcccttgtattttattgtcagaaaaaatagtccaagattggaaatgggtgaaaaagattatagggtgtctatcctttcagtggagcgctaagcatttctgaaagcttagaagttaagttgttagaaaactgatagccatgcaaatgattcctcttttgtcccattgagacagaattgatttctcctctatggaaaagatgatccaaatcactgtattgccttttacatgatatgaatcagcttggcatatattaggaaattatttcaggattcctgattatctatgtgtgtgtgtgtgtgtgtgtgtgtgtgtgtgtgtgtgtgtgtgtgtgttttactggtttgttaataagttgaataaaatctttaacatattcaatttgcaggagagtcatgtttttaactttttgaaaattatattaacatccttattaactattaatgtttccaccatcctaaacgcttggtaccattgaactttctacttctctggatctccattatataatcagtttccaagttaaatgctcttcacttcaatccctttttcactgttaatgagtcagtttgagtccctgctattttgcactaaggctgatccaatgatccaatactctccaaagtgatcttccaaatctgtctcccacaccattacactccaaactgaaaagccaaatctttccatttaaacctaggtcattgggacttttttggctcaaaaatctcatttgacttcctattaactaacaaatccagtccccaaatgccagcttcttaatagagatcccagttaccttcctaggcctatattcacttggattagtgagctagaggtgccgtaacaaactaacacagatggagtgtcttaaacaacagaaatttatttccttatgatctggaggctagaagtccaagatcaaactgctgggaggattgatttcttccaagggcctctctccttggcccatagatggtcatctctgtcagtgtcttcataggttcctccctctctgtctgtctgtctgtgtcatattctccctttctcataaggataccagtgaaattgggttaggacccacccatatcatctaattttgttttaattatctctttaaaggccgtatttctaaatacagtcatgttctaaaatactggggttaggacttcaaaatgtgaattttggaggaaaaaatttagcccataaaactcctaaagaaagaaaataaaaatacatgtttgttgaatgcataccatgagtcaagcactgcattttatactttcacataagttaaaaaatgattgattcatttttcctgaattatcccaatccagattttacttgtaatatatcacctcagctaagattccttccttgttaagaatcctggtgtcctcctctgagaggacacatttttcccttttacactactttcacattcttcctggtttgatgattattttgtactttattttttccaacaatgcattattaattccttgaagtcaaggccattaatgactcttagaatgcctgtgaagtatatgacctgttgttcagaatataaatatttgttaaataaagaactcaaaggaagaagggaaaagtttataaaagaaagaagggagtatgaccaaggttttttggcaaggggtggatgaggcaagggaaagaatcatgaaagatgttcgagaagaaccaaaattataaggctattaagtcagaggttagtaatatatcacatttggaacctagaggttctaagactctagactttttatcttttaattgatggtgttcttagtaaattatattccatttaaatagcttcacaccataaagataaatgttttaattctgacatcaaattattttagtattggtcctcatttccattctatcaccttgttttgaagatctgctttcagttagatcctttgtctttcacaatcagctggggtgtggcttaggaggacaacttaaatgtgttctgcaatttgccgatttggtctggtttttgaagcatgaaaagatttgaaggccccagctaatgtgtattacacatgccacaccccctcaactatgtctcagatttgtgagggtgtgatctataactccatctactgttggagtgctgggaagggaagagcatggtccctttaaataatatggaaggctggaagggaagtgctggggagaggaggacgtggtccctggttagggctccaaccccatgggcctaggtgaagacaggcacttctgccttccaacccaaatgttgcattttcccagagcaccctgacccgccaagcccccctcctgtgcctataaaaacctgagaccctagcaaggcagacagaagctgctggactgtgagagggacacattggcggaagaagacaagcggctggacattgagaggatgttgaggggagcacatagacagaagagcacactgaccaaccaacacaggcactctgccaggccatcaaggtgctggaagaggcagagtttggccaggagagctggggctgccgagtggcccaactccaggtgaagatcccctcccttctggctccccatcaggctgagagctacttccactcaataaaactttgcactcattctccaagcctatgtgtgatccaattcttctggtaaaccaaggcaagaaactccgggatacagaatccctctgtccttgtgataaggaaggggttctaattgagctggttaacacaagctgcctatagatggccaactaaaagagcaccctgtaacacacgcccactggggcttcagctgcaaacattcactcctagacactgctgtggggtggaagccccatgacctgcccgtatgtatgcttccctagaggtttgagcagcctggcactgaagaagcaagccactcccccatcgcacgccctgccagggggacaagggaacctttcccatttcactgtcaccagactgtgatattttttgctgtgaaaattcccaagacaaatttgtttctgtggcacatttaccattgtaacatggagctatagatatgatggcttcagacatatcagccttagcactttattatttttttcaagtcttaggctgctgtgaaatttttagaagtttctgtttccctggattatttttaaaaacatcaaatcattcctttaatagagtatattattattcagatcttttctgaaggaaagtttcatctgatttctaaatttaacggtatgcccttatctcaaaatttcagtcaccatccacttaccatgtacttttttcgttattgaagcattccagatgcttcctttttgaaaaagaaaaaaggactaaatttaacggtatgtacagagactattgtgtgtgtgtcttgggaggagtataaatatgagctcccattaaagtaagatcttctaaattgagaattgtaagttgtttttatgcttccgttcgtgtggctctgtgctgtgtctgaggaacataggaatgaagaagacattgtgttggctcacaggacgtctatagtcacctgaggaaagatacaaataaccaagtatgagttaactagtggtttccaacaaggaacgactgtacccccaggagacatttgccagtcgagatggggatttacagcaggaagttagatatataaatataaagattagcagagcactgggctaaagatatatatatatatggtagtaataacacaatagttcttgaaatcaaaagactgataaaattatccagcaagagtgtgtgggtgatgaggacactagatgagggacacctgcaatcaaaaggatggacacaaaggaataccaaagataactgaataaaataataataatattgaacattttgtagaacccatactatttttaaaaagttctcctaagcacttatatgaatgctcataattagcctgttattgtcagcgtttttgtataatgattgaagcaggaatcaacagtatcaaatgcaacagagacatcattacaatgagtactaaaagtgtccatagatctggcaattaggaggtcattggaagccagagcccagtgggtagaaaagtaaaatgttgatgggcaagtagagaagtttaagccaaaaaagtttggattaaaaggaaaggaaaagaaaataaatgaccatgttataatgggaacaaactaaaaagaggtcatgtttttcatggtggaagacatggaagaatgtaagaggagcagccatcgtttatacacctcgaggaaaccgaagaagatgccttatcaactctgagaggactgggaagtttgacaaaccaggacaggcaaagagacataagaggtcatgcttgggcctcaactgaaattggacactacttgctctgtccgtcagtccaacaactcctttttgaaatctctctcctgataagttggacttatctgaactatgctttcaggaggacttttgcctgtctcatcttcctcacttatcaggacaacattctacaaaaccaaatcacagaaacagtaatactattatctgcctcctttactcctaaaacccagggaattcaatgaccagtgaaaaactgcacactgtgggacacacacaggctatcctgagacatgagggttccccaaatgagtgttacagaatttgctaattctttgtggttgttttagcagagcatgtaaatgcatattgaacacttttttccattaatgcaatgcttatatggaagaatatttttccttcgctgaacattttcctacttctgtatcttagtctgataaaaatatgttttccatattatttctagtctctatcatttattcaactacaaatactgaatatctactatatactaggtgctggtttgtcagatgcacacacgctgtgacactagaagagctcacagtctataggtaaaacagatagattaatagctatttaaaatggaaaagtataagtgatttaatagatatagtaaatgattgtgtaagctaatgcagtaagtaactataccctccctcccccataaaataagttttcttctcaaatactgactcactttcattttttcaaatggattgtcaagaatagaaacaccccattctctttgcttgatgaattttttttcctgtttctttctctcttttctctttggttctcaccctgccaattctctgcaggtgctccttttatattctgaaatcccagttaagggactttctcactgattataatgacataggtctgttttcacagctgtaattttaaagtttcttaataatgcaatgttttaaacattattctgaaatgctagaaggtttcagggtgctcaaaaagtaaacaggctcgtataaaaagaagggaacagttataataaaaaattcaacaatttgtatcagatcattggcacttcattgaaaatctcaagctcttgagacaacaaaattttcccccaaggggaactaattcactagacatgtgtatacattagaaccagatgaaggtgatgcagtgaaattggaaagacaattcctgggcttattagaagctggagaccaagtatttgtatgtctactgacttctttggccttggcaagaatcgttttcccaggagagcagatttggggaatttgcatttatgttcatgatcacctttgacatctgaaactctgaggacttgacaccgagtattactattattataaacagagctcccaagctgttaagctcaaactgctactttggtgttaacaagaatgggtgccacatggtgtgcatatgctgtttgtgaaagtaaatgatgctttaagagtgttttactctcaaaaggaagtctactaggcagatagcttgtattgaaactctgtatatgttctcatttgaccatcataaacaatgtttaaagagccaaggttgttacttgagaataaatcagggagctctggaacatttgggtggatatattcactacaaagcattagagacatttccccctatgtttatccttttaaaaatgtatgtatttcacttcaggtctcgatagatctttcagattgtatcttaatagagcttcctcagcacagaagtgatttatttctttcaatggaggatttacttgaatctactatttaggaatttagcataactgggtatagaattcctttaccttggatagactaaaaaactcccaagactgatttaaaacaatttaaatgttgaataatgctatttccctatgcgtttgctttgtgagttaaactgatgaagatttaatcttctttttcacagtttcttttgtctataaaactaaagatccatttttataaaagatttttctttactttgttttagaaagagatttgatatctgaatggtagtggtaatgaaattctctgtgggttaggctttgaggaagaaatactaacgtgaaattaatgaaatattaacaaataaattgagttcataatggtaaccatttccctatgttatatgtgataacatataacttatgtatacgtagttttgagctttgcatctgatcactcttagccaacaaatcttttctaaaaataaggcaactggggaaacctataataaataacttagcaaaatgaggcgatgaacttttcagctaccataagccttttctccccctttaagtaatgtattttatcaggactgaaattctaatgtatgataacctgaaatttgagtttaaaaatgaacacaactgaaatataataaggcatttttcatctcttttaatattttatatattctcattcttcatgagaaatggctgcagcacgcaagctgccaggttaatcttgcttaaatttggcaatcaacaagtaactttgtgcacaaactgttggagtaccatgcaaggcaagcaaaggagtttagatttgatgcaataatagagggagagctatcgacagagcaagagaataataagatgcaaatgccttttaaggacaattagtctggaaaccaagaaaaaaatgggcttggcggaatgaaaacatacagacaaagagacagcatttgtatcatgtgaagaatctggcatcaactcagaagccttctttttcacctggcgtgattcaaagtaaattacagtgaagaaaaggccattaggctcacaataaggagacttggtaacttgaagaatgtatttttaaaagtatggaaatagctgtcaacatgaggggactttgaaaaggaagttactggggatataaatagatgtaatgggtataaggaatgaagcctgaggcaggaaacagaaaaataatttttaaaaagttgccagaggaagaagcaacattatttccagtttttagaaaagacatgagcaattcactacaagagttatacacaatgaagatgagtatgtttcaataattaaattagtgactttggggaaaaattcaaattgctgagtagagatcctaaaaagtccattccctaaccagttaacttctaagcctagataattcactattaaatatttaggcatatcttatattttgggattcagcaaatggttcgatttcctatgataaattttgtaaatgtgtttactttcccaagtgacagatatttcacaagggccataagagaggtaaatggggagattctttggtttccctttttaaaggcaggaagcagccagttcttggtttgcataaagaaactggaagaaaagcacagagataaaatagaaatgttcactaatattttcatgagtcaagttttatagccacagctgtctccagcaggaatggaatttacagtgtcaatgggtattagaaagagatgggctggaggaagaagattggaaggatgggcacttagcatgtatgcagaagtgaactaatctgcctacatagcaggagctgaattttataccaaaactttctctgcaattataaaaggctttagatgtttagtttcaaagacatgcaggttgaccagcagtttaaagagttgtgagctactggataatgatctcaatccaactactttcctttgcccaaatagaattcttcaaccatcagcagtaattagttggcttttagcttttgggcaccagacaatggatcgtgatccatagtggctatcatgtgggagatgaggctgcaggtgaaaggtgaaaggaacttttcacttcccaagcttccaaaaagcaagtgtcttctcctatttttagcctgctatattaatactatatgtgtgtgtttatatgtgtaggtgtatgttctaagtcacatttctcttggttacttgctcctttttactgaagatcatttacatttggatctatcatatgccaattctagttaattatgtttatgaaagatcctggtcttagttaatgaaagattaagaacagtgtctattttttccttttattatggatctttactcttactgaaattttctgttttaaaagtcaaaataaaatttagcttataaacagtttagaaagtttatttttctagtcttttctagttatggaaaatgtaatatttgaaagacaagtatctataacaaatcaaattgatgtttaaacacaaaagatacatttgccaaattgcttctcctccctgatgctactttagggacatataaaacaagaaatggaaattaatttttatcatgtgcatgtcggtttccctttctctgaaattcactgatttctttcaaatttgaacactccagcttttatctcttctggtcttcagtgctagactcccccagcttttctccagttctattgttgtgacagtatcacaatttactttcttcattttgaggatttgtttgtgttgttattcctattttttgtgaaaggaaaataaatcttggggccccaaaatcactaagctaaagggaaagtcaagctgggaactgcttagggtaaacctgcctcctgatctattcagagtcacacctctgctaactgagataaatgcatagctaattgcctctttggagaggctaatcagaaactcaaaagaatgcaactatttgtctcttacctatgtatgacctggaagccccctccccacttttagttgttccaccttggcttggagttgtcctgcctttctggactgaactaatgttcatcttacatatgatgattaatgtctcatgtctccctaaaatgtataaaaccaaactgtgctctgaccaccgtgggcatatgtcagtcatcaggatctcctgatgctgagtcacgggcacacatcctcaaccttggcaaaataaagtttctaaattaactgagacctgtctcagatcctcagggttcacactgccctgtactttatgggaagcaagccagcaagtccccttagtagttgatcgtaaccttggcctgcaatatcatgatcagcaaatgatgcatcattaggtgtcttcgactgagagaggagcaattaccccatgacagcaggatcagagaaatcagactgatcaggataaagaacataacaaacagttgggagaacatgaaagaatatatacatacacagcataaaaaatgtaagtgcagttaaaatatcattacactaagaatctaaagaattactgggtttcagctctgccatttctgcttaccaattcagtgaccatgagcaaatgacaacttcactgagctacattttccattttgaaacatgtagaccctaaagtctgccaggattatggtaaagaaagcatgagtccttatgcaaagcatgtgttgaatactattcactcttaaaaccatattatgctggaactgtgaaagagaactaaagctggctgaaggagggccatagggaatctgattttgtttccttcctccctgtatagttcaggctttgcaaagtagtttggtttaaaatctaggtgctattttctagacagagtaacaatttctgtttactgcttttattggccaggccttgcctcccaatccagacacccagttctcattcgctctttaaataacagattatttcaggaaacaaagttatttttctctaccttggaggtggtcatggtggtgttcttgcccttgctcatcttctaagttaaatacagttacccagcccaacacatcctcctgatgacctcatgctgaacctacttttgagcattgttctctgggctagcaatcatctccagccttctcaaagtgtcaaggcagcgaaacttggggttcaagaaggttctcaagttattgaaagaatgttcttcacatgtaatgggttggttctgaaggtggcatagtaggttttgccccatttttctttcatgtatgccatatttctgcagctaaaggtgagagtattgaaaaacattaacataaaactgagagctttgatttttatcttcatgtttaaacatctaagggataacagtaaagtaagtatggattactatagaagactcttgtacatttcagttgccatttctgcacaataatttataccaactcttaaactacaaaacttgtttgttcctttattaatttatcagctagcaaaatatgtacttgctgtgacactagttaaattattcacagaggcacatgttctattaggccctttttttctggggcccattctggtgattttaagaagccaagataggtggcttgaagattttgacttttgcataaacattgtaagagctcattcattctcagtgctgttcctgaaacttcatcatttctccctttgtgaatattatttgatatctgatcgtctttgaaaaaacagttttctttgggccccttagctcaccagtgtcctctgaaacaacctggtttccttggcatctccccctcaccctaatttctctctacttgttgcctcgtatccagcaacctccaacttattgatttggcttgatttaattgggagcgccccatacccaggacaggttttcccagtggcagctgggagtatgaatctaataggcctggtttggttctgtgaccctctgtcgcccctttctggccatagcctgtcactgaagtttaccctctggacttgataatacagacagcagccgtagtacagaacagtttgcaaactatcagcctgtgtgccaaatcagcccaaagaatgctttgtttggttcgtataaattatgccaacatttaaaaattagcagacatattagtccattttatgttgctgtaaaggaatacctgaggctgggtaatttataaagaagaggtttattttggctcacagctctgcaggcgatacaagaagcgtggtgccagcgtgtgtttctggtgaaagcctcaggaagcttacaatcactgcagaaggccaaagggagcaagcatatcacatggtgagagaaggagcaagagagagaagggagggatcccagattcttttaaacaaccagctctcacatgaactgccagagcaagaactcactcattaccaacgagatgccaccaagccattcataatggatctaccctcatgacccagacaccacccactaggcccatatccaacattggaggtcacattgcaacatgagaattggagggtatacacatccaaattatatctagagatttcagggccaggtgtggtggctcacgcctgtaatcctagccctttgagaggctgagacaggaggattacttgaggccaggagttcaagtccagcctgggcaacatagcaagaacttatcttcacttaaaaaaaaagtcagatgtggtggtgcttctgtagtcccacctattcaggaggctgaggtgggggaactgcttgagctctggagatgaggctgcagtgagccatgattgtgccactgcactccaggctgggcaacagagcaaggtcctgtttttttaaaaaaaagagattttatataaaatttacagcttctcttaacatagcagaagatctgacaatcttaggccagctttcttcttgtggacaatcttactcttgcccaccactcatggtgtagactggtcatttgcatctagtgcctgcttcactcatttctgttgactgccttgtcccaacaggcatttggactcccaggtcaagtacaaaagtttattcaaatagatgtggtttatttgtgtgtcttggggaggaagaatgatatctaatttcttttatgaatatgctcacaaaaaggaattagaaatcagattgagattctttagtacatgaaggtgaaaattgggtatgttttcttcccatttacaatatatttgtaccaagattcactttttatcaaagagaaacttttctgcagtttaaattgtaggatgatggagttctgaatatcttaggtaacattattatatggatgaatatatttgcattctatcaggttgaatatagaaaaatcattatatacagatgttaaagaaactatacaaagtactaatgtataaggagtgtgtgtgtgtgtaaccgtctaatgattcatgttttttctcttttttattatacttaagtggagtttccagggcaaacacaggtatacagtcataatgataaattatgtagtttaattcagcttcaccaatgataactcagatgccattttcaaatgcattgtgagaacggttttttcacgtttgcttctaattccagcaaaaacacctaattatagaacaacagtagcaaaaaataaattttgctcagggaaaaaggttttatgagtaatcagtgcaaagcagaaatctcttgctgcgaataatgtgggccagctaaggtttctgtgaggttttttgctttggcgtggtttggctttgtactgcctgggtgacctcttcttctcatccatcacttcatcagaaaatcaaaagacagcaagctcctagccagactcttgttcaagataaactctatgacctcctaacaggttactagatcttttatgggagttcagctgaccacatgacttcttatatttgagaacttattcatgagccagcaaagctctggctaatgtcacagaacttgacagcactagtgctgttcatggcttcatctttagacatagctattctatcctgttccctttcagaaactcaaatgaagggccgcgtcttataatcaaacatttcagataaaacagcttatttttccctgagagcatatgtgtcttctattaatcctaatcaactagggacagactgaaaagaacactctaataaggtaatagtactgagtattttgctgtgacatcccacaaaaatgagttttctgtgggatttggggaggaggtaaaaaaatgaccaagaaaaaaaagaccttcaagaattaaatggcttagagataaagcatataaaataggaatgcttttattgcttttgtattttctgaggacaattctgccagtgaatccacaaaattgtataaatacaaatatatcacatttgcctgctgtgattaaatttctctgattacacaactatacttgatacacgggaccaatgcatcattttttttttccttttgtaatcattgttatatccacgcttataatcaacattcatcacagctaattagagtttctttgtctgttgtttctgagatctgacattcctagagttcaactacaaaattcatttttaaccatctctctgcttggggagttggaggaagacaaatgcaaattccagggctgtattattcacgaatggctttctgaaattttcatgtactatgatttttttaattgaatttaaatgattactcttggagccggagaccaagtcctgcttaaaattttgcaggacactcctatgatttgtaggtacattcctattggtaaaagaagctggcagtctttcttgttaaagattttgtagatttatatagatatcaaaggatatatatttttgttgcattagattgacattaatttctaaaaataaaatgctacagatttacatcacttaccagttcaaagcttttgttcactctcaaatgctgttttcttctagcaaatgtttttaattatgcacactttaaatgtgaaattacagtaataagaaagctagttaaactttagctagtctattacaaacaaatttaatctactttctagatgttaatttgagaccagagttttccaactcacagctctgttgtctcacctggaaattccatctcctttattaaaacaactgtaacctttaaagctttgatagaagaataaacctaactgaaaatgagtcactatggtatacatcctaccttctttattttgtgttgttctactttgttttcacaattttctttaatttgcatttttgttgctgctgtttatgtccatactgtggactgagtcattcccaaataaacaaaccaatattactgagtaaccatttcagttcctgctcttgataagttcacagtactctgaaggatgtaggtatgtgaacacataattaaaataaaactggaaaaggtctattagaaaagacataaagcaatggtaagtttgaagagaaaatgaaaaatcagagagtagtggtggggggctttatagaagaggtgatatttattctgagacttggagacattaatggtagttaaaggttatgaggtggcattctgtgtcaggcaaggttctaagcaattaaactgtagtaattattttaaacctcaagaaaatcctatgaagtgctatatattacgcccattttatagatgaggaaatggaggcatagaaaagttaggtaacttgaccaagctctctgtgccatattttattttccaaaaatggctgtaacaatctctctctctatttaaattcttctcaaaccttgccattaccacagtaaaaggggaggtctaggtcttctgcttgaattgtattggtttgggactggcatgaaacctacagaatgtgtcagaaatgacaagaagtcacttcaatggctagatcaggaaagaagatacaacatccaccttaatcactggaatactgctggagccccaagctgctatgcttggagcaagcccaaagtagcctaaatgagaagccaccaggggaagctagagattgagagagagagagagagagagagagagcgagaaagagtaagtgagtgagtctgggtagccctcaaaagctctaattcctcactgcccttccagctccagccactgattacaactgcatgagagttctggagccagtaagtactgcctagcccagcctgtcccaatgtcctgacccacagaaacagtaagataacaaaataatcattgttttcagtcaccacatattggggtgatttgttgcagagcaatatcaacagaaacagttacacagttaataagtgggaaagccaaaatttgaacccactctgactccagagctcctctcctactcctatgccagaaaacaagtcttaagaagatttatggatattccttcaggtttaagtaaaaaccttcatgttacatgaatgtgtgtaaaaatcacttcttgaaatcaatattcagaggcacagaaaatgtttttgcatagtgagctcttccttttatgattgaaaattaaatgaagtaagaataagagaatgtttaataggctcataaacatgtcagttgtcacaattgcaaaagctgactgtccagtgattgggtagatatatattgcatcatctgggtaatgacttcaaccatattaaaataatatggctgtttagatagggaggggaaacaataattttttttaatgaggggcaataatttctaaatatgtagcttggagtagggaagactaaagctactgtggagccagaaagcttggatttaatgattttgaattttaatattgcatttgcttggtttacagcaactcgttgaattgtatataccacactagccagtaagcttacttagcatgagaatgagggcttatcttttataataatagtgaggttgatccttggataacctgggtccagcatgaagatgttttataaatatttactaagtgaaggaatgactataatctcttagaccctaagttttcttatttataaaatgtaactcactagttgagtttgcttgtcataccttagaccaggaaagtttccaggacataaagagtcttgtacttcataaataaatgaatttaaaatgtatctccttgacatgttgaaggatagataaatgtcatgtttaaaacaaatattattcgcactaatgtgacatctgttcctaccattgtcttctaatgatgcatgaatgaaggaggatttgagaattcagctgaaagatagatttaggacatctccttttacttcaggctatagaggctcatgtgattttttttttaatgctcttgtgggatacaagtttctcaattatggctaccacaattggaaaagttatattccactattattaataataagacctactctacctccctgatgtgtgaagttcaaatgaaaccctaaatgtgaaaatatgaagcaaatatacaaattttgattatgtgaaacaatatataattggtaattgtaattattcattataactaatttgtgttattgataaggtaaggaaaatatagaccacaagagctaattgaatttatgtcatcagatttctgctagttgtgttgtaaatttgtgcctgtgactttttgcctttatggagaaaagctgagaattcactgcgactgtacattcttcaaacatgcaaccttccaccacatcacacagtggacccagcttttggagctacttaatgagaattatttataaagttcatgaggaatttgaattaaaggcaattttccttgaaaaatgatatggtttggctgtgttcccacccaaatttcatcttgaattcccaggtgttgtgggagggacccggtgagatgtaattgaacatgggggcaagtctttcccgtgctgctctcgtgatagtgaataagtctcacgagatctgatgactttataaagaggagttcccctacacaagctctctctctttgcccaccaccatccgtgtaagacgtcacttgctcctccttctgccatgattgtgaggcctccccagctacgtggaactctaagtccattaaacctttcttcctgtataaattgcccagtctcgggtatgtctttatcagcagcatgaaaacggactaatacagaaagcttccttgctatgaattagacaaaaagaaaacaaaaaaaggaagagagagaacaagtttcatatgtaactaacatttgggaaacaatgataacagtattaatgtcatacttattgagtccttactttaagactgttcattcaacatgtaataattcatttaatcttcacaacaacttatggagtaggtatgatttctattacactcattttacagatgaagaaactgaagaataaaaagaataagtgaattatccaagtaaatacagaatgtcagtttcagatgcagtccaaaccccatagccctgagcatgtcacaatagttagtatgtgattattaatttaactgaaaatttcagttaaaaatagcttaaaaaacaccccaaatattttaaatataacctaattattaacagataaagactacagtaagaaggtaaatcattttagagttaatttactgatttgttacaagtctagtgagagatgacatatgcttcaagtcaacataactttagttttagtgtttttatcaccttttgaaaagtactttaaaaataattttatctttagaaatgttggcttcattttgtggctacgttatcatataatagctcagttttcaatattctggtttcacttatttaaagtagccatagtttaatgtaagtttctttcctaccgaaatgtgacttgattttttccataacaccctttattaggtgaatttctgctgcaactcttttaaaagtccactagtagaaatatgaaagaaaaaatataaagcatttgtgtttagtacctgtgagtgcacttatgctgggtttcaaaatttacaaggtattttcataggtagtatcacagttgtatttcttaatatttctatgaagtatcatcatcctctttttcaaatgagtaagaggaggttcacaatagtgaagtgaattgcacagaatctcacagaagtggtagaactagaattcaaacctatatcttcagtgcctgaagttcaacattctgttgcctggtaactatgattgtccattcctcctttctttatctccactatcaatgatgaatagtataaggaggaagttggttgagccttaggagactcatgaaggtcaagatttttcttttttgaggctctcagtttgtccctagtgactaagaataaaacaacttactcaggtcttgaaatggaactgcatatacatcattttaagtaaaatcctaaaattaaaaccatttataacagttattccattagtattatctaaattcttcagaacagataatatatttattatacttcatgtataattttatattctaaacaatgagagcataaagaccaaaacattgtttaaatgcacttcccaattatttgtgggcatatatgaattttctagagatgttgattaatgccatagctcactttaacctacagagaattacattaagcctgagacctaaagagaaattgactggttgaaaagctaattgcaacaaaaagcttaggtcatcacttcatgaagtctattgatttgaaaatgactatgatacataagatgtgtttgcactttttggataattttcacaaagcaaatacacccaatctttttttaaaaaaataagcaaaaatatacatgctaaattgaatcaaatatatttggtttggagaaggatgtgaattaaattgaaactcttctccttttgcctcttcattttatgttgtgccacctctgttctgtttatttgacacatccctgaaagcagtataagctatcactaaaattgtataaccacagactaaatggatcacacaacttaaaatagaagtctgttttaggaaaatgatcaaatattaaggatcccaaatccacacatttttttaaaaataaaaattaataacttatttgtgtagctaatttaaacagaacttttatgtgtttgcagctctattgtgttttttgtcctacaagcagaaatgcaacactgctcttacaaacatcatatttaattgttgaagagactgcagtatgccattacagatggattgatagccttgatgatatcattgaacttttgtcgtgcctaacctggaagacttgctataagccagaaaatttttgtcattcattttgcttctgaaaggccagatttatttacaatcttgaatgacattggacacatgcacgtgaaacagcctgaaatctatcatgcagtgaatatcttataaaactgctacttaaaatactaagtattgacctggttttcagaaccatcttcaaagtcaacgactttcaatttgtttacttataaacactgattttcagtggatagtaacaactttgtattttcattctttttttttccttgagtaaccagaggccaccaaacatgcaccatgttttcctatttttttaaattaagtgagaaacaacagaatgagaaatgcatgtatatgtctgttatttattaatatcaatatgtaactgattagtgaaaatatactagtaatagagtttatctttgggtggattattcagtgaattttttaaaaatctcagcttatacttacatgcagcaaaattgcatagtaatagtgctgtcagtgaaaaagcaagattgtttttgagctttctgtgttttggagcaaaaatgtggcatatgttactatgaacttgtaattccatccatattaaaactgaatttatgttcagtacaaattaaataagaaagcaattgagcaccttctgtgaaccaggtttgaattttcaagcatgtgataacaatagctagtgtttagctaataattataatactaaaatctactgcttatagagtttatgctagaaacggtgctaagcattttaaaagaattatctaatttgattctcacaatagccttatgaagtagttattttgtttctccttactatagagatgacaaaattaagatttataaagttagggactaatatttcataaaggagtttactttgtgctcatttgtgctgtagtagatcaagacctaattaagccatattaaagccattccatttggaattgtcacctatccagggaagctgcctgcctgttaaatttagttttcttgaaagggtttaattttaaatttttatttttatagatttggttaatacaagtatagttttgttacatggatatattgcttagtggtgaagtctgaacttttagtgcacccattgcccaaatcatgaacattgtacctgacaggtaacttttccatccccataccactcctatccccactcccaccttttggagtctccagtttctatttttctactctgtatgttcatgtgtgctcagcatttagctcccacttataagtgagaacatgcagtatttgactttctgtttctgagttattttgctcaggataatagcctccattttcatccatgttgttgcaagggacatgatttcaatgtttagctcccacttattagtgagaacattgcagtatttgactttctgtttctgagttatttcactcaggatattagcctccattttcatccatgttgttgcaagggacatgatttcgttctttttttatgactgaatagtactttatggtatatatacaacattttctttatccagtcattcattagatggatactaaggttgattccatgtctttgctattgtgaatagtgctgcaacaaacatacaagtgcaggtgtctttttaatatagtggcttattttcctttgagtggcagaattgaagtcgttctacttttagttctttgagaaatcagtgttttccctagtcgttgtactaatttacattctcaccaacaatgtataggccttcccttttctctgcaccctaaccaacgtttgttgatttttgactttttaatagtagctattcttactgctataagatggcatctcattttggttttagtttgcatttctctgatgattaatgatgttgaacattttttcatatgtttgttggctgcttatatctctgtttttgaaaatagtctgttcatgttttttgcccactttttaatggggttatttgtttgtttgttttcttgttgagttgtttgagtctggatattagtccttttctggatgcatagtttgcaaatattttctcccattctgtaaactgtttactctgttgattatttcttttgctgtgcagaagctttttggtttaatgaagttcaatttgtctacttttgtttttgttgcatttacttttgaggatttagtcataaatcctttcccagtccaatgtccaaaagagtttttcctcagttttctggtatggacgtgtgacatcctttcttttcatcacactttcagtgtataagtgtgggttgagtattcaggggaatacatgatctcttctataacttccactaacggtattctataatgctgtcattataatttgaatgtgaagagttcttctgatcggaagccttcatgtgcattgctgttttgtcaggcatggagcaatcaactgatagattgatacaactttggctgtagaaattgactaaatagaatactgacgttccatatcatggagtagctttaagctctttagaaagcaactcaacaagcaacatcttgaagatcattcattttagaaaaccacactacatattttaaaattcaggtgaatacagattttgtaccaaaagtgataaaattgtgcaccatggcagaaagtctataaaaaggaaagatggtagtatgaaactttaggaaatgtttgttttatttgttgtgcaatttttcctgaaagtatgcttattgcaaagaagttggggaaacaggcaaatacagaacaacaaaacaaaaaccattcttagtcgtttttttttggcggaggggggctggggaatggagtcttgctctgtcacccaggctggagtgcagtggcatgatcttggcacactgtaacctccccctcctgggttcaagtgattctcctgcctcagcctcccaagtagctgggattataggcatacaccaccatgcccacctaatttttgtatttttagtaaaggtggggtttcatcatgttgcccaggctggtctctaactccttgtctcaagtgatccacccaccttggcatctcaaaagtgctgggattacaggcgtgagccaccgtgcctgaccagtcttttcaaatgaacatagtcactgttagcatatttgactatctcttttcattttttttccaaaaatatatattgatagataagcagatacatatggaatcaccatcgtaaatgtaaatataagtaataaacacatctttaatatgtcaagacattggcagaggtaaataaatattactttagaatgtgactaattgttaattatggtataatggttctttggatgtgtcataatctacttaaaattcgactgatatttagatagctcctatttttttctgtgatattaaaaatacataaatcattatgcacattgtgattatatccttaagatatgttcttgagactgggtgtggttgctcacgcctgtaatcctagcactttgggaggccaaggcgggcagatcatctgaggtcaggagttcgagaccagcctggccaacatggcaaaaccctgtctctgctaaaactacaaaaattcgctgggtgtggtggtggtcacctgtaatcccagttacttgggagcctgaggcagggagaatcacttgaactgggaggcggaggttgcagtgagctgagattgcatcattgcactactccagcctgggcgacagagcgaaactctgtctcaaaaataaataaataaattaattaattaaaataaataaataaatatatattttcttgaaagtagaattgctgcagagaaaagtatatgcatattctgatatttgtaaccacttgaatttcagaaactgttcctactttgtgctcctgttagcaaagtatggtatggcctttttgccacacctttactgcctttacagcagcactgattttcatctttataaatttcatagagaattaataggattaattttattttggttttacttttttacctaccaataagattcaacagcatttgacatcttttttacatttttatttctgactttttaaatcaatttatttccttttattagactcaatttctgtttgtgaatgtttaccttttccttatatacatatagttaatataaatcttacatatgtgtgtatagatatatatgtatagatatatatgatatgtacccttcaccttatgtgtgtcaatattgttttcttcatttcttatttatctttgagttttggtcactctgaataatagagtctaaagtttacatgggaagtttatcagcctttccatttatgctttttaaccatggtgttattctagctccaaaaatgtaaaaaatatttttaaagtatccatagctattttatattttactaaaattccatctaagcagaaaggatattttaagtcctttttaatgttatttttatttactaattattttgaccaacaaaaccactaattgtcttttatttcttaacatctgccaatgtctgtccgatcttacagtttgatttgataatggccaaatttaatttgatatttgacatttgttaataatgtgcataattgttaggtttaaggtaaatagacatatgtggaaagggacacttatacatgatattcattattttaatgtatctttattgataattttctctaatattatctcacagagatacagttgttcacattccttatgagtaaaaggctttgctttcaattctcccataccagatatgacagcctaaggaagaaattttcaaatattttcatcaatcaaactgaccactttattcaaacaaattctaaattgagagctatccaatatgtaaaacacattaaagcagtttttcacttactgaattggttatatgctagggtgggcctctgtctcacactacactctgtctctgtctaggcactccctgagacagctctttgaatccttaaggatatgaagcgcagtctttcagctcggaagagtaaaagtcagatccagtcaaataaatgagtcaggttgctcagtatgatggaataagttgtggaaaaaactggtggacatagtaaacatgtatttgatccaaaagtataaattagtttctgaagcccttttcaggactatgaaaacccgacattacttttgttttaaaatttctgtatttatttcaggtaaagccaggcagaagcaatttgactggactatattaacctagctgtccattaaagtaattttgccatagtatgttgttatattaggtcttatgttttagtaaaggtcaccattatttaaaaaaaaaataaattaggaaatatttcacattttttgaaaaacctcttttggagactttgtcattgttttatccaatgacccttatattcaaaactcatgtaagatattcctatggaatttaatgtccataaagtctgtccctcctgaaaaacaaatatttccttttcaacagtcatggaaaattatataacttcttgttttattctctttttaaaattacctatcagaaatctcagacctatttttttaaaataatgatggcacaagcaatattataacaacaaaaatgaagactttaaatgacataactctaccattgttctagatcaaattatttatttcttaaagcttttcagattttctccataagaataggtagcttttgtagttgcaactaaaacacagaaacaatttgtaatccatttcaggaaaacggtttctcatattgttgcataagtcattgcaattataattttaataactgcgttcaagtaatacgtttaacttacttggttatttccgtattggtgaacatttaaattgttaccaatgtttttgcttgatgtgtgtgtgtgtgtgtgtgtgtgtgtgtgtgtgttcttcactttccttttaatgacaatacttttttgaataacttcatatgatcttgtcagttcattatgaggcctgcatgatattatgtatggaaggtatctaacatagtttaattgctttggactatatctttggataaattcttaagagtggagatatggattcctgaaactgggcttattccaacacctgtccccttctttaacaaactaagtttaaaaaataatatctaaacttgtatgtaaacttatactccaatttcccttaggtaatcagcctttattgatctttctctctatgatattctgcagcacaaagcataggacttaattataaagccatatattctttgttaattactacacgtttattagtcatgaatgcctggcttcttgacagaatcaggtgtaagcaaaataaacaagcacataaagtttcagttaatggaattttctttggaatattgtaatggaaagtaaagaggatcaagaaatagtgtgactaggccttctctttctggctatgatgggataagtagtagcagaccaattatcttgctgacaacaactagaaatgttgtatgtaatattaaaaaaaccacacatctgaagatattagagaatattgtggcagccaggaaagccactgaggtgagctttcttatcaagggattgattcatgagtgacacagtgaaaaaggctgaaaaggtaggaagaaagtggctgctagtaggaagaaaaggtatgttgaacagtcagcagtcccagcaggctggggagacataaactgaaattcagaattaccagagaagccaaaatctgaaggatcaagatactggagaaaaggtgtaccagtgagaatccataagagacagaaaccacaaattgatttggtcagagaaaaaaatactatgaagaattatgaattagaactaaagataaagtactaaaaggggtaaacagaatgttgaagaatataggaatagcatatgtagaaagtggccaccatgtctaggactggaggagagtacccaagagtgaaacaaacttggaagcatcctgtcaattccctggccaggttgaaagtcaaatctcactggaaagggtatggctatggctcactggatggcaggaaagttttctgaaatgctgctgctcagggatgatgggcaggaacatgtccactggggtggcactgaaattcactgggaagctgcctactggaggactggtaaaacttgcttaatggtattcacttctaggttttttgtataccactggcaaaatagctgctcactggtgaagaagctacccattgacaagaaagtggccagctggcagccacaatgcacaagcctgaaaaacaaattatattgatactacagtgagagttttcttcctcttgcagttttcctccagagccctctgctaagaaggctcaacaagaagctggcaagggagaaatatttacagggtccagctcctgtatttatcataaagcaagacagagaagagtggaattataaaaacaagaaaagctgtgacaagatggaaatttttactggagaagtaggatttataaaagaatcaactgcaaatagttgaaatgaaaaaggaaataactttaatagcaaatgtaatagatgggattaatggcatattataaacaacttattatggaattgacaacctgaaaggtcagtaggctatctctactgaagcaaacaacaaaaaataataaaatataatagaaaatagcatgaagcaaatgatgtatagataataggtatcataagcctgtgtatggaagtactagaaagaaaggacaataaaaatgagacaaaagcaatatttgaatagatactggtgagacaatttctttaaactgaaggacatctaactacaaaatcaaaatgcactacaaattgcaaggaggaaaactacaaagaaaaacatcacggtacatcatagtaaaatatatgtagaaaaataacaaaagtaaaattttgacacagcataattgtacatatttatgaggcacaatgtgttttgatacatatatacattgtgtaatggtaaaatcatggtaactagcatatctatcaccttaaacatttatcatttcttaattatagaagcattcaaaatcctgtcgtatagccatttcaaatatacaatacatttattgttagctatagtcaccctactgtgcaataaagtactggaacttattcttccaatctaactgttatgttgtattcgttaaccaatcaaagggaaaatcttaaaagcacacagagaaaaacaatcagattactttcaaaaggaaatttaagtgatgatagaatgacactgctaataagctttttaaaaacctctagaattctattccactgaaaatattattgaaaacatcaggtgtaactataaatggagaagaggcagatctctacataagagttccaaataatttgtttagatactctgccctcaagagggagcatttctctccactttctgtgtgtgggctgtacataatgactttgctccaaagactatggaaagaggaaaaaaatagtgtaactttgttactctagaatggagaaacctgacaaatgctacatcagccagggatcgaggtcaacatcaatagtgctaagtcatgttgaggtaataaagacactttacctctataatcttcctccttataacccacaatccctgtttaaaataagaaaaacactacaaaaatccaaatggagagacattttataggatgcctgcccagtatttctcaaaaccatcaaagtcatcaaaactaaggaaagtctgagaaactgtcatagtcaagaagaacctaaggaccatgacaactaaatataaaattctgggagacatcctgggacaggaaaagaacattaggtcaaagctaaggaaattttatttaaatatgcactagataatacaatctatcaatattaggttattaattataactaatgtgctatactaataagatgtttaaaacagtgaaatatgggatgttggagtacatgtgaactctgtactctttaagatttttctgtaaatctaaaaaaagctaacatattttatttaaaaattaaggtaaaaaaatcaccttttttgatattgccatttcctgactaaatatgaaaaaaatgttgccagcagatccatatgaaaagaaatactaagagcaattttcaggccaaaggacattattctggaaagaagcacagaaatgaaggaagcaataaagaatgccagaaaaggtaactatgtgaataaacctaaattacttctgaatatataaaataataactatgatgtcttatggggtttaaatatccaaaaataaaatacataataacaataatataataggtaggaaaagctttaaaagagttaaactgtaaggttctagcattatatgggaagcggttaaagtactaatttatattagattttaataatagatgttttaatatctagaattaccactaaaagaataacaaaggaatatatgaccgacagtctaataaaaagggcaaatagaacaccgaaaataaattttgagaaaagtaagagttgagcataaaagtaatataaaatctatggggaatttagaaaaacaataaaatgataaatttaatccaaatatgttagcaattacattaaacgtcaatgatatgatactacagctaaaagtcaaagatgtttaaaatatattaaaataatgtatatacaggtatatttatatatagagagagaatttctcagatatatgaatacaaaaaaagggaaaaactaaagtttagaaaatgaaatgacatgcaaagtcatcaatgaaataaaagaggatacaaacaaatggaagaacattccatgctcatggataggaagaatcaatatcgtgaaaatggccatactgcccaaggtaatttatagattcagtgccatccccatcaagctaccaatgactttcttcacagaattggaaaaaactactttaaagttcatatggaaccaaaaaagagcccacatttccaagacaatcctaaaccaaaagaacaaagctggaggcatcacgctacctgacttcaaactatactacaaggctacaataaccaaaacagcctgaactggtaccaaaacagagatatagaccaatggaaccaaacagagccctcagaaataataccacacatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagactgaaatgttagacctaaaaccataaaaaccctagaagaaaacctaggcactaccattcaggacataggcatgggcaaggacttcatgtctaaaacaccaaaagcaatggcaacaaaagccaaaattgacaaatgggatctaattaaactaaagagcttctgcacagcagaagaaactaccatcagcgtgaacaggcaacctacagaatgggagaaaatttttgcaatctactcatctgacaaagggctaatacccagaatctacaatgaactcaaacaaatttacaagaaaaaaacaactccatcaaagagtgggcaaaggatatgagcagacacttctcaaaagaagacatttatgcagccaaaagaaacatgaaaaaatgctcatcatcactggccatcagagaaatgcaaatcaaaaccacaatgagataccatctcacatcagttagaatggcaatcattaaaaagtcaggaaacaacaggtgctagagaggatgtggagaaacaggaacacttttacactgttggtgggactgtaaactagttcaaccattgtggaagacagtgtggcaattcctcaaggatctagaactagaaatcccatttgacccagccatcccattactgggtatatacccaaaggattataaatcatgctgatataaaggcacgtgcatgcacacgtatgtttattgcgacactgttcacaatagcaaagacttggaaccaacccaaatgtccatcaatgatagactggattaagaaaatgtggcacatatacaccatggaatactatgcagccataaaaaaggatgaattcatgtcctttgtagggacacggatgatgctggaaaccatcattctcagcaaactattgcaagaacaaaaacccaaacaccacatgttctcactcataggtgggaactgaacaatgagaacacatggatgcaggaaggggacatcacacaccagggcctgttgtggggtgggggaaggggggagggaaagcattaggagatatacgtaatgtaaatgacgagttaatgggtgcagcacaccaacaaggcacatgtatacatatttaacaaatctgcacattgtgcacatgtaccctagaacctaaagtataataataaaactaaacaacaacaacaaaaaactaaccaaaagaaaactgatacagctataacatcaaaaattcaactttaatgaaaaaagcatagctagatttaaagaggaacattttataataacaaagtgttaatctactaggaagatgtggggatcctaagtttgtatgcccctcataatagagcttcaaattatatgaaacaaaaattgcagtcagaaaagggcacatgtaaaattaaataaagcaatttcactatgcttgtcttgctaactgatagaacaagcatatgaaaaaattattaaatatatagagatatgaaaatcatgattaacaaatcaaataaatttacatatttgtacatatttgaaatattacatgtataatatatgtaagtatatgttgtatacatgcacatatgtacatacagaaaatatagcatctgaccattgaagagtgtacattattttccagtaaatatagattttttttaaaaaaaaaagaattgaccatgtgctaaaatataaagcaagccttaacaaattgtaaagaattgaaatcatgcagagtatattctttgttcaccatggaattagtctagcatttcataacaagatgattgaaaattcctcaaatgtgtaaaaaaaaaatcccaaaacatacttcaaaataacccaaagaagaaatatttatgtagattaggaaatagtttgtgtcgatgataattaaaatgaaacattaaaatctgtggtgtgcagctaatacttttatttttagggaaacaaacatatgagtgtgatgtggtctttccaacaaggccgccatcaattttttccttgttttgacacagtgtattcaattccctgattgataggaggaattctccacccttccagaatctctgctggcctgtgactgctttaactaacaaaagtctaagaagttaggctatgtgacttccaaggctagatcataagaaaccttgcaacttgtctttaaatctgctttaatagtctccctgggggaggtaagccaccggtcctccaccctgaggacaccaagcaggagaaaagcaggagtttggcatgtggggagcttcatggagagagggggagacatctgactagccacccagatgttctgaccatctcagcccaaatcccaacatgggagtgtcaaagcctccatgcaggtctacctctagctgtcaccttactactaccttctgtaggaccccaaatgagcaccaaccagttgattattacctgagaatccctagacaggtggaaaataatagtaagttgtctttctaagccacttagtgttaaggtgattggttacatgtttacagataaccaggaatattttttaaaagaaagactgaaaatcaattatctaaatttccatctaagaacttagaagcagaacagtgaaagaaacccaaggaagtagaataaaggcaatgataaagatcacagcacaaattaattatgtgggaaaaatgtgcaatgctgaaaaatcagtagagctacagggcttttttaggaaaagactaaaatagatagatgatagatagccaagatagatagataaaactcacaaattcctagcaaaactgataagaaacaaaagagaagacacacatgaatttcaggaataggaagggtgacctcagcacaattggacagacatttaaaacagtagtatgagaatattatgagcaacttaacagtaatacatttgaacattaatacgaaagggacaaattccttgaaacacatgatttatcccacatatttaaataaaaatctgaatattattatatcaaagaaattgaatctgtaattgaaagcctgcacacacacacacacacacacacacacacacacacacacacacacacatatgcaccccacaatcccaggcctcaggtagtgtcataaatgagctctttcaaacattttattaataaattataccaatcttgcacagattatttcagcaatagaaaagaaggaaacacttctaactttttttttgatgtatctagtatgacctgggtgtcaaaatcaagcaagactatttaccaaaaagaaaaagtacaggcaaatctgtctcatggaaaaaatcataaaaattccaaatgaagtattacctaagtgaactcaggcatatataaaaaaagtagcgtatcatgacgaggtttattttagagatgcaaaaatcaatcctgttatttatcatgttaacagaataagaaaaaacatctaattatctttatagattcaaaaaagtggtaaataaaactttacacctgtttatgaatcaaatatgaaagaaattaggattagaaaggaacatttatctatatctatctgtatctaccctacagtacccatcatacctaccttgaactattaaaacctctcctgagatttgaagcaagaaaaggataaccattgccaccactttttcttagcatcctatttgaggacccacaagtacaataatgaatattttaagaattggacaaatggaaaagctatttgaacaagcatttcaacaagatgttatccaaatggccaatacatgagaatgtgcttaatctgattaatcactgggaaaatgcaaattagaatcataagctgatgctattattaaactcccagaatagatcaatgaaaaacccagcatatcccaaatgttggcaagaatgagtagcatctgaactctaatataccactggtgggagtgtaaattagaatagccttttaagaagaccatttgtctataaatactaaacaacaccttagaccttttgacccagcaagtccagtcttagatgtacagctgctcctcagtagctgcaggggtatattggtttcaggacacctgtgtatgccaaaatctgtggatactcaagtcctgcatctggccctgtggaactcgagtatataaaaaacaggccctccacatatgcaggtttcacatcctgtgaatactgtactttgaatccacatttggttgtggatgcagcacctgctgatatagagggtccactgtatttagaaaaatccacatataaaatggacctgtatagttcaaacctgtattgtttaagggtcaactgtattatccaacagaaacacattggtaagctcactgaagacatgcatgagaatgttcatagcagcactcttcacaaaagccaaaaataagaaaatatttaaatgctcatcttttgtgaaatgaatattgtagtatattcacagaagggaacaatacacaggaataagaatgtgtgatctacaagtatatgcaacaaaatggatgtatatcctaaacaatgctgaatgagagaagccagacacacttgaatgaaaagttaacttgagcaaaacagtcaaagctgcatagcaaggacatcagacaaaatcagttacattcagtcaagatgcattgttgctcagtctgcctattacctgactggtccttcagtatcagttgttttctgctctgatggatccacacttcggtgcgactttgcttatgcttctactttacttcttctgctgttcctgaccaaacccttctctcccttccctgtctctctctgtctccctctgtctccctcttcctctttctcccatttttccctgcccctccatacctcccccttgtccactccatcccctcttccagccacactcatctcatgaggcaaggatctatcaagttagctagtcaacatgcagaagaggtacctcatttgagcagaaccgtaatcaagccacctcacaggccactatcaaacttgaagatggattggaatactcgccaattgttaactggattggataaatacataaaattgagtcctgtctataaagatgacttatggccacaggtttaggagtggtctgtgggcatatcctgtatatggactcaaccaaatcacatttctgtttagtcctcaactccagctacattttaaactttggaaaccacagaaatacccttttacctttctcacactgtccactacaatggcatatatatagtggtgggtaactaataattatttgagaagccaataacaacatatttaatgggtaagcaggtggcctagtgtcctgaccttagtttagtttctctcattgttctcaatttcatcctcaaatgattctatgtaaaatttctgggtctgtaccataagcttcccaaatctgtaagactagaaaataccttagtttattgttcaaaagtaatatttcagataccaaaattatgacttgtctctttcttcacatcaaaattagagtgcattcattctaattaaaatgaaatattattttatttcatttaatccaaggttaaataatgatgtcattctatgatggttcatttttaacagagacccaccgaagtttctttttgtatgtctagttacaagaggctaattctgtttgactattcacttgcagatataaatgaatgtaccattgacaatggtggctgtcaagatcgatgctgtaatacagttggcagttattactgcaaatgtcaagctggccagaagctggaggaagatggcaaaggatgtgaaggtaacaggactgtctgcttactgataagggaagagagaacatctatgtaatgcaaaagaggaggttgtcttttatccagagccagttgaagtgcctgtgttgaatgttgtcaagagcacagatcttcctctcatgtctagattacagtattgtaaccctaagaacatttcaagtagcttattatgggaaacatatgattatatgctggtttggttgtgtcatgttctgattatggaatttcaatcattcatttaaatccctggataaagtacatattttttaaagcatttcatttaattctaaagtaaaaatgatacttatcataaaatactcatatgttgctacaatgtaaatggaggggcacaaaactaaccacaggaataatattcttggtatagaattagctttttgcacaaacctcaattttctgtttccttttaaaattaattccttcatttattaattcatcattttattcatttgacaatcattgagtttctgctctgtatcaggcattattccatgctctggagatataaaaattaatgagaaataaattatgtcctgaaggagctcactgattagaagcaaagattgaaacataagcccaagccttacaaagtggtatttttaggcattatagcatgcggtaagtgcattggattcaaagagacatgtgtttgagacctaactctgtcacttatgatttatgttaccatgggcaagttattttattttgctaatactcttccttcattgataatatttagaataatggtggtttctaaaccacaaaatttgctgtgagaattaaataaggtaatgcatctaaagcacttagcataaagggtggtgctcaaatgataactataagtggtactctcatttatgaacttagttgctgcctgtcttgggaatgtaatgggggacagagattgcttccttctcttaatttctgaaagggaacataatagattaaaaggatcactattaccatgccttataactgtctttctgaattttttctatctggccatattactaaaatgcctgagaattttatatagtcaggcatctttgtttgtttgttttaagataacagtagaaaagcatttattctgattatgttctatcacggatcttaaaaaatcacattctttttttcccttaacaaagttcattcctgatggggcatgtatgaataagttggtaaaagaaaacaaaacaaacaaaaaatatccccactgaaggcacctgaggctagggttgtgggtttcattgagactaccaaaggcaagacaaattgtaggtgtgagtaggttggaaaatgtatcaatttccctttatcattccctcccagcagggcttgtgcaggcaataataggaagggctccaggtagagagccagatgtttaaaggcaactatgtctggaccttcctgggacagggttcatctcaggaagcatcctctgcctggaaaagtgtaaattcacaaaggcaaaccctaaattcacccaggctcttttttcattcaagtgcaataatctctatttctggatgaaattatttggcaatggtgatcccagtactgattcaatctcagaagaagagtcaaggactgcattgtgttcaaggtaaaagtgggatggtgaccactgaagacgacatggtctgtactatgagaatagtgttttcatgaaccctcccttcatctgacaggcaacaagctatttatttctctttgactgagtattattattgctgtatcatcattgtcattattatagatatatttgaagcacctatcacagcaattcaccattgttaggtataataattatttttataatagctattaggctaataaggcatgttagacttcgcacccactggttcatttactttcacttatatcctattttaactgaagttagttactcatggtcactcatataagtgacaaggtatttagagaaatgatttccatggttttatttagctgagtccatttgtacaaactgaatacaattaaggtcagtatttgtatgaatcaagagtatgataatcaagaatccagagtttgatataatgagataacactgacttcctactttcccaggactagggatggtggtttgaagtagagcagcttacctgcaaagaacctcttctctcagtctcattgatgttagaatcttttttttcttttcatttccttaaatgactatttgctggagatggtactgctagagattcagcttgcttgattgttgaacatacaatcatctcaggtttatttatatacatgattaaataaaatataatagagatcattttgaaatccagtgcattctaaagacactgcaaatgaacattcatgtgagtgtagaaatgagtcattcatgtttatttactggctggtaacagtagaagtcagttggtttcaaagaccatttagttgaatgctacagcattgaattaaacagtcatttaaaaatacttttactttgcattaatataaattgaatttaagttatttgaattgctttttaaaatatagagaccagcattttaatgggcatttgttgtactatttaaataaatctaggctgggcatggtggctcacgcctataatcccagcactttgggaggctgaggcaggtgaatcacttgagtccaggagttcaaggctgcagtgagctgtgatcacatcactgcactccagcctggacagcagagtgagaccctgtctctaaaataataaataataaataataaatctagagtctgtccttaagtggacagaatttaaacatttataaacaatcttgttagttaatcttactctttaactttttctataaagaggtataaacttgtggagaaggctcttgattagctcagtttcactggtatccccttctttcaggcatagcactgaatctaaagaatgttttctgattcacacgcagattgattcttacaagatatagattaaagaagcaaatgaagggaaaaaatgccttccactggatgctgtgggagatattaaaatatttacatagtgtgtgtcaaggatccccaaacctcgggccacagaccagtactgctccatggtctgttaggaactgggccacacagcaggaagtgagtggcgggtgagtgagcaaagcttaatctgtatttacagttcctccccatcactcacatcaccacctgagctccaccttctgtcagatcagccatggcattagagtctcatagaaatgcaaaccctactgtgaactgcacatgcaagggatctagattttgtgttccttacaagaacctaatgcttgataatctgtcactgtcttccatcaccccgagatgggactgtctagttgcaggaaaacaagctcagggctcccactgattctaccttatgttgagttgtataattgttatctatcacaatgtaataataatagaaataaagtgcacaataaatgtaatacacttgaatcatcctaaaaccatcccccttaccccggtctgtggaaaaattgtcttccacaaaactggtccctggtgccaaaaaaattggaaactgctggttcatacacacacacacacacacacacacacacagatctatatatagatctatatatgtgcatacttgtatgtatatgtatatatgcttatctattgaaaggatgtaaatttcttctttcatttgctagtgtgagtgattatttttatagattttcaaatatgcaactataattgcacttcagaaaaaattcaactggtatcattttatttgctattaaagtcaattctctattattttgtttaggatgttgtatccacaactgtgagtgaaataggccagtaatttttgtttctcatatgttctttatggcagtggctctcaactggggtgattttgtaccccagaggcacttgtcaatgttcggagacactattgattttcacgactgaggggagtaggtgccactggcatctagtggatggaggtcagaatgttgctaaacatccccttcttctgtaattctgattatactgcttcagatttcaaccatttaactttatgttttagaaatatcatttttctcaaatttatagattatcttttgtatgtatgctcatttttatagttgtattatcttcttttgctatttcacatataagccttctatattccatatctgaatccagcatctggggtccttgtggaaggtctaaatctattgttccttatttctaggaccattagttacactctcttccctttcatgttatatacactaatacctctgttccataacttcttacagagcactgtacttatttacacatttgtactgtcaattagattggggatatctcctgggaaagaaccatgtcttatcactttttcatccccagcacacagttgtctagcacatagggggattccataaatgcttattgaatgaatgaataccatcatcctttcaaacatacaagcatacagtcaatatggcttttattcattttattcatttccttatctacagattctaatcatgctgaaattgtcacttaaagtttgactagttaaactatttggttatcagtaggtcttaatgtaagtatttgctgataacaagtcatttgaaagggaaaaatcacatttttttgtttctagggagcaaatcaaagacttttggcttgctttcagctttctgaaaagtttcttcatatggcttgtctaaattattggtgccacaacgtaagtagtgtggctattcaagcacggtaatcttgtggtgtcaaagaagttttctaaatgaaatggtaactaatattactatatattctaataaattaacttagaaagatagtgaacattgtttggacatttgagataaattcttctatttgagagaaataaatgaacatatactatacattgataaaggcatattgtttaaataattgattgttaaaatattttaaagtaattttaatgatattttggatttttttttctaaagcatatggacatgattaagtgaataaacagagaatataattcagcatgccactgtggtggaattacagaatatttcagcttccaaaaggcttctatagttggaattccagggaaattaaatgatttggacaaggtaacagtgctagttgatgagcaaaatgacaccagaagccaaactttcttatttgttacccactgtcctttccctttgatgtggttgatgggcagcatgaaccggatgcagactagtctgactgtggggtcacagtgttgtgggggtagagaggccctcaactcatagaagccatgattgtcagaggagggaaattaagaccctgagagattgactgatttcctccaagtcctagacaatttatttgtaaagcaaaaaacagaatccagttccccttttcccatttgtcattcttcttcattgaaaaatcaatctggtcagtaaacatttattgggtaactactatatgtccagcactgtgctgggtaattcgagaatacccaacccatattttagtacagagtatggtttatttcttcacagagtttcagtattattaagcatcctgaatataaaatgattgtgtgatattttacatgaaagtcaagtaattatattatatcctttgagagttcactcaggctagctctttgcctccaagcagcatggtgtctaaaccagctagttgtttaccctagtattagagatctccaagggaggacatcttttaataactcttgtgatcaggaaagcgttccttatatgtcacctatattgctcccgtttaagcctgtgtgttttattttcttcttagttcagagacacttaaataatcagtaattctccacacacttacagcacactaatgtgtagttgttcaacttagtaaaaacatttattgtgccaaatatagtctgttggcacttgaagaataaaatatgatatatgtatacacatacacatgcatatttattttgagtttattaagaaaacttgaaatcattatgaagaatttttctacttctgcatgttgcttctcttaatagtcacttataaaggaactctgtacctctttctattggtgttgtggagcatgcaaagtaacagcagttccctggcctcaaagagctagccaaatactggagtagttaactattggaattgccaaccattgaaatttatacagatgaagaataatttgaaaaaaatccaatatagtctatctacatatactaaagattgtccattttgaatttatagaaacacatttacaatacagaataactacatttaaaaggtttgaaccacttaaaatgtgggggatttatctacttgattcataattgtattcagagttttttttcttattattcaccaagcacgtatcagacccttacactgtgctccatgtcaaacaaagagcacaaattttcggttcaaatattgactctaacatttactagctgtgagacttagagcaagttatttagtatctatgggctttcccttcatctataaaaccagagtaataatacttagccttatataggttgaaagatcaaataagatgtagtttgaaagcatcttgatggtaggaaaaccttctttcccctgtttcgtgctcacctaaagagggattgtttattagtaacattcttgacctctgtctgcaccccacatctcccactcccttcttaccaagagaagaggtgtgaaaatacctcactggtgagtttggggaaataaattggtctgttgggtttagctcacattcatattttctctttggggcttgcaaatgcctgcaaaaagtgaccattctggtctgcttctctgcttaaatggaagtttcaccatgccaggaccccacatgaagaagacaggttttccatctacacctgggaccaagtgggagagtttgtctaattctgcatgcatttttgggaagcccattgttgctgcacccttaaattctcttatccagtttcaattttaacaaaaataaaatggatattttgtctccatatgcctattttgaattagatctcaattaattcaaaattcaggcaggcaacatgaatttgttattgtatcccctcaaaatagtagcactttatatttgcctaatgcttaggaaattttatttctctccagtttttttttaatttcctcctatgctatttgttgttgaagatttaaaaaaatgtacaatattatctttttctctcccaggagcttccagttcaataaaggagattagatggatacacaaacagctatagtgtaagatagcaggagtaaatataaggcaggcacaagtgctatgagaattaagaggagaaaaagataacccactgttgaatcaaaatgggctgcaaggaactgggacagacactaatcacttagccctgggactgaacaaccaaccttccatttctttaatttccttaataaattccctagtggagttctgcccaatatgacttgtcctgctgtctcttgtgtctcttgattgacactggacggcatccgggattttaacaacaaagctgctactgctgttcccaagacattccttacagaaatttctgagagtattcttagatatatgtgtcttttagactagagtgaaaacacatataattcaaatctgaaactctgttatgaaaatggaaatcaactttatttatagttaagccagtcttttaaataaagtccatcatttctcccccaataatcctgagtaattccttcaatacctcagctttcagctaacacttaactgtagtcaacagagtatctacaagtgagaggagctggaagagactatagctcatacagattccccaaggtgagctggctcacttagcagatttcattagggatgtgcagatttatggcagttatggcttctacaggtagtgccaaaagaggcagacaagaaaaaaaaaagacgtcttagaggtctgtggctgacaagcaagacatcaaaaggcttcttattgcctcagcagcccatgccactcttactacaaaaacaatgaagcagaagcagccaatcagggcaaatggctgtgtgaagctgtctgaatgtggtgagcagcaagatacctccttaccaaaatttggctcatggtccttaaattttactgtaaattgggaagcataaaatattttatattctgaagaataaaacttttagtttcattcacaattattttttagtttttctgtttagtagtcttaaaaatgagctgatatttttaaaagactgtattattatatttacttcccagaaatattttccaactgatgcatcctggcttgaattcttcagatgtgtgtttaccttgtaggtattttttgtattatgaaatcatacctaccaaaagatcagtgtgatcctgtattctaaagcatgatccttttagacttctgaaatgtagagggttggttcctgcccttacaagatccatattcctttctattactatcataaaagtagttacggatgactgactttttaattttcttgctataagaaattccttcatcaatttttaaataatggagacttatttttcttgcaataaggacttattaagggagcctatgaatacatatgtgtgatttttaatcaggaaataagtcagttaaagttgatttgttattttgctgctattgactttcatgtgtttgtatttttagtggccttctgatgaccagtcatcctcagcatatgatatcatagaaagaaatgaaggtactcatttctgaaaaaaactatatactgtagttcataaattcaagttaattttctgtttttattattaattccaattctgagtttgtcaacaggccaggtctgtacttccttgaatttaatttagatcataataaaaggatagcactcattttatttgtcccaatggatgcatgtgatgcgtgtattccacatgtattactggtaaacccaaccttctgagagtatgcatatttatttgtatttttactttatatcttctctatgagtatctcattggtaagagcatattcctaagaatagtaatattgtaaacatacagaattctttatgctattacaaatacaaatgtcttatatttcacatttcctataaataggaaagatatatgaaaagaatctggagaacttttctaaaaagtgttgttctcattttaataaggaagatagcaggtctctaacattgtatgaaatcacaggcttttgtgattatcaaaatacacagagtgattataaattaattattgtcattcaaatatgattttttaagtctatcttgcagaatgagaaaggcagttaatgttgtataaagccatttgaaaatactcaagtaatagaccacctgaagggaactgcatactgtaggaggtcattgctggctaggaacacacataggaagggaacaggtgttagctttggttggtctcagactggcactgggtcctagtgactcccagttcagggttgggatagagaagagcagaactaagataccctaggtttctctgtctgtgtgggcatgagaggtcggggagaagggcaggagagaggagagacaagaataatcatgtaaaggaatgcattttatacatatatactttatgccgtatcaaacacatgtttctaagttataaagttctgtagttctgacaagcttactgaagtgggacacttcaaatcttatagcggtctcagcaatagcataaaccatccagatgagatgtgcaaacaaaatgtcttttctctgcttgatgtatatttaataattttttagcatgactaagatgacccctgtggtaatccatcaaaaaatgtagacaagaataagaaaaaagttgtttataaattgcttttcattggtgagaaaataagttgatttaaaatcatctgttgtataattttgaacaagtgaactggaagcttctgtatttaaatcatttatctatttatttttgtatttattttaaaatatatttatatctatatttatttttctgtattcaaatcttttgtaattaaattttctgtataaatatataacatatttatatttatttttaaatatatttattttatatttatttttctgtatttaaatcactggtctatttacttttatatcacttcttttattttaaataatcatcacattttggtggcctgactgagctttggaaaacaaattaaaactgcagctaggaaaattaggttaattataattcattcgatgctgtctttattaaaagtgaattgatttaatccctgtaaaaaaccctaaggcatgagaaagcaaaatagctgtgtaaaagcttagtgtactcaacaattagaagatactacagttcagtacttaatgtgcatatgaatcaccttagatcttgttaaaatgcagattctgattcagcaggtgtgggatcagcctaagaatctgcatttctaccaggctcctgggatttgagatgatgctgatccagtgaccacactgggtaaaaaggcttttgtcagctcattctctcaatgtgtcagataataattaagcatttgctaattataatacagccatagagaagggatacaaaatgctgtgaaatgtggtgcctgcaattctgaaacattttaagaaaccagtttgttgagataaaattcacagcccatacatttcatccatttaaattgtaaaattcagaagttttcagtatattaacaaatatatgcaatcattattacagtagattttagaacatttttatcatgtcaaaaagaatccctatacattttaggatcacttccctccactcccatcactcccataaccctaagcaaccacaaatgtactctttgtctctatagatttctctatacttttatataaatggaattatatgatatgcaatgttttgtgaccggcttctttcaattagcatagtgtttttaaggttcatccatgttgtatcagtacttcattccttttcatggacaaataatatttcattgtgtagacataccactttctgtttatccatttgtcagttgatggacatttgggttgtctccaccttttggctattacggctaatgctactacaaacattcatctgcaagttttgtgtgtagataagttttatttctcttgggtgtatacctaagagttgaattgctggattatatggtaaccatacatttaattcttctgaagcttttaatttagataaatagaaagattttaatacataaatgttcatatgtgtgtgcatataaacacactgtatcaaacaattggcttcatgaaaaagggtccatggtcaaataattttggagagtactacatgctaaagctctcttaaatcaggcaaaaggggagccatttcactttgtttaacacaagtttccaaacatgtttttcaaacatgtttggaaatattttttttattattattatactttaagttttagggtacatgtgcacaatgtgcaggttagttacatatgtatacatgtgccatgctggtgtgctgcacccattaacgcatcatttagcattaggtatatctcctagagctatccctccccccttcccccaccccacaacagtccccagagtgtgatgttccccttcctgtgtccatgtgttctcattgttcaattcccacctatgagtgagaatatgcggtgtttggtttttttgttcttgtgatagtttactgagaatgatgatttccaatttcatccatgtccctacaaaggacatgaactcatcattttttatggctgcatagtattccatggtgtatatgtgccacattttcttaatccagtctatcatttttggacatttgggttggttccaagtctttgctattgtgaatagtgccacaataaacatacgtatgcatgtgtctttatagcagcatgatttatagtcctttgggtatatacccagtaatgggatggctgagtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaagtggtgtgagatggtatctcattgtggttttgatttgcatttctctgatggccattgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagacaatacagggatgccctctctcaccactcctattcaacatagtgttggaagttctggctagggcaattaggcagaaggaaataaagggtattcaattaggaaaagaagaagtcaaattgtccctgtttgcagatgacatgattgtatatctagaaaactccattgtctcagcccaaaatctccttaagctgataagcaacttcagcaaagtctcaggatagaaaatcaatgtacaaaaatcacaagcatttttatacaccaataacagacaaacagagagccaaatcatgagtgaactcccattcacaattgcttcaaagagcataaaatacctaggaatccaacttacaagggacgtgaaggacctcttcaaggagaactacaaaccactgctcaatgaaataaaagagtttacaaagaaatggatgaacattccatgttcatggataggaagaatcaatattgtgaaaatggccctactgcccaaggtaatttatagattcaatgccatccccatcaagctaccaatgcctttcttcacagaattggaaaaaactactttaaagttcatatggaaccaaaaaagagcccacatcaccaagtcaatcctaagccaaaagaacaaagctggaggcatcacactacctgactttaaactatactacaagcttacagtaaccaaaacagcatggtactggtaccaaaacagagatatggatcaatggaacagaacagagccctcagaaataatgccacgtatctacaactatctgatctttgacaaacctgagaaaaacaagcaatggggaaaggattccctatttaataaatggtgctgggaaaactggctagccatatgtagaaagctgaaactggatcccttccttacactttatacaaaaattaattcaagatggattaaggacttaaacattagacctaaaaccataaaaaccctagaagaaaacctaggcactaccattcaggacatagacatgggcaaggacttcatgtctaaaacaccaaaagcaatggcaacaaaagccaaaattgacaaatgggatctaattaaactacagaacttctgcacagcaaaagaaactaccatcagagtgaacaggcaacctacaaaatgggagaaaattttcgcaacctactcatctggaaattttttaaaagcaaaatgtttaaaattcaaggatttagtagagagcattttgagaaatggcttaattgcatattctggaaatagaaaacttattggatagggcagagagtatattcagggaactagtggatgatttattggggctagacagaggacagtttcaactcaataggtaaatcccctaggtaagtggataggaatgtggtttctgatggaggacatctgagtagaggaataatagggtggaaatgtgatttctgaaagttgttctgggcatgagtcataggatgttatagaaagacaaaaagacatggaaatgacagggataccatttatgggccagtgaaattgcctagctattaatatccataagttgtataaagagggaagaatcagttaattctgatgacacaatggacccaagggaaaggggacatatcaaagtctctttaagtaagatgatgatgaataataaatctattatcgatagcagaaatgccaaatgcagtatgtagaataagtgcatctttaaaagcactaaacagaaatatcacattccaaccagatatatcttatgaaatttcctgacattatagaaaaatgattatataaaaatgacgaagacctatttattcatccttttttatttgaaaattagtacttgatttctgtatgtgccctgccataggttttgatgttgccatctggcagaatctgcttattatcttcattatgaacctagactttctttttatgctggtgtctatttcccattaaatcaaaagttatgtcaatttcaaattaatgagaagtaagtataaagatggaaacttcccctcaatattactatttttatgcttttggagcataatatttagcactgctcaaatctggttgtaaataatttctttcattgatgagatgaactgtctttactttttctcctgttactatatttactgtttcccttttgtttgatgtcattggaaaatgaaattgccagatggtttgcaaagagaagtgagcaacaactctttttttaaaaaaaagtttctttatatacaaataagtaagcaagcaaacaaaaaagtatgtttgcttaaaaaaaagaaagaaaaaaattttgcttaaaagatacacagagacacactcagaatctcagagtgttaattagatgctcctgtttatatcaggatgaatatgccatatatgggtaatagttcctaaattaggtaaaaatggggatcttgaggagccacacattgtcagcataacacacagcatgaagacagccccctggccagcctttttctttcagttatagctattcaagtcttcatttttacaagtagtactctctgatatcaaaacagattcactctttttgtccgcatgactttaggcagtatgaagatcactaacgtaggcattatgaaaccttagtgatttcagattcaccaccaagtctataacccagaatatatctcttcacttctctgggccttaatttgcccatctataaaatgagacattaggaatggaacatcttcaaagtctctttcaggttgtaaatgccgtaattcacaagcgtaaatctacaaatttaagtgtaattcgaaagctggaattctgtgcaagaggccaggaaaagatttttagaggttataatgaccacataaaaactacttttctgaaccttatagctaacacagagaacctatggtatctagtaagatatgagattatatcacattagaggctagaagagagcaaagcaaaagcagcaattaaattttatcacacattacagcagccgtggattctacttggccttttatgcacagctttaaggtaaccttgttttccatttggctttctttgtttctgtgtctctcccaaaaacatttcttagatttccccagttctatcccagtgttagacacctaccttgtattcaatatattcatgttgaccttattgtcatcaattatccacatcagtagtcagtttagaggagattttagacaagaaaataaaacattatatgttttctcaaataattatttgacttcctcatttttcaattgagaggaatagctgcagtctcaaatacttctgcaaaaaatatattcacatattaatttaaagtgctagttacaggctgggcatggtgcctcacgcttgtaatcccaacactttggaggctgaggtgggtggatcacctgatcaggagttcgaggccagcctgaccaacatggtgaaaccccatctctactaaaaatacaaaaaaaaaaaaaaaaaaaaaagaaagaaaattagctgggcatggtggtgggtgcctgtaatcccagctacttagggaggcaggaaaatcgcttgaaccgggaggcagaggttgcagtgagccgagatcacgccattgcactccagcctgggcaacaagagtgaaactctgtctcaaaaataaataaataaataaataaataaataaataaataaataaataataaagtgcaagttaggttcttttttgcccaataaaatggtttacatttgctgtgctggttctcagaaaataaattttaaatgataaaaatttacatgattttgtgtgatatatgatatttattttaacagaactgcttatacaaattttatccttggatttctatatatacttcacacactctgataattaagttcgtagttatcatagattattaagcttatcagaacagagatgtagcaattatagttttaagggattggtgctttttaaaatgttgttcttcataggtcttttctaatgtgtatgtgatactggcctaagtgagagagccagtaggccaagctcaagaatttggagaaagaaagaaaattagatgtcttttaaaattcaacacaaaatcaagtggagaaaaatcaggagaattaattctgttctcagagaggcttaaagagcctgactataatctgatggtattcatagagcttaagaaggatcctggcaatcaagtgtggtcagatacagagatgtacaaagagaaaaaaccacccaggaatgcccaggaaagatgaagccttaaccaacagactttgagaatccctgtcctatgtgcaaatgaatatgttaggctactttatcccattaaacagcaagtttcatctcattgattccatttgttagatctctgtgatagcttatattatagttcctgcatcagtctgggtccaatcaggagagaaagaactgcacagtaatttgaacatgggaagtttaatataaagaattaactataacaggaggttggagtaataaggaactggcctataagaaataaagagaatgctaaaaaatacaggatttcaactactaccttctaggggtgaactgattccatttcacccaaagaagagactcccccagggctgagatccagacctagttagaaaggttgcaaccacggttcactgaatggcagagaggtcactgtgttgccacaccagcaggacttgaaaatcgggcttcttgaacttgccagaaatctacagtctaggaggtgggagaaaactgttcaaggtaaattatcttttgcccaaggggagagtcgggaagttgctggtcattggatgctgctggccacccgtgactgcacaagtcaggtgctaaagaaactacatgtgctgcaggagcccagcaccagagaagctgccgcgttgtagaagatgggtttgaagaagctatgtgcaaagtagcaacctagctgtaaaccctagaagccaccacactgccggcgaatagtgctggagaaagggccttccaaaggctggagaaggcatttcaaaggctaggtgctgggaaagttggacacattgagaaaaccagttgctggagaagatacctgaactatgggagccagacactgaaaaggctacacaggctccaagagccggactagagaagtcgtctgctttaggggagccaggaacaagagaagctgcatcaggagcctgtctagaaaagtacactggagccaggaaggatgatgcttactctacaatgtctttccgttgtcctttactggcaagttttaacatagtgcctgctgacaaagggaaattaaagggcccagatccattttcacagtgaaggcaaaaataatgaacttggagataggaggcaattaatcaacaataagcacagttcccagctatgcttcctgtgctccataagagacgtataaaaatgtgtccttcatcccttataaatacatgtagatttgagtactcccctgaaggcaaaggtatttctcccatccattggttgacttgggcttatgacttggttgggtcaatagcatagcaattaatgtgatatagcaccagttctgagcagatgttttaaacgtgagtccataggttagcatgaactcttccatctttgccctgtgccataaagaaagcaagtcccagacagagtctactcttttatctgggtcctagaatgatgtacagagctgagtagagcgacagccaacctgagacctctaagcaaggaagatattggtggttgtatgccccttagcctttgggttgttattacaacaaaagccaactaatgcagtttctatgcttgacaaccaactttccgatttctgtttggctaatcatgataatgcagcattaagacctataaaccattaggtcattttctgattttacttattcgtctgcagcaaggagataaaatgaagtgacaaggcccccttagattgaagagaattcatcatagtcatttcatcctgagagaagtcttcagtggcagctagccagaacttcccagatgacatctcagacttgcctgagtataaatcattgggtggaagattagagatggaaaagttattgtcaatagtttctttaaggtatagggcctctctacatggctgttgttcttctctttgccggttttcatgatttgctgcaaagattataatttatttcattttatctggtctttatcaaatgtcccctaatcatttgggacactgggttgttgtctaaagtttatctttagaaactgctgttcttgatgagacttggtagacttctacacaactttctgtggaagaaaattgtttttgataatagtgttatataaattcttcttcagcggtcactatagtctaacaacacatagttcatattaacataggctttcttttcactcattgatttattaggagaaaataattttctaactcactattataatattcattataactataattggtattataattattattatatttggtaatcttggagcatccccaactggccacacacacatatacacataaagaagtctgaggctagatatttcagcctttattgagctgaaaaatcatactgctgttcaaaaagatttttttcaattaaaatcaaaagtaagaatttacttcctatgatcactaaataattaaaagcataggtcaaatattagcatgtatataagatatacgtttaagaaaagaaacagtgctaatactttgagtgctaggactattacttcctgtagatattcaaaaatattgactagagtttttaaaccctccttctgcagtaatgatcagtcctggaactaatttaatttgggcacgtgcatgaaaagaaacatgaggagatagaaaatagccacagaatctagtccagtctctgctactgtacatggagaatcttagttttctcatctctaaaaagggaataatcacatatgcccaaacaaacttaaggatttttttttttttttttttttttttgagacagagtcttgctctgtcacccaggctggagtgcagtggtgcgatctcagctcactgcaagctctgcctcccaggttcatgccattctcctgcctcagcctccctagttgctgggactacaggcgcctgccatgaagcctggctaattttttgtatttttagtagagacagggtttcactgtgttagccaggattgtctcgatctcctgacctcgtgatctgcctcccaaagtgcagggattacaggcgtgagatgggatttttttgagaataaactgagtgtcacggtgaaaaggagatgtcaatagcaaaggtctttgcaaatgtgaaattttttgatgccctgaaataattggttgatggtatgttaatgtcttcctaaatgccattgaacctggaacctagccaagggaataatcagaggagtgatcttcaaaatatatcttactacagaaaaagcagaagatattaggacagatcttgaagtttagggtgggtagaaatgtaatttctccttctgaagtcattaataacctgattgtaacttcgactatcagaacgtatgatattccccaactcctatttaaaaaaaaggaatgtgatcacacagtagagaaatttactatgggaaagctccttaacaaccacgtggtattatcatttaaaagtggaagggatagaatgatgggagagacgcttaatggcaggttggaggtggggagacagggatggagggaatataaccagctcacaaccatcttctctctgaacttttctggacttttttttctctagtgtatagtgaaagtttaatccttttgtttccctgtgatcccagaactctttgaacaaacttactattagaacttcagatggtgtattacatttatctgttaaattgtctttctcatcagactatagatgtcttgaaggtgaggatcattccttaattgtgtagtagcccagactgctgccttgcacaagacctggcatgtagtagatttatactgagtggtatgtgaaaggatgaatgggcacaaaatagatcagagtaaagccattggaagagatgggatttggtaaggttttaatcaagtatttcacttcttaaatactaaggaagtattctcagaattcagcacaatacaaattttatattaaattttaatttaaaaattagtctgtagacatgattgaaatattctctcaggagactcctggaaaacatgattaacttccctttcctttctttttctttttcttttttttttttttttttttttttttttttttttgacgttgtcttactctgcacccaggttgaagggcagtggcacgatcttggctcactgcagccttcgcctcccaggctcaagggatcctcccacctcagcctccagagtagctgggaccacaggtgcctgccactacgcctggctaattgtttgtatttttggtagagatgggtttttcacatgttgcccagtctggtccaaattcctgagctcaagcaatccacctgcctctgcctcctgaagtgctaggattacaggcgtgagccaccatgcccagcaagcataattaatttctaatgtctgagttcctaagtttaagtttatgcattcttaaaaatagacctaaaacaactatgatattctgcttcagaagataatagtagctttccttgctacccagagaggggcccataccgcattgttctggattcccattgtaattaaagggaaactttcaccatgtccagagtctttaatgtcctgcaaatgaagaaggatgtcctcaaattccttgcagcagaaacccacttagatggcaccaacctgactttcaaatgcaacagtacatttccaaaaagaaaagcgatggcatctataccataaatctgaagaagacctgggagaagcttctgctggcagctcgtgccattgttgccattaacaacagatatcagtgtcatgtcctcagggaatactggccagtgggctgtggagaagtttgctgctgccactggagccactcctgttgctgatggctctatttctggaacctttactatccaaatccaggcagccttctgggagccatgtcttctggtgcttactgatcccagagctgaccaccagcccctcacagaagcatgttatgttaacatacctaccattgctctgtgtaacacagattcttctctgcactgtgtggacattgccatccaagcaacaacaagggaactcattgagtgggtctgatatggtgggtgctggcctggaagttctgtgcatgtgtggcaccgtctcctgtgaacacccatggaaggtcatgtctgatttctacttctgcaaagacccttaaaaggaagggcagtctgcttctgagaaagctgtaaccaaggaggaatttcagggtgaaaggactgctccagctcctgagtttactgctcctcaacctgaggttgcagtctggtttgaaggcatgcagatgccttctgtgcctattcagcagttccctattgaagaccataacacagcctaccatggaaaattggtctgcagctgccactgcttaggccactgaatgggtagaaacaaccactgaatgtcttaagccatttttctacagacttttaaacaagatggaaatcaggttgatgaaaaataaacatcagttcctaaaactaaacaaaacaataattgtttttgaaaaaggaatgtatttttaggtgggaatgggatgggggagtaagtgttatgaaagtcagaagcatatgcctggcacataaacctaaaagcataggaatctttgtcataacatacaggatattgcaattattttgttaaaaaacccagaaagttaagaaaattgaacatattctaaattacaatggcattaacttcttttttttcttaagatatcttaaagaaggtgtggaactcgcagacattttctggtagttttgagcggactaatctattataactattatgtatataatatttatattatataaaatataaatattatatatttataattatataactataacctactataactattatatataaatgggtcatctcgttcctaatactgagcatcaaaaatgtgtgtatgtaatccttgaatgcgcttaaaggaaatatcaggaggaatgccacatcagccaggttgtatggatttgactttctatggaaagttttggcatggtaaatcttactttgtccattaccttacctgctatgtgatatgaattctttgcctgctaatcacaaatctcaagatctgggaaaatggagctccctagaacaggctatatattttttattgccatctcgaatcaaactgatgccgtttttcatgggagaactaataaaagtcatattctgtattgaaacatccctgtattttatggacccatctgatataccattaataaagttttaaaacaatctataatagattttgcaagaaccgcagatctgccagcactctcattaacagcccaattttaagcactactttaggcatgattatctacaaaatgttagtggggctgtttaatattaaaagactagtagctgaagaaaaaggaagctcaattactcaaaaatccagttagattgctatttcgagtaatttaacaaacaaaattgcattttgttctgttttcaaagtatgggcttgtattcatttcctggaatatgaagttcattgaaaatgccagtgtttctaagtgattctgtatgagaggagttgataaaaataaaaataccctttggcttgttaaaacacaaatgttttacgaatgacaccttgctcaatagtgtttcctcgaatgactatattctataaaataaaaaagccagagcctctggcctacatgatgttcacagaaaagacaatgagcaaaatcatcacctgtgattttcttagatatgtaattgtcttttttccattggcttctttatcagggaggatatcctttgtgcctcagacctgtttacaaaggtatttacttacctagactttcatgccttaataataaatgttaacaaatttaaacataaggtaataatcaaaaagaataaaatagttacttatatacagatgaaaaattgtctacactatattaacccttgcgtgtatgtgtgtgttagaactggtattttaaggtatctggataaattcataggaagttattaacagtattataacctctgtgtctgggaaaatatgagggggtcattaaaagggggagacttttattttcagttgtttcttctctgcactgtttatacttttttcttaccttgaacatgggatacatttataataaaaacaaaatattttcaaaatggcactattgtgctttctcaaattttaacattattttacatccagtaaaactattcaaagagaaaaatttgataaaatatatacttgttaaatttaaaacgtgcaagaatgttttattattagctatgatgaaagaaaaccaggctatggtaattagaccactagcattcatagtaaattttttttaaatatacacaaaaagacttcacatacttgctactagtcatccttctctactaaacatattagtggaatactagttaatattcattctttgttatatagcttaaacatctaacaccagattggcagtaaatttggcaacattcttagtttttagtttacaatttaagtcatgatagccattttggatcaaatattagtacttagaattacagaactgaaattagcatcaataatatattcttgttcattttattataccaaatcacatgtctgacttctaaatgtatttgttcattatgatttctctaaaattattttaagtttccaaagaccattaggccagaggtaggttaaagtaagaaacatatcatatttgaaattatctctctgtctctttccattcactgttctcttgttttatccctaatgattatctaatccttcatgagagaagggggacaaaatgagataaaataacatcctgggctcatgggtacaattcaataagggacaggtttccctgtagtattcttggaagaattacttacttactcagacagcaatgagctacctggtctcctcaccaagtaaagtaataattacaggacctgttttttgactttgatatatctgtttccttttttggatattactcccaggctgttaattgcaactgttatatttcaagcactggcttatatggtatctccatatgccaagtaggacctggacttttcaaattatgctttatgcacggctcactcctgcttgttatagtgaagatatcctctatgattaagcctacaatgtctttttaaaaaaattgttgctcagttcatgctaattatagtttgctattttaaatataatggagtcaaaacgtttcttttcagactaatgaggcatcagacaatttggggatttatctctatatataggttgttgttctttttctaaagccagagaaaagtaatttagaatcatttaggaggatctatcacctgatttataatttggaaccacttattcccaagtattggtattattatttctttttaagtaactgaggacataacccaacttttctaggcataccctgacttaatgtgagctttctctttttaatgaagtcaatttattaagggtgttactaagtatatatatatttttataacatttttatatgaatacatttataaataaaacattgttgattaatgtttctcaaaatttggttcaggaaatattcttattttctttctggaaagtaaataatatgaaatataataataataaaataattttagagatttaatggcataaaatcctgctttttacggtgaggttggtgagatgacaggttaagcctgcctaggtagctgcttggagtttcttggcctggctaaaaattgaagtctgttcttatctttgctaaggtttggagaactagttggcaattccctattacagtcagatattgctagaggaaattctgggtctcatggctgggtggaacttgaaggacagttgcaatgattcaagtagtatccctgtacacttttgcataggtgcacttaggccaggtgagtaccaggatcaccgaatagaataattgtaatgatataggagttaagaagaaatgatttaggcagatagtgaaggtaaggaagtcctcagtaaggttttacttttaataaaaagcagcctccaaatcatttcttttataacaaaaagcagtgtgtaaaataaacctgcagacatagacaagcaagcttctagcttgcttgaatgctggcagctgtgccaataggaaaggctaactgggactaggcatgtccaacatggtggcgccattgtcccctttccttgtcaaccacatgcacagtaaggagcaggcaacatggcagatggccaagtagagattttatttgcgtaataaaagattagggtagggtgaccagcttcctcgcatactatgtaaacatcaaacctggtccaaccaatctttgggccctatgtaaatctgacacggccttctcaagcctgtctataaaatcctgtgcactcttccttggggccggaggccccattcaggtgcacttctctctcccaggagagaaagctattctttttttttttcttttgactattaaacctccgctcctaaacccatttctcatgtgtccatgtccttgattcccttggagtgagacaacaaaccttgggaatttaccatagacaaggacaccgctccacttaaactgattgcctaaactaggacactttggagaataaagggaggagaagggaggtgcttaaataattaaaattttatagttataaatattgtaacataaaaaattattacattccataaaacaaatatttctgatttatcacttaggataaatgaaaacatcagtgcagcaaggacattcataccattctgtgtgccctgtagcaggacttctcagcttcccacaaatgagggtataatttcctaattatccactgtccctgtcaactaatggcaaaaggactattggagctaatcttctctagatttcctgaggacaaattgaccatagctaatatatgggtgatatctctacttcgtggaactgttgggaaggttacattgaatgggaaaatgtatggaagatgcctactcttctgacactcctagtgccccaacgtttgcttccttcttccttccatttcttcctttctttattttattttattttttttttttggagatggagtttcgctcttgttgtccagggctggagagaaatggcgtgatctccactgactgcaacctccacctccacggttcaagcaattctcctgcctcagcctcccaagtagctgggattacaggcatgcaccaccatgcctggctaattttgtatttttagtagacacagagtttctccatgttggtcaggctggtctcgaactcccaacctcaggtgatccgcccacctcagcctcccaaagtgctggcattacagacgtgagcaatcacacctggcctgcttcctttcatttctttttccatcactcactgcacactcacataaaatctacacaagactcaatcttatttttattatagttaggggttcacatgtttgtcttattagactcagcattccttgagtacagcgtcctttccatacatctgtatactacctaaggtccaacaaattgctggctcatagaaaataaatattggccgattgaatgtttctgattctgcccaaggaagagtctgctttccagcccatcagaggagcgcaagtctcactgggcttgttcagcttgatggcagtaaaggctcatgactttctttgttcatagtgcaaagtctactttcccatctataatttgatttcttgaatagatctactcaccaggaacatgattcactgtgaaaaaagaacagtccaaggttttttacccactaatatatccataaataggaattcagttgaacctgtgtgggtttggttcatcagaccctttatgtgaaccaaatattattcaaacctctgactccaccatagtgattgaaaacatgaagcaaaaagatcagggccagtgtatctgaggccaagccatgcacttaagtcagcctgcacattatgactagacacgtgtacattctttcacaagttgaaataacgatgccatgatgtgtctttacttttcaaggagataattcgtttttgctgaattttactttttttctgttcttcagccatttttctccccatgtttttatagtaatgtaaataaattgttaaataacacttcattattgacataatctaccatgtaaggaaagaggttttattcctgcttctacttctgaggaaaagaggactcagaaagattaaaattttcttatggtcaataacttatggcaccacagtttgttttttactccaaatctagtactctttctacaatgacacctaccccataaacatcttgtgcaaagatatttataatatctccaatgaagaatttacattgaaaatgtgttagcttatataccagaaatgcttttaaaaaatgtataataaaaatgtgataagaattgtgtgggagataattcaattgcccttgctttatataattattgtctattttttatgtgcatgacctagatcctaggtttgttggatatttttaattgtatgttacaaactgacttcaactctgtttacaattttttaggctgtttgattggtttattggccatggctgatgtttgcagatactctgaatggggaatcattgaaaggttttattagcagtttattttaacagcgcaagctgttcatcagaaaaaatagcacaaatgcatttgaatgttggtctccaggcagcaaagcgtatccttccacccagcttcctaaaagacctactaggaaacttggtgccacccacacccatttcttaggggctctgatttagtgttgcagtttttttctctaaacagacgtgggtgaaagctagccagtgaaagacttaagggaaccattatatctataacagtggattagaaaatattaatagtaatcaaaggaaaatagaaatagcaatcgatttttcattattgatttaaaaaaaatttttcctgctccttggaatctgtgtttagagaaccctgacttatcctcttagagcaatatggacttccttttttgatggttttttgttgttgttgttgcttcttcactttctcatttcttcatatttttttcttgcctctgtaaaatattgttaaaaccatggatcaaaatatacattgttaaatgtgtctttttgccttaaaatcctttttacacttataaaagaatatatgtttcttatataattcttagaaaatagatattttggggaattattgtaatgtgagttcccatattaagctcttttattctgtccagagatatgttagtggtaagtaaaatatatttttaaaattaggtttaaaaagccaaactaaaaaaattaagattaaaaaaaagactttttcatgttacaaaaaaagcaacagaatcacggagttgtaagtggatgtggacggacatagctaaaatctcagatattttgggctccatttctggaaagagtcaaggcataaaaactcctaacagagacttaaagaaccccacatatggtagatatgttagttttctagagttgccaaaataaaggcttaaacaaccgaaatttattgtttcatcattctggtggatagaagtctgagatcaaagttccagaagggccatgctcctgaaggtgctatggaaggatctgttccaggcctcttccctagcttctggtgttgtgctggcaatctgtgctgaatgttggcttgcagaaacatcaccccaatctctgacttcattattatgtggcgttctccctgtgtgagtgtctttctcttcacatggtgttctttttcgaaggacagcagacttattagattaggaactcattttgcttccatatgacctaatcctaactaattacatctgcaatgacactttttccaaataatgtcaccttatgggatactagaggttagaacttcaatgtataaatttgtgggggacacagttcaacccaaaacgtcagggtaccagggcagaactcactgcagggaattaggggctaggaaaggaggctgacttaagctgtttgttctaatttgcatacattggatggcgagaaggactcagaaccaggccaaaccacccgattgttccaagacagtctgtgttagttccattttctggaatgcataggcctcatgcaatacctctcctagagagtccagatgcaggcagctgcaaaatgatagaagggaggaatgaattcagagagagagcagaagaaaaaaaaatgcttttatgcaaatcgaagttgccaactaaaattctaaggcacatagaaaacaatcaatgccagctgggcgcggtggctcatgcctgtaatcccagcactttgggaggccgaggcaggtggatcacctgagttcaggagtttgacaccagcctgaccaacatggtgaaaccctgtctctattaacatacaaaaattagctgggtgtggttgcggtacctgtaatcccagctactcaggaggctgaggcaggagaatcgcttgaacccgggaggcggaggttgcagtgagccgagatcatgccattgcactccagcctgggcaacaaaagcgaaactccgtcccaaaaaaacaaaaaacaaaacaaacaaacaaacaaaaaaacaatcaatgccaaggaaaaaagcttaaaaaagaaaccctcaacattagaagatgaacttagtttcatcaacaagtgaataatagtaataaatggcttgtaattaactacggtcaaaatcatcaaaaagacagaaaaaggaatactaaaaatttaatgaaacaaaaactggcaactgtgaatcgaaaatgaggaggcatcaaaagtgtcaaaattgtgcatataggtattgatataacttaagaaagaattagcaaaagataatgctgaggatttcatttatagcacacagccaaattatatagagataaaaatatggaagaagagttaagctacacagatgatctactgaggggttacagtacatgggtattaggagtctcagaaacaggagaaatggcaaagaaggaatgtttggagagaggacagctaaaaatgttttttttttttcagaattagagaaagatatatactttcagattagaagtgaagattaactgttatagaggtaattaaagccataccacctctagtgaaacctcagaacatcaggaataaagaaaaaattctaaaatcagcaaggctgaaaagacagaatgcctaaaatgccatagttttttttatagtagaatctagaaaacaactggagcaatatctttaaagtggtgaagaatacacagttgatgctcatcatttgtgagttctgtaccaggagactgcaaaaaatccaaccccttaagaacaatagttaaaacgtcatccaggaattaaagtatgcttccattttttgtaaatttttgttcactgaaacataaagtgattttttaaaatgttaggtaatttatttaatggcacattttaaatctttatattcctaattgatcgtagtatttttattttaatttccatagtttactgggagaacaggtagtgtttggtgacatgagtaagttctttagtggtgatgtttgagattttggtgcacccatcatccgagcagtatacattgcaccatatttgtagtcttttatccctcaccctttcccaccctttccccctgagtccccaaagtccattgtcattcttatgcttctgcatcctcataacttagctcccacttatgagtaagaaaatacaatatttggtttaccattcctgagttacttcacttagaataatagtctccaatctcatccaggtctctccagatgccattaattcattcctttttatggccgagtagtatttcatcctgtgtatatataccagagtttctttatccactcattgattgatgggcatttggttagttccacatttttgcaattgcaaactgtgctgctataaatatgtgtgtgcaagtatcttttccatgtaatgacttctttgatttttttaaagcttagagcatcattaataaaatttaaacttagaagagatattcacaaattcaatgaaagcatattctttgtttacttgaatagggcatcacacctttagcaaggaacaaacaaaagaataatctatcacatggatactatactagtttgcttctgctatctaatgtttaggtaattttgatttagttttttttttcctgtattgtcctatgtttagtaaagaacccatctgtaataaatatttcatttttttaattggcctaaggcaggcctcaccttgcttgggtattaattgtttagagatttttatgtacttgaagtttcagagaaattttgttaaggaaaggcattttctgtattcttttcgtaccgtatatgcctttgttggaatgtctctgtatttagcattaagatttctgcaaaacctggccaggtgtggtggctcaggcctgtaatccggatctcctgaggtgaggaggtcaagactagcctggccaacatggagaaactctgtctctactaaaaaatatgaaaaaaataaaataaaataaattagccaggcgtggtggtggatgcctgtaatcccagctacttgagaggctgaggcaggagaatcgcttgaacccaggaggtggaggttgtggtaagctgagattgtgccactgcactccagcctgggcaacagagcgagactcagtctaaaaaatatatatatatatattcaaaacccagcaagagagcacttgtttaactgctaacaagaagcagctgttttccatgggcgatcaatcattattttctgtacttttttttccaataaccttattttcaacttatgtcgtgtcctgctgaggacatgttcaggaggcttgtcatgtaacagaactggacacagcttgagttttgaaacagcagacctacaactgaaaaaaggagtccaatatttccttctttaatgattctgctattataataataatggcttttacagagacaggcaaagtgtagatggagttctggttcctgcatggaaatttgtgtgtgttaagtggggatataggacagacaagaggatttttaagttgactattttacttcaagctcttttttgttgttgcttttatcttctcctcgggataatactttcacccttatcaactcgtcttagatgcccagtggtctccaccgtatcaaaagcagaataagggaagaataggttattgctgatttaattcttagtattactaaaagtaaactctctcagaattttatttaatttttatcagtttgtctttggtaaataaatctcaaatattttgaattaggagagataatttgaaaggatcctcctaaaacaccttaataataatgaaaataatattagaagctaacatttattggcttctcactatgtgttaggctctttgttatcaattttttaaatcctcaaaccaatcttatgggttaggcactattactgaggtccattttatacagataataaaagcttaacaaggttaagtaaccagcagccttagcatcacataaaagaatgttacaaatgcaaaatctcagcccccactcttgaccttaaaaaaacagaaacttagaatgtgaaacccaacaatctttttgttttaattaaccaattggttttagtaaaccctccaggtaaattggataccattaattttgagaaccacttccaagcctttctagtggaacttctcaccagtctttttttcctttgtgctagagggcaggggctgtgttatgtttgtttctgtgtttcagtgcctaaaaatgtgtcatacatgaaaagtgttcagtaaatgtgcactgcatagtcatggatgaatctataatgaatcatcctatgtagctgtatttggggatgatctgattattcacatgcccattttaaccaggtccgttttctcatctcttgggtagaaaggcctgtaatacctttccagcaaacattagtcttctgagacaccaggaccaatgtgcagtcatgggatttttatttgtgaattagagcattctttttaagacctcaatccctcagcaatgcagctgatgtattgtgctttctttctttcttttttttttttttttgttttggacaagatgggagtggggaatggaggataaaagcaagggtttctactatgttctaaggcattcaagagaatcacaaataagagtagctaagcagacgagtcttgaacacctaaaaaaaataagcatcaaattttgaaatactaatttaaatctgtgaaactacattataaggcaggtcataattaataaaacaatgtatgcagatagttattaacaatgttgagtgtgttactgtatcaagagcattagaatacgaatcagcaggccagggctccagactctttctgaccattacttgccatgtgctgatggatgaacatctaagctctctggacctgtttcttcatctgtgaaatggaggaaatagccctgcctacctcataagtttatttattcatttattgtcagtcacggtgatgaagcttcatttcacaagattatgagcctcataagtttgtttagacaaacaaaaaacacaatgtacaggtatttctactataatatgagttcctagaaaacctcacagccctaaaaatcattaatgaaaacaagggcacaatactaaaaacaaatgcaactttataacctgagctctatctaaaatgaccatactcataacaatactattgcaatttcaaagacaaatgaaatcctaataaatcaattctgcagtaaatatagaactttgccttaagaaaaaaaaggagagagagagagagaaagaaagagagagagaagttggcttgataaaagggggtaaggaaggattgaggcttttgagctatggaaggcaggtcaaaatatacaaagtgcaatgggtatgtgcttccaagagcatggatttggttaacccaagttaagaggaagaatatggagtaagggaggcattgtacgtagtcctaaagttgtgtagtgtacatttagctgctggcacttggttgggcaaaacactaatatgctaaaaaaatttagatctgaaccaatgcattaaattaccctaattccttcatttaccaatatcttatctgctaattctccttccagcagcacttgtttaaaaaacaggctgcatttgaaagtgttgtaaagcgtggcacagaagtaggctagtattattaacattactttatccaggtttataaagaaaggcccaatataactaaagtcattagtgtaatcaagtcctctatgaatttttcattaaatcttttacaatatgcaaatggtagtgtgccgagtgacttcaggaatattagtcaaatgaactatttgttgtggtctgtgaattctattctgagtgattgggatgtatctttggatgcaatcagtcaatgtccctgtgtttatgaaaattctacagcgatgccaagacaatcttagcgtctccaggaattagtcatttagaataactaagcctcctagaattttgtttctgcacaaaattattttcatttggaatcttttctaacttaaaattatggcaagtagaatagtatatcacaatagtaatgcatttcttcttaccatggccctaggagtctggaaagtataaaccggtttttccacccatttcttcatctaatctactctcctcacctacatttaggcacaccttccctggattttgaatccatttgcctcacaaagtggttgtgatgctgcaggttttgaaagcctaaacaacttgaagggaattttactagattaagtggggaaagaatttgggaaaatataaaaagtgttagacttttgtgtgaagactagaaaaaaaaaatacaccaagatgttaacatagagtctctccgaagagtggctttctgggatatttaatttccttttgaaaaattatttcctgttgtctccatcttgtaactatagtaatatgttatctttataatcatattttaaaatgtttatgcctgaggtaagcttgagaacagggtagggacctatttccttagattaagaagattgtttaagttctagttttaaaattctgagatccatctgtctgtctatctatctatctataatatctacctatcatcacttgtttagaggagaagagagtactgtgtcaccctttacagggatattaatgctgatacacaatgatatatataagtgaatttgaggtttttcattatggattggacaagattattcacacctctctctctttttgaaaacaaaaatgcacgtgtatagggtctgcttaatgtaaaaaatagtagttaatggcctccagataataaagtaatttctttagatttcatcctggtattcaatctgtaatctgggtcttcttcacttccctgttctttcattgaactcattcactgacatttttgaaaatattaagtagattttagaatcagtaagtgttaccaacaatatcagaaaaaaataatcttagtgagctagaatcacccaagaatttatcagccgaagtcacctttgtctttcatcttatgaagaggtgggaataggggaggtggaaagtaaattaaccctttttgctgtcccttaatatttcaggaaatgagtatatataaaaaagacttattatctctatcccttagggagattgtcagggtttttaatacagtattctaagaggtttggatacgatgctaatgagcatactgaactgtattcactgtattaaaaactcatttgcttcttcctttctatgtttagaaatgtttttaagaccagttgctagattattcattttcacctcattaatgtaaaaaagaaagtatgtttatggtcttgaactttgtgagtttggtgtgaggaaataaacagtagcttttaaatatgtatgttgctcttaatcaaaagaaaatctttcataggttgataatagaaagattcagcacattacttttgagatgacattttgataatgtatgatttaaatgggaaatatatgtattaaatttctgtgaaaatattcatgagaatattagagatacatttggatgtgaggatatttaaaagtaatagaaagtttttctgggctcaaaatatatttctgaacaattaaatttgaaaatctctactataaaaatctctaatatatttttattaaaggaaagaaaatgatactaaatgtcaaaatttatactcaaaataatatattttaaaataaaacttttatatccttatcctgtaatttctgtacttatacttaaagtattataccaaatgttattactcttgcttaaagaaacttttgagagaatcttgaaggtattttgttcagagtttattagaatcttagaatttcagttaaagttttcctttatactgagtgaaatatatggaacaattattaagcatttgtagcaaatcaaaataaaggtgattataacaaaaaatagagcatttttcacattgtaatataaattaaaaattagatgaaactgagcaagaatatcttttctttatacaactttccacttggttaaaaaattacagcttcagttaaaagtgcatacaaaatttatgaattttagaatttcttctttaagaaaaagctggttgatcatcagagaaatgctaatcaaaactatgagatatcatctcacctcagtgaaaatggctgttattcaaaagacagacaataacaaatgctggtgtagatgtggagaaaagaactcttatacactgttgttgagaatgtgaattagtaaaactactgtggaagacagtttggaggtgcctcagaaaactagaaattgagctaccatatgatccagcaatccctctactgggtatataccaaaaaaatgagacatcagtatatcgaagagatatttgcactctcacatttgtggcagcactgttcacaatagcccaaatctggaaacaatctaagtgtccctcaacagatggatgaataaagaaaatgtggcacatgcacacaatggagtactattcagccataaaaaagaatgaaatcctgtcatttgcaataacatggatggaactggaggtcattacgttaagtgaaataaaccatgcacagaaagacaaacatcacatgttttcacttatttgtgggatctaaaaatcaaaacaattgaactcatggacatagagagtagaaagatggttaccagtggctgagaagggtagtgggtgttgtgagagaggtagagatggtttatgggtgcaaaaaaatagagtaaaaaagatttggtatttgatagtacaacatggtaagtacagttaatattaatgtagttgtatgttttaaaataactgaaagagtaaattggattgtttgtatcataaaggataaatccttgaggggatgtatacggcattctctatgatgtgattactatgcatcacatgcctgtatcaaagcatctcatgtactgtataaatatatacatacttactatgtacccacaaaaattaaaaattaaaaaaatgaaaaagaaaaggtttgtcttagggaaatttcagtaaattgcatttgaagtttgttgatgatgggggctgagcattaatgttttttgtcttccacgtaacctcacagagtcatattactagtaaatacctgttttttattgattcagttaaccagaaatttatctgccattattatttttaagaaaacacattaaagctctgccttttaaaaactatcttttcttgatgttgttttatgtaactaaataatttgtcactcttttgctgtgttttatctttttcagttacaatgcctgtggaattttgtccaggtttctgagtgcaggcttccattttaattatctttccacttattttcaattatccataattttacttgcatttagtaaacatcttttctttaccacagttttatctctctttattaaacattttttttgctttaatctcaggagagcctcagagaagaaattcaatagtttccaccaatagactcatccttagaaattaatagtaaaatgttgttttacagaaacatgttacatgttcagaaatacgttatatattcccataaaactggaagccaaattatttccaacattaacattttactatatttttttgaaaattttttattgtgaattattttgtttcatatttggttttaagcccgatttttaaatgaattgtcacaaggtggattcccaggaagcacactctgagatggagataaatgagccagcattttatagggagtgcccttaggctcaacaacagtgggtggaaaggcggggaaacaggaatggacaggagaaaatggagggtgatgcagtcacacaaaagcttcagcccatcttaggggaagttctgaagctgggatagcccttcacagtagtcctcacataggaccaggggttgggtttttatactccacatgaaccagtcatttgatttgtgctgtcccagaaagggaacatgtccttggataagggagctatcttcagcaaaagcaccccaaggaggggtgacagctaaaggctgtagactggcggcactcctggcacgtggggtggaagccttcgttactgaaaggagatccgggtggtagatctgatagcatccactacagtagcctatcatgtgaagaggttgacacatttagtgagtgcaaattgagctgttttgagctgagggactctcataacttggcacacgtaattgagcagttgctgctttctttgcctacctgcttgaatccctgacgttttagttttctttgcatatttcgaaaaccaacaagtgatgtgctttgttttctgatattttgtgttacaaataaatatgaagacttcatagatttaaatgacagtgggtctgttatattgctatctgtgtgtagtttttcttaaaatattagggtagatttcaatatggtttctctgatgaccttgtataatttgaatggacacttttaattagagcctgcaaaatttctaaatgtgccatatggtttgcataaagatttagaataaaagtaaggataattattgtctgtggaatagctaaaagaatgttcaactagccaactatcaaatgtgattcagatgttaaaaaataaaaaactgaagcaacagtaatcagtttggaattacatgtaataattatttctggattttttattttctgtagaatttgtggtaaaatcttaatgaaagtattaaagactccctcctaaaaaaaagtacagacatacttgtcttattgcacttcactttactgtgctttgcagatactgcagtttttacaaattgaaggtttgtggcaaccccatgtcaagcaagtctatcagcaccatatatttcccaatagcatgtgctcacttcatgtctctgtgtcatgttttggtaattctagccatatttcaacattttttattattatgtctgttgtaatttgtgatcggtgatcttcgatataaatatagttgtttgggggcgtcacaaattatgcccaaataagatggtgaacttaatcaataaatgttgtgtgtgttctgactacgtcaccatcccgctgctccccaatctctttcctgctcctcaagcctccctataccctgaaacacaacaatattgaaattaggccaattaaaaaccctacaatggcctctaagtgttcaagtgaaaggaagagtcacatgtctctcactttaaatcaaaagttagaaatgatgaagcttagtgagaaaggcatgtcaaaagcctcttgtaccaaacagttagctaagttgtgaatgcaaaaaagaaaaaaaaagttattgaaggagattaaaagttctgctccaatgaaaacatgaatcataagaaaccttaaggctgtatgaagaaggttttattgatctggatagaagatcaaaccagtcataacattctctccagccaaagcctaatccagagcaaagccttaactgtcttcaatttcttgaaagctgagagaggtaaggaagctacagtagaaaagttggaagccagcagagcttgggtaatgaggtttaaggaaggctgtctccataacataaaagtgcaaggtggagtagcaagtgctgacagagaaacaacagcaaattatccagaaggtagagctaagctaattgataaaggtgtctatgctaaaaagtagattataaatggggatgcaacagtcttctattggaagaacatgccatttaggacttccatagctagagagatgtcaatgcctggtttcaaagcttcaaaggacaggctgagtttctggttaggggctaatgcagctggtgactttaagttgaagccaatgcttatttaccattccaaaaatcctaaggtccttaagagttatgctaaatctactctgcctgtgctctataaatggaacaaataagcctgatgacaacacatctgtttacagtatggttgatgaaatattttaagcccattgttgagacaattctcagggaaaagggatttctttcaaaatattattgctcattgacaatacacctggttagctaagagctttgagggagatgtacaaatagattaatgattttatgcctgctaacacaacacccattctgcagcgtgtggatcaagggggacaatgatccttatttatttaagaagtatgtttcataaggcgatggctgccataagtagtgattcctctgatagatctgggaagaataaatttaaaatcttttggaaagagttcatcattctagatgccattaagaacacttgtgatcatgggaggaattcaaaatatgaacatgaacaggagcttggaataagttgtagatgactttgaggagttcaagacttcatccaactgttgtggatgactttgaggagttcaagacttcatggaggaagtaaatgcagatgtggtggaaatagaaagagaactagaattagacttggagcctgaagatgtgactgaactgctgcaatgttatgaccaaactttaacggatgaggagttgcttcttacggataagcaaagaaagtgggttcttgagaaggaatcttgaaagagtgtggacgttgttgaaatgacaacagggcatttagaatattacataaacatagttgataaaccaatggcaaggtttgagagaattgattccaattttgaaagaagatctactgtgggtaaaatgctatcaaacagcattgtgtgctacagagaaatatttcatgaaaggaagagtcaattgatgtaacaaacttttttgttgtcttattttaagaaattgctaccatcaccccaaacttcagcaactaccaccctgatcagtcagcaaccatcaacatcaaggcaagaccctatactaggaaaaagataatgactcacagaaagctcaaatgatcattagcactttttagcaataaagtatttttaattaaggtatgtacattgtctttgagacataatgctattgcacagttagtagactacagtgtagtataaatataatctttaatgctctaggaaaccaaaaaattcatgtgactcactttatttccatatttactttattgcagtggtctggaactgaacctgcaatatctctgaggtacttttgtatggtggtgtagatatcagatataacttactctaccacatgtttggagcaggtacttaaaaatacattaaaacctagccaggcatggtggcttatatctgtaatcccagcactttgggaagctgaggagggcagattacctgaggtcaagagttcgagacaagcctggccaacatggcaaaaccccatctctactaaaactacaaatattacctgggtgtagtggcacacgcctctaatcccagctacttgggaggttgaggcaggagaattgcttgaacccgggagacagaggtttcaatgagccaagatcacaccactaaactccagcctaggtgacagagcgagacttggtctcaaaaaaaaaaaaaaaaaattaaaaaattttctgtgtggtaaataatgatgcttttttctgaagtttagattctgaaatgtgggcaattggctttgcttctagctcatcttaagttagtgaagaagttaaagaaaaccctggaaaggcgtaattgcagcaatgttattatatatagaatatgttatatattcactgtctgatagagattagcatcaacatgccgttggtgatttcagatgtccagttttagagacacaattcgtgtaaatttaaaagcacagaagcaatgcattcttattataatacgtataataaagaggaagtgaaattatttcttcagtaactttttctgccttttgtgctcacccttcccattgcctagatttaactgctgttatcatttctgtgggcatccttagtcttagtggtctccttctaaaatatatatgtatatgtgtgtgtgtatagattcaaaacatttacttagatgcatacacacacacacacgtatatgcacacacacataggttgattatccaagtatccttaatctgaaaatatgatatatgaaatgctccaaaatttgaaactttttgaagctcaaaggaaattctcattgcatcattttcaattttagatttttggattagggatactcaactggtaagtataatgtaaactttccaaaatttgaaaaagttgaaacccagaacacttctgattccaagcattccagataaggggttctctctctctttcatgtatatctatatatccacacacacagtcatctatgtcatgtcacatatattgggcatggactcttttctgtctttctctttgacttagtattatgacatagatatatgttcattccagcacattgaaataaaacttattttttcaaactgctgcacaatattctgtagggtaaagttaccatttatatataagcatgtaaaagaatataaattgtgttatttaagatatatttaacttgttacagttaattaattttattaaataggtaattttgtattattttgtttattccttttttctccacatttgattattatattttgcaaaagtttaaatatttcatttttattttaatattttgagtagaatattaattgtaaaataaatcttctattatgtattttaaagtaactttatgttcttctcgtctatattttccttttctctgaagcagcttcttctgtgctttttctcttttctgagaatgcaagttcctctacaacgttatataagagcaaatgccaggttcatcataaataggtacaatcttataaattaaagtttacctctaaatatagtttatattttgggttgaacttccaatttttgaaacatacatgataaaactctgacctactacagcacattcttccaatttctaatcaatgtccattcaaccacagcaataactgcttcataagctaaattagagtgccttcttattgctgataattcttggtacagcctcttgagcatcaagtgcaaatttcaagagaatccatccctatacaaattcagcgttatcagcctgaatccagacagcttttgcttccttttgaatgttactagcctgtacttttccatctctttcatttgtgctgcctttgtgaatccacaaaatcacgttcagaacagtagtggaagaaagagcacaggggttagacgcatgtttctttactaaagcacttcagcccttacaaatttatcttccttgttcaattctcactgagaacctcatctatgtcttgtttgcctgcagtcagaaactcttaaatgataagcctgaaaatgtatttttctaacattgtcacatcaggtgctaacagagttctcccttttggaatcagatacactctctaaaaatgaatgacttaaatcttggtccatcctgtgacatttgttgaaatatttctaacatccgccaaatatattcttggtaccactgcctctttgggatcaaagatttgtctcttgataagtggattttttttattatatctcttttaggttaagcaagttattttgttaccaagtatgtatattattattcatttttaattaatacatctttcttgggtatctactattcccaagatattatggtaagtgccaggggtcatttacttctagatctaatgaagtctttatgaaagatgaagaatctcagctgggacatgaaaaattgtagaatttctgcttatggaaaatggaaagatcactccagatgcagggttttaaatgagttagggcatagagttagcaaacagcctctgcaataataagtgacagtttgattcaggccctgagcacagaaaacaaagtagtgagatgttagtctggaaggagggtcagagctggagaactagcttggatgtgaggagtttgctgtccatcctgaagacattaggaacacactggaaatgggaatttgccaacatattaatagttttcagcaaacaaccaataactttcagacattggttcatgaaactctgacataaaggtcgatagtttgatagaataggcgaggtacaggtatccttcgataaagcagtgttagcagcacaatggccaggatggctgaactgctgaaggagccctaactcatttaaaaccctgcatctggagtgatctttccatttttccataagcagaaaatggtggcaatggagcagagactgagtgggggaccactggcttttgcagttggaggagggagcagaatgagggaacagagtgagcaaaatggaagacaaggaaaaataaccagtggtaaaggagtgaggaagatatatgctgaagggagtaactgatgttatgaagcctgaaggatggaaatggaatcagatggaaggcataatcttgtcaaatttactttaggacccatggcaaggaaaagaaaatgagtggaaacaaggcattttgtgccacaaagagggaagttaggagagtcttcactacctagccaaggtttacaataagatcaaaagggaggctgggcatggtggctcatgcctgtaatcccagcactttgggaggccaaggcgggcagatcatgaggtcaggagttcaaggccagcctgggcaacatggtgaaaccccatctctactaaaaatacaaaaactagccaggcatgatgccacgtgcctgtagtcccagctactcaggaggctgaggcaggagaatcacttgaacccgggaggcagaggttgtggtgagccgagtttgcaccactgcactccagcctgggcaacagagtgagactccatttgaaaaaaaaaaaaaaaatccaaagattcccagttcctggaaagtgagaagtgtgttcaggatgaccaatacaaaataagaactacagtccccttgttcaaaaggcaggaaagatttgttaaagataataaaatagaaaacatattttattgtctctctctctctttcatcctgtcatggtgtttttcatttgttattgtgctctttgaacatcgggatactaatagtgggaaggggtgtggagactcacaggtgccctgcaactcggctcaggagtgtttgagcaccagcacactgccctcatttggggcagaaaagccaatcttccctccctaccagcttgttcctctccccacaatggatggacggaacccaaaggattgcagcctctgagctgtgactcacacagtactgaatcgatagagggtcagtgggagggtcacccctactatgtcacccttcaaatgctttgtgacctgaactgagactggctgctgccataatctgcagaaataccagggagaacgtccaccaccttggccctcttgcaactgtgcccattccctcacaaaggggtgagggaagcagagagcaacagtagtctctgattggcagtggggagagggatgatgggcagccctgaggagagaagagatgcgaggaggtggaattgtgcatgaactgaggctccaagtccctcgtgcatgctccattgtcccacctgactaaaaggaagttccaagataaaaggaaattccaagataaaattaatagatatttcaagacggtgagcaggggccatcaaaccctgagcatgggacacttctaagttcagggcccttctaagttcagggcccccagcaccagtcacttgttcatgaagctagtgctgagtatatgttgtgtttgtgcacacgtgcatgtgtgtggggtgtgtgtgtgaggatgtatcttaagggcagcacatattgaaagcttagaatagtcattctgcagaattcaatagggaatcaacatgtgctgaatggtaaataatacatagttccttcaataatgctgtaattcatgagtgtctttggagttaaagcagaataagtggatggcagagccacattatgattattgtgggccctgggcacttggcactttcattttactggacctctttctccatagtaaaaaactaaaatgtatgatttataactgcattggtataagggtgaatatgttaatattatatatgaaaatatttttcaaccttaaattttttttcttctgatttaaagatattaaaacatatatgtgggcctctaaaagtattgtgggttttaggcacagtacctgatggataagttggccctagtggatagtgggtatcagtcagaaatgccacagtacttgaataataggatcaggggaagggattctggagagccagtggggacagcatgatatcctggctgggtgaaaacaggtaagtacttgagggaatgatgaattgggagccacggtgaaaggagaggtaagttgtcaaatggaagtttggggtcagatggagaaatgggctaagtcttttggtgttgaactactcaaaaatgaaaaggtttcatgcttttgtctagagataaaattcagtcatttgccacatgactgttttattttatgtctaattttattcatttgctttgctatatgtacctatattgtcatcaataaattaattccctaggaaataaattctaggaaaacattttagattattcttaaacttcgaaatggaaagatctctagattacattattttagttctaattttttgactgagattaacaacatcaatgagaaaaagaaatattgtttcgtttcagttgggacattaaaatataatcagtgcaccaattttttgtgcacagtaactttagggttttgaattcagcacatttatacttaatttataagtgctaatgtttctggaattattttaagcaatatagcatccgattatatatgagctactttataatattagaagtcatatttaactacaggttaagtgactacattaaaagggaatacaattattttaatggatttttaattaaatgcttaagtcctaggtagtctagaggtgcactttcaattaaattgatctttcttggaggtttggttaaaagctgttggcaagaagaaaaaaaagattgtgtttttagttttggtaaacatcagacaaagaaaggtagaaaaaagaacagtagaatgtaatttaataataggtgaaaaacataaacagacatctcactaactgtgtaacttgtaaacaaacataaaatgtctattcttggtagcaataaagtacaaatcaaagagaggcaccaattttactacataaattaattagcaaaatattgcattgttttattcattctatcttctatatgcaattttttatgttttaaagtatctctttttctctgattcaaaaaccatataattatggattttaccccctttcaaatgttgtgtaatgtggttatgttacataaataccgaaagacaagagggaggaggagaagtagcagcaggagggataggaagacataggaaacataaaacagcaagctccctacagctggaagtatttaatcagagtctgaatagccatttgttaaaaatgttgatgaagcgactcctatagtgtatcgtttggagtagtttatcttctaaggtcctttcaaagcctgcaactggataaatcagtgagatttctagtgttattaataaaatttcttactaggagaaaaaaacaaatggcattagaagtgacacaatttatcttcacaaacatgtaaagcaaattcaagcttttgtaatataaataaagagcgaatttcaggcatcctttttattttgttattaaaccttagcctgtatttgaggcattaagtaaatgaaaaactacttagtttcttaattatttgggaacttttaatatacagttaccttaaatcttacagtttagatcttttcctaagtgtggtccttagaatacagtatcagaatcacctggagagcttgctaaaatgcagatcccagtacattgaaactgctggatcagaaaatgtggagtttaagtctgaagaatcttcattttaaactaatttcccaagttattcttatgcacccaagtttaagtactacttattatgctcttgaaactcaaagtgtgatccatgaccagcaacatgaacatcgcctggagtttgttagaaatgcagactcttaggccctaccccatacctatagaatcagaataatcattttaacaagactcctaggtagtttgggtacattttaaggtctaggaagccctaattagacaatatccaaagagtgacaaaatgaagtcaaaacttcactgtttcgtcaagtatataaccagtggtttactttcactcaacaaatattcattgaaaataaacaccgtaggccgggcgcagtggctcatgcctgtaatcccaccactttgggaggccgaggtgggcggatcacgaggtcagtagatcaagaccatcctgactaacacggtgaaaccccgtctctactaaaaatacaaaaaaattagccgggtgtggtggcaggtgcctgtagtcccagctactcaggaggccgaggcaggagaatggcgtgaacctgggaggtggagcttgcagtgagccgagatcgcgccactgcactccagcctgggtgacggagctaaagaaacactgtaacagctaatatttgagaataaatgaaagacaaattctattctcatgaaatcaataatcacaacatcatttgataaataagggatgtttaaatattttaattctctaaaataattttacaaagaatcaacaattggcatttttcactgatgtaagaataaaacagattatgtctactagaagaaaatgatgtgaatttttaattgagtcccacttttataattttatatattttaattggtatacaactaattttgttgatgttctcagtcactaaattctatgtatttggtaatgtgatagagtgaagatctgggggcaacactacaaaggtattatctaagtggaagggaaagtgccacttttagaatggctgtataagctccaatcagaatgaaactctcacaaataacaataaactcaatatttacatagttgtttattttgttttaaattacctgacagcacaaaaatagagagattgtagaaggaaatcaagttggaagaagagggtacagtgattttcccatttttaagtgttttagcctgcaggcaggctcgtatctgcaccttgtgggcagctatgatagtgacacaaaacttagcagagggttttcctcaagtattaacagagtactgatcaacacatgcatgtgaggaagtcacacaaggctggagaaaggagcactcaaaaatattagagagaacaaacagttgccaataatgctcacataaggataggaatcgtccctcttctcatcaaccagacaagaaaaccttaaaacgcacaaaacactagaatgaatagtcaatggctttccttggtattattagcctttgactgaaaactattcatgtcttatatagcaagtcttaaaagcaagatgcaaaatgatcaaactgtttccaagaaacaactacatttgtgagcaacgctcaataatatttagaggaatacagagctgtccagcgtttaacaagtaaaattcagtgtctggaatccaatgaaaaattagtagcatgcaagaaagcatggatgtatgactcatcgtgaagagaaaaatcaataaaaactgaggtcactgatgtgtttttgaatctaagagtggggggaaagtaataagatttctttaaaacaagcaagtagaaattattgctatcttttcttaaacaaacaaaaaaaagaaaacatagttgtttcatatctcctacactttcctggaaattctatcctcttacctgtgaaagaaacaagaaatcttacaggataggaaggtaatttgaggagtatgtcagatttccctaaataatatgtctttaggcattcagaatatacagacctctgatttctaactgactgcaaaaatagctagttgattattacattttgctgaaaaggatactaagcttatatttggataaaattcaccaaacattgtagaggtagagggggaaagagagagaaataaaagagggggggagagagaagactgtatgactagtaataacagagcaaaatattttaaaatataaaataaaaggtaagtagtcaaatgcatgaacataagttggaaagggatatatggattactgaagagaagaagtacatgcctagtcctcgtaagacaacctctcttccacagtttataatctctctgccaccaatgataatctagtatcccaaaaggaaaaacaatatgtaataaatgttatagaacatgaagtatcatgaaatcagccatgaaaatcaagaagtatacatcattctatttgttttggtacatggaaattatttcttttcataaaaatacaaactaaaactacaggacaatataagtaaaatcatgtggagtggtctatcatagttatgtcggccttcccgtcaactctcccatccatcttagtcattctttgtctctcgctgtgtgaagaggatgtttctcttgtctagttaatcatttgacacctgattggttagtggctagaattagataacaaaccaggcatttggtgggataaatggaaggagagagaggggaagggttctgtgtaaaggaaattgttatcagaacttccatagacattttgtcatctagccatttatgctattctcatctgagcaaagcaaaaattattgaatcagcaatggtcacaaacatgaacagcatgcttatttaaaagaatgttgaccacagactcaaagttatctgactttttatcttaattcaaatctgagatccatcactaacaggacttgtgcatatctcctaatttcttggagtcttataatcatttcattatctttaaaattcatagtaattcttatcttttaaagtttcagggaggacaaaaggggacaaaaataattaaagtctgaaacaaggtaggaagccaaaacataccagttccctacctgccattcctctttcttagattacccagaatgtagaaccattggccataaaacagtctgtagacaggcctgatggagtaacagtcaacaatgtttacctgctctgataaatattttcgttgtcatagcatatgggagctcccaaaatattacccaaagcatacagttactggctcaacataaacatgaacaatgacttagagatatcctgagaataataattcctgtctcatagggttttaggaagaacaaagcagtggcttgtcttatgtcaggaatatggaatagcagatgcatttctctaaagatgctctttgagtcatccaggatggtgggctcatttttgagataaccctggattaatcaagactcttggttgtaactgagtgaaatttacttaacatcagcttaaattgctgctgttgttttttgggaggaagtattataatatgtaactgaaaaatgcagatattacccagctttcaggcagaattgtatccaggcacataaacgctatcttcagagggctgtctcttttcatctcctgattctacctttctctaggttgtctttattctcaggtagactcatcctatggtggaaaacacatcccctggaagctgaaagttttcactgtctcttgtaatggatgattccagagaaaaggtagtggtgtttgtttgtttgtttcctaacagccttagcaaaagtccctgatagaattttacttcatttggcttgggtcacatgccctttcttgatctactgaatgtgactaaaaagatggagtcctcaggtgtaggtccaaccccacagggtcagtgggtctctccccgtgtgcggagatgagagagtgtagaaataaagacacaagacaaagagataaaagaaaaggcagctgggcccagaggaccactaccaccaagtcacggagaccggtagtggccccaaatgccagactgcactgatatttattggatacaagacaaaggggcaggataaggagagtgagccatctccaatgataggtaagaccatgtgggtcacgtgtccactggatggggggcccttccctgcctggcagccgaggcagagaaagagacaaagagagaaacaatttacaccattattagagacttttagtactttcactaatttgctactactatctagaaggcagagccaggtgtacaggatggaacatgaaggcggactaggagcatgaccactgaagcacagcatcacagggagacaggcctctggataactgtgggcgagcctgactaatgtcaggccctccacaagaggtggaggagtagagtcttttctaaactcccccggggaaagggagactccctttcccggtttgctaagtagtgggtgtttttccttgatacttacgctcccgctagaccacggtccgcctggcaacgggcgtcttcccagacgctgccgttaccgctagacaaaggatccctctggtggccctgtctgggcataacagaaggctcgcactcttgtcttctggtcactcctcactatgtcccctcagctcctatctctgtatggcctggtttttcctaggttatgattatagagcgaggattattattatattggaataaagaataagtactactaactaatgattaattatattcatatataatcatatctgagatctatatctggtataactcttcttgttttatattttattatactggaacagctcgtgtcctcagtctcttgcctcggcacctgagtggcttgccacccacacttaggttgtctcagccagggcccctgtgcctgccctgtgactttgtggtggtcctggggcacgggaatgggaatagccccccacttcatcccagcatacatatgaggagttctataatcagggaaaagaaaggagtaaaaaagttctgtgcaggtaaatgcattactagagcctttcggagtcagtattcattcatcattattacagtttttatcaaactcctaagcataatataaactgtaaggtttctgtgtgttaagaaataaccaggttattttagttagtttgaccagcttggttgggatgtggagtggagtcagttagaaggagtaaggtccgttggagagatggaagaaaaagaggttgattcctgaacaccatttctgacttttaattcccagcttgtggagcctcatcctgctcccccagctccccagtgacccagagctgtacaaagtcccaaggctgtcccacttactatggaccaagcaatgaaataggtactagaaacacagtggtaagaaaaatgaataccatctctgcactcagcaagctaagaatatagtacaatagttgttgtttcctgggttgggtatttgtgtccttgctgttctttagaaatcacctaaagacacaccagcatgacatcttttccttccccattctgagttaacacaaaggatcaagtggttgaatcctcaggaagacagagatctgcccagaattatgcttcactgataatttcaaggctacaaggaatcaacaagcattgatagaacaagaagaagacaggaacatcctctactattccccaggtccttccattctgcagtgaacgtgctctctctaaccccaagtagtagatgatcatgggtgttttttttgtttgtttgtttggattcttgttgttgttgttgttgtttgtttttgtttttgttttcttttgagacagagtctcactctgtctcccaggctggagtgcagtggtgtaattccagctcactgcaacctccccctctcgggttcaagcgagtctcctgcctcagccccccattagctaggattacataggcatgtgctctgctaccacacccagctaatttttgtgtttttggtagagacggggttttatcatgttgcccaggctggtcttaaactcctgacctcaggtgaattgtccgccttgacttcccaaagttctgagattatgggcatgagccactccacctggcccgtgggtgtgatttctattctgtatactactgtcaagaactgtgcaatgtttgagattttaccctgcttttatactaacaagcttttactgtttcacagttgctgacagaagacatgagattcctgggtcagaaacaaaagacattattactcatggcaaaagaagcagccaggccttcgtttgtttgtgttaattccccgtgttcccccaactctcacaacaaggacacacaaacagcccattatggatgcctgcacctgcaattagttacattataccagggaaacactgagcttagggcatctaccacttttatagttagtggaaacaagtctattctttattgtcaaaggagatgttagctcatttctctgtggaactatagccctgaaaaatggcttgggtaaagatgatcagagccttgaattcttagcatacacagcaagaatatgtagggataatcagggcctgtggcaaattctttcccaatatatactttattttagaatgcactaatgtgttatcatttgagagtctcagtaatttgagaattccctttctcttttgtatctttaaatcatctctctgttggtccttttcaatgagtaaacttctgcaagtgtcattcaccttaaaaaacttcccctcttccactaccacactttactgtacaactacaacctcctctccttaacagtcaaacttattactaggcgtgtcttaattccctgtctttcttcctttatctccctcttctttgtcaacccagcccactaaatctggtaccaattgaaccactccactaacacagctatatatactaaataaattatcagtgtagtaaaatagagtatactatattatatactagtatatattataattatatgtagtaatatactatatagtatatacttattataccatatataactgtatatagtctgtatatatatttatataaaactgtgttaatgtagtgactcaactggtaccagattttagtaaataaataagtaaatatatatatgtgtgtgtgtgtagatatatgtttttatgctaagtactaaagtatactaaatttatatgtatatagtaaatatatatttagtgtgtgtgtatatatatgtatttattatatagtagtagagggagacagagagatcactgtggtgtggcatatagaagatattggagggtcccatggtggacatggagacagctgtaattaggttactgcaaccatcaatatagtttaaattagtgtggtgacagtggagattaaaaatgaaaagatttgacacgtgttagaaggtaactttgatacagtgaaatttggtattaggttggttagtatgaaggaggggaaagtgtcaaggatgacttctaagtttcaggcttgtgtttgtagatagatggtagttgaaaaatcagctcacatttttcccctgatcttagtccacatattcaactgcctaataatatccccaacttttcatctcttttgataattcaaaagaaaatggatttggtgatcaggcaagccagagataaaaccagaaactttaaactgataatatttcatcatctagtcagagccacatttacacaggtggagagaaaggacccagtatgtatttaaactgtcgttttatatagttcctgagcaggtaagtgtcctcctttcctcacttactggaggatgcttaactagcgtttttctttttcttctttttttttttttttggccgtgagagataataacaagtagataacaaaatttgtcttttgacttatgtacttgcccatcaaaatatttatttctaaaactgatctattcatctaatatgcagtgtttcttctcttgtgctattttggtgaatgccacaaccatctatccaattattcaaggcaattgaccttgactctttcttctccatcacattcacttaataaccaagtcatactgatttattcttcttaagttcttttatatctgcccacatctctctatttcttctgctactagcttaggtcctcatcatctttcatctggattttggcaatagttatttgttggcttctctgccttcagtctgccacccctcttatctattcttcactctgttagtgcccactgcatataaagtaaagtcataactccttaatgtagtataaaagactttccatgatcaggcccctgccacatctctagcaaaatctttttccactttaactctccctctagagagatcaaactaattgcatattctatgaacgtgcatactctcctcctatccttagcaaaagataagtcctttaagctttgttccttctcagtactgtcattctcttcaaaagtcctattcgcctcttttctaaactaagtggtttttgttattgcttggtgaatgcctgtgctagaaaattggtaacttttttttttatttgcagcaatagcagaaattagggaaataaaatccacagagttaccagcatgcatttatttcctattcaattagatctgactttcaagataccagagattgtagctgccaagaaaagaacaaaaggaaacacacaggataaaggatgagattttaaaaaaaaagtaaggagagatcattcaccatgaagaaaccattcaagaagccagctttaccatccctgccactgtcaggtttatcatgactttgtacaggcaattttataaacactaaacatttgtagtcaagatgaaccaagatgaaccatcaaattcattataattttgacagaatataatatctccaataaattctgtagggaacaactggaaagtatgacttttatgtactttatgaaatacagattaagtcattttacaggctagaggacaacaaatctttttaaaaagtagatgttacatttgagctgcacttggtgattttctcccactgtaagctgctccagtttaccacatgcatcagtaaagataattttgtttgcaagcaacagagtcattgaactaaaaaataattaaagggagttattggatgacctaacagaagttcagagatagggaggacttcaggcagagtttaatcagggctccaactccagttctctgtaagttcttcagttttgtcctgtattgattgactttatctttagtgtagcttcactcatggaagcaaagtggttatgcaaaatggctcacattcatacattatagtttccacagcaagagagcatctatgtcccaggatccccagcctatatgttgagcttcctactgactggatcttatctgaagtaatgcattcctcatgagaaagcctcatgcattcctcatgaagggactacctgatcaaattactgtggtaaatagagatgagattatgccaaataaagcccattctggatttggaagaggggcagtgtttatcaatcccacataaactacataatatctctaaagtgaaagaggtaaaatttccctaaagaaaacctgggaacccccaggtttatttagtatgaaagaaggaaaatggatgaatcccaaacaggcaaccagtcaatactcactacagacacaattcatagttgttcatcagaagatttagaaattattttgtaatccagatgtttcaagctacttgtgagtagtcaaaaataaatatcaagagtctgctgcgagggtgaaaagagggtaaacagaggcaaggagcccaattctgagaaattccatcagtgagtatagatgcattagaagattgaatggtgtggatgactctcaaactactcattcattcattcattcatccctatgacatgtatagggtgtaaatctatgccagaaaatatttaagtcaatgggatctttaaccccttaagaaattcattctatcaggcactgcagaattttaaggaagaaataagcaattttgatatatagagtgattgccactatagtagaacacaggaaaataaggccacatggaaaacctagcagagtcttcatgaaactcttcaatatttcttccaaacctaatacttctacagtgcaatctccaacataaagcaccctaggagcactttattttcaatcaacaagtatctgagagtagtatattaaaaggcaaaggaagaataatttatcttactctggttctcagttaaatggtcacacaatctaaaaaaaaaaatgaaacgattttgattgtttggaaacaatctcagggagctcttaagtacaaaatacatttgctaataatatgcattcttttaagatattatattgtatgtccatctgaggaaatagttttgagggatacataaagcaaaaatatttagagaaaggacataaaaggaaaaatagcagacatagtttattctttttgacagtcttttatagcatagaatcatgaaatcttgggtccatatcacagtggtaatgctgagaaaattctaaccactttatccttattcccagcagtgtcctggaactccaattctaagagtaaggctttccataagcatctagcatgaagatataactcagagagtttttgaaaaattatttcttcacatgaagtatacttgataataacattttaatgtaatattgaaatttctgattcttaactctgttgggcagaatcttgatagccaagaaaatcacttgtgacagttccagaataagggtctaatatcatagcaatttaacccagtttcatcctatatcagaagtattcgatcagaaaagaagtaacatttccttcaggttaacagaagtagatcatttctcgtaacagatcgtgttaaaattgtcttgaaattgcatagttttgcttactctaatacgtatatatatttaaatattttggtctgagtacagatttaggaatttggactgaattggtctaatttaattaaactgagaaatctagctaaattatgacatttgtgattcatgtgacattgaggttaaacagactactttctacactcttgctagttggaatttatggtccacagtccagtacatcagaattaccttggatctagttagaaatgcagaatctcagacctcagttgcagatctactaaatcagcatctgcattttaacaaaatccctaggtaattaaaacacttactgcaccaggcaatcttaactctgactacacattagaatcacttagggtgctttaaaaatgttttgatacacaggccttagccatgcccaattaaatcagaccctgtaagggtgggaccctggcactggtattttttgatgctcaccaagtggttctaatgtgctgccaagtttgaggacttttgattacacaatgcccaatcagtaaattcagtgtattctgaaagggcaaaaagaaaaaagaagtcaaaccaattacttagtatttggtcccactctataaatgattgattttttttaacttttaataagtttgctttgctatggtgtgaacacagcctattatgtctcaacctgcccagaaatgtattgtattttaaatcaagaagagaaatgctttaccatccaaattaaataaaaggagacttacgtttgtttttcaattttacttccctttggtgaccttattctccagcttgacagagctaaatgctaaatttcagataaaccactgtacttttggattgtccaccctgctctccatgcactcaattttcatttttcccctaagcctaatggacttcttgcctctggatttctatattgttcactgctcctgccatgcactctcacttcatggtcttatattgttagctctactagttagtggaataaaaatattatttaatttctacatataatctcaagcattaccatatgccaaaatcttacatatgaataggaaaaaaatcacagcacagtacatgtggccatcactatcatctcattttatagatggggaaactgagtctcagagagacaaggtaactggctaataagttcgaacactgtttttcccaagactatttgactcaaaatacagaggaagtttggtgtgtgtgtgtgtgtgtgtgtgtgtgtgtgtgtgtgtgcatgcttatttcaactatagtatagtactttaattaaaattctaggacagattaagaatataaacatgttaggctgcgtgcaatggttcacgcagtaatcccagcactttgggaggccaagctgggtggatcacctgaggccaggagtttgagaccagcctggccagcatggtgaaaccccgtctctactaaaaatacaaaaattagccaggtgtggtggcatgcacctgtaatcccacctactcagtaggctgagacagaagaatcacttgaactcggtgggtggaggttgcaatgagccaagatcacaccactgcactccagcctgggtgacacagcgagactgtgtctcaaaaaaaaaaaaaaaagaaaaagaatatgaacacattaaaacatattaaaaagaacattcattctcaaaatctatgcccactcttacctttggaatggactcagtgatttttcttattttcactaactttgtttcttttgtcagaaaactattgaagttcggtgggtgggtcaagggaggtggtcatactatattggtttctttaaaatttgttttcattgcataaataacaactggataactttttcctgtaaaaaattagaacatcatagatatgactaaaatctttgtgtccagcacagccccatgcacaccctgcactaaacccgtttgaacaccttttctcccccatcagaagtagcatcctttaagacatttcccaatgtatttaaatatatatggcacattgcaataactcttgaggatggcaaaaatcatttgtgatctaaagcttagtatgcttgaaaattaagagttttacttatgtctaaaattttaaaacctgggaaggatatctaattcgggggttgacaaaattaagattcaaaattatatcttaactccacagaataataccataaagtcagaaagataaaaatttagccatcataaatattgagccctgcgtaaaaatacaagtaacacatagagaattctggtttaacattagttcatatgaaaaagacctagaggttggttatcacagactcaaaacataataaaaatcctagcactttgtaaagtcagtaattcttatctttaaaataagattcctttgaaaatatcaggaattataccagaatatctactttttgaaggaaaatactaaattgtataaaattgtaaaatagagtgaactagtagtttttaaatatgggacttatttgatgacttaatatcctctttttatatattttgtctcttaattcaatgccaattaagagaaaactcttttgcttccctcaggtcatatcctctagtctttattacagtacaaagcactcattacagatcataggattttagcctgaaaaggtgctatgatgagtcattgcaatagtaatacttctccattttgatgtcttcttgaataaggatcttgccgtgtggaattaatgctgctcgttgtaatgctgattgtctagtaggctgactatattttagtgaagaatattcattcccaatattcttgctggaatatctgagattgggagcagggaatactatccattagcaggcattctatccgttagacacatgcgttcctatgctaagtctccaccttcctgaaagatgattatttctttgaaacttgtcaaaagccataggtttttatttaaaaataaatccccaaacaagaacattcagaatttctctatccaccagccacctgaaaatacctccctaggtttatggatattttctttttgtgattttagacacacaagtactgattacacagggtacaaggaagtgtagcttctgagagagaaattgatttttcttttctaacagaagatgaagatcatattcatttatcatgaccttggctgatcataagacataggtgatcatgaatcttgaccacttgctattttttataaaattaaagtaaccactcatataaacatggtatttcagaaaatggcatcttgagtgagaaggaagaagttgaatcaatgacacaaatgtatatttttaagaacaccaaaccatggtttcattttaatttatctatctctgccctgatgttcctcatagcacatgagagggagattcaaggtcttgactctattactggctttattcagcagtgccagaccaataataggtgtttatctaccagcgtgtgctgctcctgatagagtagcttattgtaattctcccctccagttttccttccccaaggaaatacctacatctcagatctgtctaattaaccaatatttgaagaatagaaaattacgagcaatccctatgctcatcattgatgggctttaaaaagctcgataaagtttctaggtacattttcttgtttacacgatgaagcaaaatggatcaaacaagcaaagatttgtggcaacagagatggtgcctttgtataatataacacatactgtgtatcaaagaaatattgtgccacttcttcgaagctgacattggaacgacattgtaatcctgaccatctgtcttcctcctctagatgtcgatgaacgtgcagtggtgaatggaggctgccagcagcgctgtattaacactctgggcaccttccactgtgaatgtgatacgggatagagactgcatgctgatgaacgcacctgcataagtgagtaaatattagaaccagcttgaagctgttttcaatgaaaatcgacctgcccatgtagaggcaggaaggaaaggttgttctattgtgaaaatatctatagaagctgacagttttgagtacaattctatcccttaggatttttttaaaaaatatattttgctattaaaagactaccagacaaaaagtggggaaggagatatagaaattaacattcagaagcaaaccttgaatccccaaatatgtaaatatttctgtagcatgtaatttctgccatatacagtagagtacacatttgttagttgttgcttatatacaagcacagcacagaactacaataaagtgaagatactgggccattataattactagcaacaatgtcactcattttagactagaaagaactggactcagaaccccctgactggaaagaactggactcagaacccccgattagaattcaagccccagcaaaattatagcagattatatgccaaatatattaggactgttcaagctcagttaaaactacacatgtgaaatctgaaattctgtatgttcattgtgcatcaaaatttcttaatactatttgtgggtagtaggattattattttttgtgtttgtatttttctgaattttctaaatttcttaaaatgagcatatgggactttcataaacagaaaaaaaactttaaaaatgctatgtttcctgtatgacttgtaaatgctccttgttgttttaactgaagtaatttacataaatattcttttttcattaagtgatgattctcagatcacataaaattgcattctaacttcctctccaggtcccttttgaaaatatttatattaaaaaaggagcacattgtacagcacaatttaattactggctttttgtttatagagtttgttaactagttcatccatacaaaattgtcagtatcttacaatgtaggcgataattatgaaacttggaatcgaaatcagccaatttcaactagctttataacatatacccctccttcttcttcttagcctatcttttaagaaattaaaaaaaaaaaggcaatgcaaacaggtaaagaagtcctatttgtaggtctgattttgatatgagaaaacaggttctgagagaaaaagaaaaaaaattcttgaagtcaagtgaagatacaaactaaagtcatatcctaggcttcaaggagctcaatatcataatgattgtatcgacagcaagcacaggttgggggacattaatacacgcatgtttaaatcaaaacaaccctttctttttgtgggattactggttttagctggaagaatccctttccatcctcatttccaatctgtaaagtctccagctagtaacatctttaaactgccaccataatgtctctcaatcacaaaatacataagagcagcaggattattgatacatgcagatgggatatttatcagtaaaagttgacctggtaaatttttgtttctgatttaaaaattttttgccaaatagtgatttatatgaatctacaatatctggtctttgtgataaggcaaaataaacactctagtcaccaactaaattgtatttataggtataattaatttggcagttcctagttatttcttagtaaaatcattaagctcttcccttattcctttccatcactgtccttgaattttcaaaaatttttaaggacatcaggtcaaaagtggagtttgacaaggatattgtaggttatcttttctctttctattcctttaaagctaattattattgtacatatacatgggcactatgataatagcttacttgcagctccatatgctgatctccttatgcagaatcttaacatagggaaaaattaaatttatatatgcatactgataacacatataaatctcccattttatatatatatatatatatatatatatatatatatctcgagtgaattaagctattaagaaatgtagagttaatgattgccgtcatttaaagtgtttaaccccttgataccattctacagaagttactgaactaaaagcccagcacttgacccttgcaaaaattttgatgccttttccacttaatacactgaagttttggtttcaaagggtggtcttaagaatttcagctgatacagcttacatttacagcagtctttttaaaaggagcccaagaataacttaagcactttgtattgaaacataaataatgtgtaagattaagaacaataactatttgcttatttgttctgaaagaaagggtttattgcagagaattgactttcaggctggtctgtattccaggctatcttgtaaacagggtaagttttttttttacattaatttatttatctatttttgaaatttcagcttttattttagattcatggggtatgtgcaggtttgttacatgggaatactgtgtgatgctgaggtttggggtgcaattgatcccatcacttaggcagtgaccatagtactcaacaggtagtttttcaactcttcccctcaacaattagttccccatgtctattgttcccatctttatgtccaagtgcatccaatgtttagctcccacttataagtgaaaagtatgtggtatttagttctctgtttctgtattaattcacttaggataatggcctccaactacatccatgttactgcaaaggatatggttttgttcttgtacatggctgcatagtactccatggtgtatatgtaccacattttctttatgcagtccaccactgatgggcatctgggttgatttcacgtctttgctattgtgagtactgctgcaatgaacattcgagtgaacatatctttttggttggagaatttagtttcctttgggtgtatacccagtaatgggattactaggtcgaatgatagtcctacttttagttctttgagatatctccaaactgctctccactaatagtgatttaaaaaaaaaaaaaaaaaaaaccattgaattatctcacatttccgttgagattttttacctggtagaaagctgaatatggtggttggtgtttaatgggagattgtagtagatggaagtttattatgattcacggtagagtcacagagaagaagataaagttatgaaatgttgtgatttcatacattagactacttgaaattaagtgcctccatttcttccttcctcctttccttcttttctttccttttccccattctgcttattagtcataggataagactagtgtgactttttgagttagagcctctggtgctttttgtactttatcttcatcaaagctacaataaagtaaactccccacacacagacacttacagagtttcagatgacttcatttcaaaagggtctcctttctcagggctgtgctcttgtagtggtgtgtgtgcagtgcagaacagtcagcctccgtcagaacaatcaagcagcatagagtggtgtaagggaaggagtccatggcagctggctaaggtggcaggaagtatgagtgcatggggcatgtggctcaccatacaagttgcttggactgctgatacaatgggattgcaataaatctggggatctttgtttagtggaccacagtttgaacccatggacttgtcagcaaatttttggaatgtgtcattgctttggaggccagggcctttgctcagattctttaagatgtctatggcacccccaaaataccccacatatatttttgtcattatgatgtcacttcttaaaaagtatgtaggagaaggatctcatgacattgttatatcatgttattgtctcatgatactgtcatatagtctgatgcaaagttgtgcagtgaatgcttctctcaacagctttctttataatgggatttgaggctaggaacctcagtccctgtccttgagaagcatgactcctgacccactgtcatttctcctgaaagaacatcaggaaaaccagcctgaaagcatgccccacgtatgaggagcatcacagcaagtgaaagtagctgcattttgttgatggaagggtgcagacacagcatggggaagcaaacaaaagtggaattcttgccacatttgctttgctattggtgttctcccttaacatgcatattatggaataatttttatatttttaaattttcttttatgtggagaccaacagtttaaaagatggaaaatagattttagcaatcatcagaaagacagagaaatttatattcagattagtgaacactgaatctcatctatgtggtctcgggactgtggcacaataaaattcaagttggcatgtgagcttaagcaagtcatttaatctctctacaccctggctgcctcctgtgcaaaacagaaattggacaattgggcttaaaattacttcatcactaaggtattataattttacagtttctaaaattactagttcattataaataatctgctaacttgtattttaaaaattctactgaatcaggcataactattttatagagctctaattttatttaaaaagtgttgaaataactcagctctatagagtacaagcataaaagcagtgtgagaattttgtgatctagtttaataaaaatgaatgagtaacttgcatttcttcttgaaaaaaaaaaaaaacttcggtgcttttgtgacaatactgttttccatatcacagaataatatctggaggggacccaaggattatgatagtccaatttcctatcttagagatagaaagtctgagagagaaagagatcaagtaagtaaattactgtgagaaagaaaaatttagtcttcaggaaatcctggctaatctcactcctgatcctatgacctcaaataacttctgttcaattttgttttgttttattttgagagagtctctgtctgtcacccaagttggagtgcaatgatgtgatctttgctcactgcagcctccgcttcctgggctcaagtgattctcctgcctcagcctcccaagcactttttctacaggtgcgcaccaccacgcctggctaattttttgtatttttagtagagatgaggtttcaccaagttggccaggctggtctggaactcctggcctcatgtgatctgcctgtctcgtctgttcaatatgttttaaaagactaagataaatcatgaaagcactgctaaaagaaattcttacattacattttagtaaacacagctaagggttaaaacaatgtatttttaaggtagctactgaagaaataaatctactttatatcatctcttgtcagttcaatcttatcacttctctcctacatttctgtgatatgctccaacaaaacctggctactctcagttctctaagtaagccatgcccttttctgcttctgcactttgctttactcttagcctaaaaattagctcacccccaagtctttgcctatcaaaactacacttactatgttccatgtcaaatgacctgtaatgctttctctggttacaacagccaaaggcattctctcttatctgaaatatcaagcaattttatttgtgttggtttaataatacatcataatatatagacttatgaatgtataattgggtttcagactaaatgaaagacactgatgaccttttaattgtcaacttcaagtggaatcttttccgttctcttcttgatagctgttaaccactaatttttctaaatcttccttttgagttcatgacagtgcaattttcactttcaattgctgcttctctgttactttcactctgggtaccagggttctgacttggagttatcatctgtgtctctcctctgttctcctttattcacccttcctctagtctatcttcattttgctcttctatttttatacatagtacttgcaaaatagttagaatattcccttgcacattgtattacttaaatataacctattagaatataaaaaatataaggacttcacccagatggatttgcttgttagggaaaacaaagttgttccagtatttctagcttttggaacgttgctgatattctcttttataaagtacattgtctttcgatagctgttaaatggtggtttttttccatggttgagaggcaggggctagtagatatagctaaatatgagaagtaatggtaatgtagactaaactgcttttattattagaggatgttttttaagagccaggggctacatgccaaaataatttatattacccgtattttcagtatttaactgtgtaatttacattttaagtaacttgtaaggctataatttgatatacctcacaaaatctttcttgaatttttatttttaataacaaccttatgaaacatgctcagctcagatctccattcataatcatgttcttcccttgatgtatttgctgaaattggccttcccagagggaagaaataattaaatgattcaaagttttaatgcttgcatagttctcttactgctttcatgctttcagtacataggtttattaacatctgcattcataaataaacaaatggaatctgatgtctgcatagagaaaccttagataaagaacattttaattacttcagtctctgatgcaagaattctttatttccagttgcagggaatgatcaggatctgtttttgttcaatggtctctttttagaagtccaatgtgatattcattgcacaatggaacccagtgacccctttttagtctcactaaatgaaaaaaaaaaaaagaagaaagatgacctagaaaatataatctaaagattttagatattttgtttgtggtcaagtgtgtgacatggtgcagtcaatggtgatactttaatgataattaagcagaagttgtgtggcaaggagagggtaggtgtaccagcaagagcttgattaaaataaagatgtccttactaaaactttgagcttgaataaattttcttatatcagatttttatgagtttgacatgttaaaataatgctaattttaaaaaaagattgagaaaactattagatgtggtggtcttcacaatgagttcttttgtttttgatctcagtgttctgatcactgatgtctaagttttatttgataagaggaaggattctttccagggaatgcaaagagattgccctcaaataggatatgaaagaggttaaagactttcattgtaactacctttcaattagttgcattatttatgaagacaaattagaaacagaattcatttcagatgacagctgatgtcttgaacagggccatgtcaggttaaaaaaattgtttagtttgtcagattgatggcatctctccatcattatcagattcatcaccctctcaagattaagcacttttgtgtggcagatgataaacttaattcccaaaagttaaatttaaggaacactttttctctgcccgtctcattctcaatctgtggccttagggaaaaatcatgaacttaagtttttcatccagagcatcgactgttaacccagtttagtaactttttacaactatttgagtttcaggaacacattaagaaatcttcccttttttttctgtagtttttgtacagtttgcagactcaggaaggtaagactgacaattttagataaagacagattgaggtttgaatctgactgtatcacgtaagagttgtgtgatcttagcccagttacggggtgtccctgattttcagagtccatatcatctctatgtctatgtgaatacctatatctactaaaatcaggataataattcacaaaaatcatgttgtacatcgtgaaagagcacataccttataaagaagaatgtatgtaacatactataatgatcatccatgggaaattgggaagattgagagtgggctctggggttaaaagtgaacaaataagagaggctcttaaaaggacaagggagtgataaggaatgtccttgtggtgtgatgaactccaccttctgtactggagattacaacaaaacaaaataatgaaatgtttgcgtagtggtcttcacatttggtaattggctttttgtacttctttctctttatgtggcaagtatctttacatgtcttccttcagaataatttttaagttatttttctagttccttttataaaatatatgacattaaatgataaaaccctaatattaagcaatatttaattttgttttcttgtgttccctaagtaatctcatagtgcattatagaatacccaccatatagcataaacttacatgtgaagagattaaagtcgtaactgacacacagtgaatgctcaataaatggtggcttagattaatgatttatgtatctactcctacattattttctcacaacctgaacacccgttcaatacagagatactgagaatgggagattcttcattgtgtgccactggaaatccaagactttagctttaaattattcattcatgaaaatataccatggaatttaggatcgagagaaaaatgatactaatctgaaaacagtatatcttgggaaaaaagttcctcccctttcagagtaacaatgttagctttaccacatagtttttgtttatttctttttagtttttttattttttaatttcgtgggtacgtagtaggtgtatatatttatggggtacatgagatgttttgatacaggcaagcaatgtgaaataagcacatcatggaaaatgaggcacccatcctctcaagcatttatcctttgagtgacaaacaatccaattatgctctttaagttatttaaacatgtacaattaggttattattgattagagccacccttttgtgctatcaaatagtaggtcttattcattctttctgtaccacccatcgccatctccccccatcagccttgaactacccttcccagcctctggtaaccatcctgctactctttatgtctgtgagttcaattgttttgatttgtagatcccacaaataagtgagaacatgcaacatttgtctttttgtgccttgtttatttcacgtaacacagtggtctccagttccatccatattgttgcaaatgactggatctcattcttttttatggctgaagagcacttcattgtgtatatggaatcacgttttatttatctattcatctgttgatggacacttaggttgcttccaaatcgtatatattgtaaacagggctgcaacaaatataggagtgcagatagctctttgatatactgatttcctttactttgggtctataccagcaagacggattgctggatcatatggaagttcaatttttaggtgttttttgttttttttttttttttaggaacctccaaactgttctccatagtttacaccatcagtgtacaagggttcccttttctccacatcctcgccagcatttgttactgcctgtcttttgaataaaagccattttaactagggttagatgatatctcattgtagttttgatttgcattcctctgatgatcaactttaccatgtagtttttatattacaaggtgttagacgttgagctaatgacataactgcttaataactcagcttctccatatgtaaggggacagttgaggaaaagtaacaatgcaagtgaaatctttagttcagtgcctgacacagagcaagcaagtaaaaaatattaggtaatattattagtatagttccataccttggaacttggctatagccatagaactaagtaaaattatgaagggtcagaaaccataagtataaattggctttggtgatcacattacttctattaggcatttttgttagtagttgctatggtgtgaatgtttgtgaccctagtattcatatgttgaaatcctaacccccaggtttatagtattttgagatgggaacttttaggagttgattaagtcaccagggtagaatcctcatgagtggctttagtgccttcataaaaaagaggcccgagggagcttgtttaccccttccaccatatggggatacagcaagaaggtacaatctacaaaaaagatgtacccttagcagacactgaatcagccagtaccttgatcttggacttctcagcctctagaactgtgaaaaaatatttataagctgcccagtctatagtattttgttatagcagccaaacagacaaagatagtagattttaaaagcatacattcactgactgtttcaacaatccccccttttctttatatttttgatattttttgagttttagagcaatattcacaactatgttttgactatataataacatactcccattctcatttatccctaggttgaagatttatatctccctttttccaaaagcactgaaggcagcaagctacaggaagcttatgcatttttacaggatacaaagtgcagaaagacattaaacataaaacagtattgcctacatctaaaagaggcagaaggaataagtgcttgcaaatagcagatatgagcagaaaacttaaatccaaatttagtatcccaatatagcttctagctactgacaagaaaagaatagcatgatttcagagtttgcatttttctgacacaagtcacagagacatcttttttggggggtggggggagaattcagtgatttcataatctgttactgaatacacatattttattttgcagagaaaatagaaatttttagctaaggtacctcccaacttttactcccacccagaactttaaaattaactctaagctctgcctactttgctcttcactctgaggaaaaagtgctctgctgtaatttcaggctaatcttcccatctctggataggatctcagctgccctcctccttagaacatggctccattacatgcttctttttcctctatcaccatcttctttatctctatcttaaaataaaacttctctctaaaactagttttgccaaggttattgataaattatacactgttaaattcaaggagtacttttcataccttattttgcttaatatcttgaaagtaatgatcttgccttctatcatagtctgttttctgctgctataacaacacaccagagatggtgtaatttaaaaagaacagaagtttatttggctgtcagttctggaggctggaaagtccaagagcatggcaccagcatctggcaatggtcatcccatggcagaaggcagaagtgggcatgtgaggcagagagtgaatgggggccaaagttatccttttatccaaagcccactcctgtaataatggcattattccattcatgaaggcagagatcttataacctaatcacctcttgaaggtcccatctcccaatacgattacattggcaattaaatttcaacatgaaatttggcagagacattcaaaccatagcaccttccttcttgacattctctctttcttggattatagaacacaactttcttttggtcccctcccatctctgtgatggcgtatcttctttcatggagtcttttccctccactcatcctcaaaatcttaatgattttcagtgttctaaatttggctctttcttttctccctcctgtgtaatctcttccacttgcaaagctttacctgttacaagtagctagcagggaatgatgtccaaatcaaattactaaaccaaatccttcttgtctgttgacccacagactcagctactgcctgggcttcttcttgaggaggtccccttagcaaggaaaacttagtgagtctaaaattcaacacgtcttcattcccacatgctcccaacttttctcttctcttttgttcttttttcttagtgagtggcagcaccccaggccagttattctccaggccagtgtagtacaccaggagtcactatggtttgaatgtctctgccaaaattcatgttgaaatttaattgccaatgtaatagtattgggagatgggaccttcaagaggtaattaggtcataaggtctctgcctccatgaatagattaatgtcatggcatctccttactctgactttacaaatctaatctccagtaaaaccaataggctcttcttccgtcacactccccaagagctatctccactatgactgcttacattaaggccctcataatctcttacagaaatgtttttgcaattgcctcttaaccagggttatcgtccatacttactccccttaactcattatctaaactacttccagagccaaagatgtaatttaaaaattattttactatgcttaaaacctcttattgtttttagaattgcttttagaatttaccccaaacccttactatggcttacaaaatgattcagagtctgacttctggctacttctgtcgcacgtaacaagtttctgctccatactttatactacaggctcagacacccagaaaatttgcagctccctaagtgtactcaggggatccacattccttacacttttcctcttagtgttctatctgccaaacacacctgcttctgcatctgttcatccagtagttttgataaacatcaacactcccttctcttaagttctccctttctctacttctttgtccctaacttctacttgtgtttcaaagcttactgtggactcacctctcctgagaagacttcccagatctattaacatactcaaaaccaaatttgccacctgttttaaaaaatttaaatattattttgatggcagagcacaacaaaaagacactcaggcagacgaaaagcagggcttgttgccacttacagctccaaatgagatagagctgccatgcagggctatacattgagttatacctgggactagggtaacagcaagctagaactggaggaggcagcttatgtatggtaacaaggtaggggcaggctaagtatcaccatctatctgaggattgggaataattccacaagcccaaggatagtgatattattcatgggtgttaggtatccaggaaactctggcagttgggtatgtgtgtgttgcatcccaggaatgttggattctcaccaaggtaagtagttggggttgggtctagcaaactgcctgtgaaggggaattgaggtttttagccatgattcaaaactggatcaggacagcacttgggaaatattataatacatcaccacatggagctaggatgtatctctaacatagaacttttcccagtgggttataaagctttatctttttgtgtgtctcttgcactagactttaatctctcctatattctcaatacctagaatgtgactgaaataaagcatttaactttattaaatgactatttttcagtgttcaaaatataaaggtctttgcaattagttatgctttgtttataagtaggagcttattgtctctcttgtgaacttctcttaatttgataagaggaattatataatacatggctttggctcctaggaaccctacactaagttgaaggcttaacttcagggattctacttagtctatattcctaatttaactatcatctcgaccctatttcacaacatggttcttgttttcttcaatgaatatttttgtacttttccccctccttttaaaccttagcattagttattctattgtagatatgttttagactgcacactgccttaaatcatctttggaaataaatggaatataaatgtagtaaaaataaattcaagcttagatttatcacctggttccttgcaaaaaccaacaagtgacatcattaacaatagtttaaacttcagggccgggtgcggtggctcacacctgtaatctcagcaccttgggaggctgaggcaggtagatcatgaggtcaggagttcaagaccagcctggccaacatgatgaaaccccgtctctactaaaaatacaaaaattagccgggcatggtggtgcacacctgtagtcccagctacttgggaggctgaggcaggagaattgcttgagcccaggaggcagaggctgccatgagccaaaatcatgccactgcactccagcctgggcaacagagcaagattctgtctaaaaaatataaaataaaaaataaaaaccttgagatttaccaaagatataaacctgctattcagttgggtggtttgcatattggtcttttgaaattctgagtctttctgtcgttgccagggcacaagagagagagagcatgacaggaggacgaaccctggacaccacaccacaggaataggaagaatgcctagggcttctcagagcctagagcctgttgctgagaggccacttcataaagaggctacttcataaagcctagatcctggtgccgagaggccactgttattaatgacagtcaagggaaaagctgtggtttgagtcctggatatcatttcctatcagagaataagagcaaggagagggacacactacatacataaaaggactgaggccaccattcagaagttcaggctgaacaccaaatcataaaccagtatacataaattcagaaaattagtttgaaaggtgatatggttaggtgttgtgtcctcacccaaatctcaccttgaattataatctccataatccccacctgtcaaaggagagaccaagtggacgtaatcgaatcatggtggtggcttcccacatggtgttctcatgatagtgagtgagttctcacaagatctgatggttttgccaagtgttcgatagttacttctgcatccattctctttcctgctgccttgtgaagaaggtgccttgcttctccttcaccttctaccatgattgtaaatttcttgaggcttccccagccatgctaaactgtgagtccattaaacctctttcctttataaattgcccagtctcgggtagttctttctagcagtgtgaaatcagactaatacaaaaggcatggaagaagtggtgtcaacaagtataaaaccaagttaggattaaaagttgagccaaagacaagcaggaagcagattttcatctctgacattgaaagcttttcagggaacatctcttcagtagtcgtaaataaaaaaaatataaccattgacctgactgtcaggactgtatatctccttcccctgcaggcttctagtgtgagtgggcaaagactgctaggatatggaacattccctggggagggcaggtctcctcaagactcagtctttgggttgacatcttaataagaagctgaacaagcatggtctaagtactctgccttgagacttaactttaattaacccagagattcacattctagcattgagataacagtagtttgcagataattttggctatgtccattagcaataataaattaccgtgactttaaaaaaatattatctcaaatcctcacaacaaataaagggagaaatactatgatcctcattttaaagatattgaaatggggttacacagaggttaatattatagctgtggaatcacagacttgggtttatagccccacagattactgctcttaagccaataaacatcatagggaagtgtattcaagtgtgttttatactttttgaagggaaaaaagaagatggatagatggttgggtacatctgccatgcaatctttgctaaaattctttcttccaggctatatgatatggtaatttaagtcttattttatcccaagtttgggagtttacaaagattctctctgtttcctcttggaaaataaaaagttggctcattctgtagactcccccactggttttgtctggactgcagtgggttggccttctgtctgggcaggaatacaagtctgaatcttaagcttttacaatggaatgtcaaccttgtctccccagtgtctggtgtgtaaatcttatggctctcacttcaatcaacaatatagaaattctgcactacaggtctgtgttagaggatttgactgaactgaatgggagccagcattcatccaaatctcccttaagacatccgatatacagagtgcatagcggaaagatcatgagccttagcaccaagaagctctaagttagaatcccagctttgcacctgctagctgtgtgaacgtggggatgttgttaaatgataacaatggataatatttatggagtacttgttatctataggagcacagtgttaagcgcatcacatctactgtttcatttaaactttatgaaaccctatgaggtgggagatattgttgtcaccattttaccattgtgaaaaaaatgacgcttagaaagtttaaataacttggcaaaggtcacacaccttctaagtggtagatcctgaatatgtcttgagcagagatgaccaattgaatccagttgtgctaaaacaaacaaaagccataactatgcaaaagtaggttgcttggattttattgttaaagctttttaaggaagggaaagacaccaattgaaatataaagtgttgtgttaaaagtgttgcagtgtgttgcagtgttgtgtgaaaatgagtttgttatgtatagaatcagggagcctgagaaagagattattgcattaagatggaactagtgaaaaattctggcactgtgggtaatgataataatcaaggactgaatgccaagaaactgcagtgcttttcctatgcatacttagccataaacattttattttaccaaaaaaaaggttttatatagaccacataaaatttcatagttagattttttcacaaacatttaaaattagctttatcaaagtcaatacaataatttcagtatgcattcaaagggcaagttctaaaactttgctacattgtttaataataacccaatgattaataataaaaaacaggttccatgacttatttgtatttgacattgtttaaaattggatttgaaggtttttatattgtatggttttgaatttgctaaaaccttcatcatattggttctcaccaaataagattcatggattgtaaaccaatagcatgaaaggtgtcttggcctgttctgcttggtcataatcccagtgcccacattcatttattttagaagtgaatatagtatgttactcaaacttttaatcattgcaatggaatggtttgactgatttcctgcttctaacattttcatattgtatgtcaggaaaatgttcaagatttcagtgtatctcctggattcaggggacaaatgtaaatttatttttatactgagccaattaattaggcctcttttgtctatggagaatgacctgacttctacaactcacattttaaaaaattatttaagtttgaaaacagtctaatttcaatctggtcttatttccaaaaaaaaagatttaataatatttcttatttctcattataacttttatgagaccctgtggtataagaactacactatttcatctcttagtatttccataagactagtgaagtttttgctaagtgccgtatcatatacatatcagaacagtgtattaaaactaggaggaaaaacagtggattaaaactaggaagaaaaaaaaattaggcctctgcagccttactccacagtgttgaaacagccctgcctttgttacacagttgattaagcccatggtataaggaatttaaacttgtatggaatcattgaactacaaaatttaagatgtggaagaataggcttccttcattccagtgactgacatatttgctaacccttctccttgtagcaagcataaattagtaagtgcagaatctcagattcagtaggatacatcttgcattggaagcaaaaattatgagatcaagaataattgatattctatgtgacccattaaaataggtcttatttaaggcaatactgtttcaaattgtatctcttttaagtaggctaacctgaatgtaggcaccctttttttgcactttacagcaaaactaagcaattcccgcaaccatcccgatcagaggaccttgaactgagagcacatgtttaatgatgcccagactagctattgattaaacactgacagtgttcagaggaattgagaatcaaaaagtctcccccatggccagctctgccatgctcacttcttaatagatggcaaaggaggattctaaatgagatccgctgccctgcgcatcctcagaactccacaggcaatgggattaatttctgctttgcagttttttggaactactatgtctaaaatgtccatccttctccagaatttactacagatgtccctccttttttattttttgttcctcttctttgaagaaaaaaagttttcatatgaatttaaggcatagaacaatatcctttcaaatgtggaatgaattaaagctcactgttaattactctataaacaaataaaagaacaaatcctggagaataattcaggctgaaatatcattctctaaatcaaataaacaacaatataaaaaaggctaaaagaaaataaaaagaagaaaggtttcagacaggactaatattctcattggcattgctccattgagttggttactgcccagaggcacagatatttttaggatattcttttgtctggtaggagattatgacccagaactgtgaagtaaggctgtttctacacttaaaaaaatgtaatttccaatggtggaaccacccagctgttttaccttcaacaaacattgatgaaacacctagagggtgtcaggcacgttgcttggtactttcccttttaaaattatttaatccctccaacaatccatgaaatactcattataatccttttaaagatgtgaaaactgaagctcagaggaattaaataaatcctctattatcaaacaatcagtaaataggtgagagcaaagtcacattgttagaaactgtcagaacaaggattaaaatccagatatcttgattaatattatattggcataattactgtatagtaccttccttggcttaataatacacatttaatgaaaataatatacggattttttaaaatcattgtttgctcttttactattttatttctgattttctaaggattacatccttagggtgaatttttttttaattacaaaaaagggtaaataaggatagaataaagcaatcataatcccaccactcaggggcaaccattgttaatattgcacttattttgttccagtgttttgtctacatatttcttcataattgaaactatgctacctttttatatattcatatatacacagaacacatattttacattcacacatgcttctcaatatacattaaaactatttattaaactcactataatggtggtaaaaaccttttggtatgtatttatttatatagtcatgtatatcatggtatcttttttattctcttctaatcaatatagatattaatattaatttgtgtatatcatttagatattttgtttccttgggatgattttaaccaaagggattaaagtttaaaagagttaaaagaatggatcttaaaaaatgttgatacctattgtcaaaatgtttttccaaattttaagacaatttattgatccatcgtcactatataatacttcctgtcttatccttactggcctcaagtttttctttgtccctttcagtctttactaatttgataagtaaaattatgtatattcttttacttgtttcagtaagttccaattctaaaaatgtattcatcatttgtatatccttttatgagtttgctgctaaggtactttgcctaattttttcttaattgtgaatttcatattttagaaagttcacatgtaaattatatattatataatatgtgtaactttataaagcaagcataacaatcctttgtcatctttgctacaaacatgtcatggtttgctattttttaattgagctcatattatatttaagccattttttttagcataaaagcaatatagggagtgaagtcaccaagatcgtggaatagaagaaaacatgctcatgttccatgacaaaagtaagaattctgtacctatctatagtcaaaagtttctctgcaggagttttaggattcagataggagtttctaaaaccctggtaaagcccaagaccaaggagggtcattttgagagggcagaccagcacctagctggctgatctgccggcttgctcccaagttcaagcccagaaatggcctagtcccccaagggggtttgctacagccacttttggccttgagtctgccaccaaaaccatctgccaagaggtctagaaagaatcgtacatactagtgccttggtgggaaggcttgctgatacttgttttggcagtgaacctgaaagttgccctgtggctctgttccaacactccttgtctgaggtctcagctcagaggtccttgcacaaggacctagaaggggatgcccatatctcacagcctggaattctgctgaatctctctgatgggatctccaacctttattgcatagcagatcccaaggggacccagttgcagcactagccccttccagtgcagttagggaactctcccatctgtgctgaggcctgctaggagatacctgtctgggccaacaagacaggctctccagtgactgtcccacagcaggtctcaagggggcccagtcttagctctagtgcttcttgctgcagtgggggaaaaaatcccatctgtacagcaacctgctaagtgacacacacccctctgagtcaatgataccaggctcactagacacccccacagcagactccaaggaggccactctcagctccagattctcttgtttcagttcaggaattatctcatctgcactgaaacctgctgggagatgtgtgtctgtctaagccaatgagataggatctccagattgtgtcccacatcagatcctgaagcagcccaatctcagctgtggaccctcttgctgaagatgggggactgtcctctctgtacagaaacaggtggggaggcatacacatctgggccatggaggcagtctcctggactcagatcccagccatgtctacacagctccagtactctccttgggtcttccccagctccgcttagccagaaagctccatcaaaattggagccctcatgagacttgtggcaaacttgggcatagcacttcctctagcgttgggacaggtgcaatgatcacagcctctgggaacataacagtcaggccgcttagaatttctagaaggccttctgaagaaaaacagacacaaacaaatccagattgcaaagactgaaataaataccttatctttcaatgtggagatattgccacaaattaagaacatttaatatgaccttatcaactggacaaaataaggcatcagaggccaaccataaagtaatgaagatatgttaactctcagacaaagaagtccaaatagctgtttcaaggaaattcagtgaactaaaaaagaacaaacaaacaaacaaaaaaccaatttttgaaaaaaataacagagatattgaaataagtttaaaagtcaaacaaatcttggaggttcaaaatacaatgaatgaaataaaaaatacagtggagggcaccaacagcagaactgatcaaacaggagaaagaatcggtgagctcaaaacaggctatttaagaatacactataaaaggagaaaagagaatgaaaaggaatgaaaaaagcttacaagatctatgggacaaaatcagaagataaaatacttgggttattggagttaaagagggaactgagaaagataaaagggtagaaagtttatttgaagaaataataacagaaaaatttccaaacctggagaaagatataaatatccaggtacaggaaagtcaaaagtcaccagtcagattcaacctaaataaacatatgccaagagatatcctaatcagactctaaaaaatcaaagacaaagagaagattctgaaagcatcaagagaaaagaagcaaataatatagaagggtgatccagcatgcctggtagcagacttttcagcagaaatcttacaggccaggaaggagttagataaaatatacagagtgctgaaggaaaaaaataaaaaataaataaactgtgaatactgtattgagcaaagctatcttttataaatatagaagatataaatgctttcccagacgaacaaaaactaagggaatttatcactaccagaacattcttacaagaagtgctaaagggagttctttaaactgaaagaaaaggatgctaacatgattgttacactaatattgtaattatggtatgtaaaccacttacatccttcataagaagactaaaagacaaaactcttaagataatagtaactacaacaatttttaaagaaatgggcaatacaaaaatgtaaatggtgacgccaaaaatttaaaatatgagaagacaaagaagttaaaccgtacagggtttgtttgtatcttttttgcaatcaataagttaagttggtatcagttttaaataacttcttataactacagaatgttttttctaattctcataatagcgtttttttctaattctcataataattacaaagcaaaaacctgtaatacatacactaaaaaaaaaaattaaaacatattaccagagaaaatcacttagccacaatggaaagtagtaagaaagaaaggagttaaaaaaaacaactataaaataagaaacaaaatggtagtagtaaacctttaccaacccctaataacactgaatgtagaagaactgaatgctctaattaaaaaaatagagtgactgaattcattaaaaaacaagtctcaactatacactgtctacaagaaactcacttgacctctaaagacacacatagactgaaagtgaagggacgggaaaaagtattccatgtaaattaaaatcaaaaaagagcaagactagctacatttatatcagctaaaataaattttaactcaaaaactaaaaagaggcaaagaatgtcattatagaatgaaaaaggagtcaattcagcaggagtacatcacaatatatatacacccaacactggagcacccaaatatatacagcaataatagatctaatggggagagaaagactgcaacacaataatagtaggggacttcaacacttgactttcatcaatgtacagatcacccaggcagaataccatcaagaaacattgaagttaaattatactctaaaccaaatgaacccaaaagacatttacaaaacattttatccaactattgcagaatacattcttcttattagcacctgaatcattctccaagatagaacatatgttaggccacaaaacaagtctccacacaaaatcatatcaaacatttttatagacacatccaaaactagaaatcaataacaagaggaaatttggaaattgtaaaagtatataaaaattagcaccttcctgaatgatcaatgattcaatggagaaaataaaaagaaaatttaaaaatttcttgaaacaaatgaaaatggaaacacaatatatcagagcccatgggatccagcaaaagcagtactatgagaaaagtttatagcaataaatgcctatactgaaaaatataaagatttcacataaacaacctacctacacctcagaagcctagaaaagtaatgataaaccaaacccaaaattagtagaagaaaagaaataataaagataaaagcagatataaaaaattgagaatagaaaacaatataaaatctctatgaaactaagttcatttttatgaaaagatcaaacaaaactgacaaaattttagctatcctaattttaaaaagagaagatatcaataattaaatcagaaacaaaaaaggagatatatcaactgataccacagaaatacaaagaattattaaaaactgttatgaacaaatacatgccaacaaattagaaaacttaaatgaaaaggatacatttctggacacttataatctactaagattgaaccatgaagaaatagaaaacctgaacagaccaacagtggctaacaatatcaaaacagtagtaaaaagtctcccctcaacgaaaagcccaggaccaaatggattcactgctaaagtctaaaatcatttaaataaaactaacaccaatttgataaaggccatatatgattaattcaccactcaaactattttacaaaattgaagaggagggaagacttccaaacttactctataagaccagcattcccctgataactaaaaacagacaaggtcgcaacaacaacaacaaaattaatgggcaatatccttgataaacatagattcccaacaaaataccagcaaaccaaactcaacaacacactaaaaagatcgttactgtgatcaagtgagattcatcccagggatgcatggatggttcaacgtacaaaaatcaataaatgcaatacatcacatcaacaaaatcaaagataaaaccatattatcatttcactagatgctgcaaaagcatttgataaaattcaacatccttcatgataaaagttaacaaattgggtacaaaaagcaaaaagaaaatattgcagcacagtaaaggccatatatgacaaagccactgccaatgttatactgaatgggaaaaattgaaaacctttcactaagttctgcaacaaataagaatacccactttcaccacttttatttaacatagtactggaactcctagccagagaaattatgcaatagaatgaaataaaaggcatccaaataagcaaagaggaagtcaaattattctagtttgcagatgacatgattttttatgtagaaaaatctaaatactccagcaaaaaagctcttaggactgataaatgaattcaggaaattaacaggatataaaatcaatgtacaaaacaactagtagtattctacacactaagagcaatcagtatgtaaaataaatcaagaaagtaatcccatttacaatagctacaaaaactaaaatctctaagaataaatttaaccaaagaaataaaagatctctacaaggaaaactataaaacactgatgaaataaattgaagaagacacaaaaaaattggaaagacatcccatgttcatggcttgaaataattagtattgttaaaatctctgtactacccaaagtgatctagagatttaattcagtctctatcaaaattcccctgacattcttcacagaaataagaaaaataatcataaaattcacaagtaaccagaaaagaccctgaatagctaaagcaattctgagaaaaacagagcaaaaccaaaagctggaggcagcacattacctgattttaaagtatactacaaagctataatagccaaaacagcatggtactatcataaaaacagacatacagaacaatggaacagaatagagaactcagaaataaatccacacttagagtcaactgatttgcaagaaaggtgcatttgggaaaggagagcctgtttaataaacggtgctgggaaactggatatccatatgcagaaaaatgaaactagatcctcatcttttgccatttacaaaaatcaaccccaaatggattaaggacttaaatctaagacctgaaacttgatactactagaagaaaacattggggtaatgctacaggtcattggccagggcaaagattttcggggacagacctcaaaaacacagacaacacaaaccaaaattcacaaattggattacatcaaactaaaaaccatctgcagagcaaaggaagcaatgaacataggaaagcaacaacctactgaatggggaaaaattgcaaactacccaaaaatagattaataatcagaatatataatgtattaaaacaactcaatagcaaacaccaaataatatgattaaaatatggtcaaaagacttgaatagacatttctcaaaagacatacaaatggccaacaaatttatgaggaaatgctaaacattaagaaaaggagatatcatctcaccccagttagaaaagctattatcaaaaagacaacaacaacaaaaatatcagatgctggcaaggatatggagaaggggaacatttatacagtgttgttggcaatataaagaagtatagccatcatggaaaacactagggaggttcctcaagaaatgagaaatagaactactgtatgatccagtaattccactactgagtacttccaaaaaaaggaaattggtatattgaagagatatttgtattctcatgtttactgcagcactattcacaatagtcaagatatagaatcagcctcagtgccactcgatgaataaatagataaaaaatgtggtatgcatagacaatggaatatcattcagccacaaaaaagaatagaatcctgtcatttgcagcagcatggaaggaacttatttcattctgttaagtgaaataagccaggcatagagagacatatattgcattctctcactcatttctggaagctaaagaaaagtggatctcatgaaagtagagactaaaatggtggttaccagaagctgggaggggaaaggtgttggacagatgaagacaagttggttaaaattggatacaaatatacagtcagatagaaggaataagttctcatatttaatagtacaactgggaaattatagttaatgataatttattgtaaattaaaatagaagggaataactgtaatgttcctaacacaaagaaaagataaatgtttgaggtgaatgatatctcagttaccctggtttgatcattatacattgtatacatgtatcaaaatattgcatgtgtccctaaaatatgtactactattatatatcagtaaaaaattaaaacacaatatgtatgtatgtgtgtttatatgtgtacatgtgtttgtgtatgtttatatatatgtatgacagtttagaatatataaattaaaaaaaattaaacaggggaaaaatcatcaacaccaccactcagagttaaccattattttttcattatactaggtggcaattaaggtacttgggcctggatagatctatgggccagaactacaaacaaatctaataaagataccatgtgcttccagcacttttgctgtcaatcaaaagaaaacattgagacaaaacaagaatcaacagttcatttgggtaaagaacaattcatgaattgggaagcaccaaattgaaatgagattatggtctccactctagtggcttaagcagcaagcttttataggctgaccacagaagcaaagcaaagaagttggttggtttattagctacagcgaggtgtttacctgatttggctatggttcaatgggaggtcacagttaacatatcagctagttgattgttgcggtaagctgaggcttggttcagctttttctttgatcagttacaagaaatgtctccaagtttacttatgatttgcttacataagaactctgggtacagagacaacctcaagctaatggtctctttcttatttgctttactactatctgtctatcatcaccgtatcactataggattgtaagagctttcgaactagggctgcatttcctcccttctcagaagatgacattgtacctcagtcttctagattgtaatgaaatgtaaagcaggtgactccaaggaaaagagatgcatcaaaatattccacttctctctattctctaatcctaagaatgccacatttcacagtccctgacataaacattacctgacagtgggatttttctcagggtcccagagctggtatagaagttctttggcagctgggctggtaaacacagaagttttctagcaaggacgtccaaagaactgttcaaataaagataaaattctgactttttatctggttttattcagggcaaacaaattaaggacccatggtgacatcaacttaatgtatttttaaactttgggacatttgtaaataataatttccctgatattatgtagaaatgcatacattttttaaagagtcctaaaagtatcaatctcaaagagaaaattctgaaaataatacttagaccagaatgattatcaattttcaaaaaggaccactcagattatacagaattccctatgtttactgtacatctaacaatttctttttacatgtacaagcttcttaaatttcttaagcattttctcaagcaatacacataagccttgaggagacagtgtcctcagtctgttaatctcatttgcttcccacaaggaagaaaaatgtcagagttgaagcgttttggatgtgagttaacatatcctttttcttttccaacagaaacgaaatcagacttcacaggatttttagaaactctttttaaaatttaatacattagtccctctgtatcctcaggggattggttctaggatccaatacctagattatggacagataatccatagatattgatatccctagattatggatcctggagtcccttatataaaatgatgccgtatttgcatataacctatgcaatcctcccgtgtactttaaatcacctccagattacttataatatgatgtaaatgctatgtaaatagttgttctactgtattgctcagggaataatggcaagaacaaaggtctgtacatgttcagtacaaatataatcatccatttaaaaaatgttttttccattggatgcagaacccaaggatatagaaaactggctatatatgttctcttcctgccattatatattttataaaatcatttttaatgacatattctactttatatcattttactgatgattgacctgtttgtggactgttttgtctgttttctctcagtcttttgtataatgaacagtcacttataagcacatttagagccaaatctttgaatatcttcagggttatttccatagaatcaatcagcacacataggattgtgtttattgtgattatttacatcagaaataatcctgttacaaattgtcctccagaaagtatgtatttaaattttcatcatcaatatgttagaaaaatctattttttttcatagagacatgatctatgttgccttttttatgttcttcacgcaaaacctatacattgcgtattatacttgttcctcaacttgagacgggactatgtctggataaacccattgtaaattgaaaatactgtaagttgaagatatattttcacagtccctgtacatttttgactatttctgtatgttttcaacttatggtgggtttatccagatgtagtcccatcataagtcaaggagtgtgctgaaggtgtatcaccttgtcaagccaaaagattgtaaatcaaaccatgtaagtcagggacttcctgtcttttattttatcattttccccaatacgataggtgtcataggttggatttcctagaaaacagactctaaaatttttgtacaagaggtttactgggaataacacaagtgaggggttagagaagcaggacaaggcagggggagaaataaaactgcagcacaatttcaacaagggctctgttgatctttataaaaactcgagagctgggatgttccttcaaaatcatcctgccttgaataaaagggggtaggacttgatatgcttgtaacaccctgcaagctgccctaggatgggtgtgaccttggatgaggaggctgttttcagctgaaggcaactcttggagaaacatttagccataagctgcgtgctgccaacaggaccagcacttgaggaatgaatgctcttctgaaaagagaaattgagtggtgtgctagcgcctcttctccaagagatccacttactttgtataataattagtgggaacagcacctctcggattctggttggtttagttttcaggaaaatttacaagaggaaggttagtgaagtgaactacatacaatcccagccagcgcatctggtcttgatgctgcaactgacaccaaacatatctcattacaagtctgtatttctcttaccctacttctattactgactgttcagatagggctcactgggaaacagactgagatgtgcatacaggatgtttactgaagcatgtgtgcttttgcgaacaacacatgtgagggggcagggaagcagaattgggcagagagaggagctgaattgaaatgcagttgcaacagacctcattcaattttgtgagaacttcagagctgcaacagcttttcagattgaccccaccatggcacaatgtagctggactatatactcttgcactggatcagtcattagacacaggctcttctaatgtaagggatattgtggctctctttagttaatggcatttcctagagagagaaactaagctgaaatctgtcaggtgtcataccatagcagctgagggaatgagcatttcagtcctgaaatggaatctgagcaacacatcatgatatctattacagtagttaaaaatggcatctcggcctagcgcagtggctcacacctgtaatcctagcactttgggggctgaggcaggaggatcatgaggtcgagagatcaaaaccatcctggacaacatggtgaaaccccttctctactaaaaatacaaaaatcggctggcatggtggcgtgtgcctgtaatcccagccactcaggaggctgagacaggagaatcgcttgaacctggggggtggaggttgtagtgagctgagatcacgccactgcactccagcctggcaacagagcaaactctgtctcaaaaaaaaaaaaaaaaaatggcatctcattattaccatatattatttgatatgtcattgaaccacatgacttctttttgaattccctgaatatttctttcatttttctgtgttaataatgttttcttatcatgtatgttgaagatatttgctctgtttttcaattgtcattctttcttttattttttaatttttatgggtacctagtaggtgcatatacttatggggtacatgagatattttgatacaggcttgcagtgtataacagtcacatcatggtcagtggggtatcttcgtttcgttgatacatccatgtttatattttgtatggtatatttccttcccttttgcatttctttctaccatttgagctttaagaattctttatcctgattataagtaaatacagattattttatttagtaattcgatagtgttactttatttaaatattttctattatttggaatttattttagttcatggtataaggcaagaatgtaaattatgtgtgtgtgtatgttttctggatagttcaacaattatctcagcaccattcttgaatgatccatctcatctttagtgattttatgcttccaatataatatattcagttctttatatgccagattttgtctatgcaatagtctatttatcaattaacctgtttatacatatgtcaaaaacacattacctgaattattatagttttatagtattgcttactgtccagttgaactaagtaagccacagtgtgatcagcttatagatacaggagtatgtcattattatcttagatgcctaaattttcatgcctttttcgcttatgtggaaacatccatttttcttcacttctgaccatctgttctatgcattttgccttttaacaaatgtttaaatgatgtttgaaagtgtcatattcttgtcttctttcttctcctcactaccttgttcccttgcagattggcaactttttaaaacaaccattgagctgcatgtttctttttaaattccttatctcttctatcccaggcctgagcacatggtacaacataaacaaatatttttgaatgttgaatgaataagattataatttcatttctgtgttatctctttggttcttgatttctctacattaaaagtcatatctagaatacctcacaaagtggtaggaaagtatgaaaaaaatacattgaaatacactgaaatagcatatggatatgtacttttcattctttttttttctaaagagaggtcattgatgagactttcaatatttaggctagattgactttcagggacattatagagcctaactttgaagagctcaaaatatgattgaaaattttggagctcatagtgaaaaatctagataatcactgcttttgttaattagctttttattctttccacacaggtactaagtgaggaaccagctatataatttatagggacaagtacaaaaatgaaatggttgggtcccttgttcaaaatttattaagaatttcaagatggtgatagcaaagcatttaaccaagtgtgagtccttttgcaactgcatagtttgagcacccgcaaacctggcccatgactaaatacaacccatatacactatgacaggtattagcgctgtagtggggaggaaacaaatatggttacttcccttgtggaactcacagattcaatgtagacaaaagcagaacagtgacaatttatttccttaatagtgccttactagcttcactaattcaaaattggttttagaaatttcactactttgtacttattcccaatcgccaacgtagtttttgaactgccatgtctttggataatcatatagcagaatttattaaatgacaactgtttgcaggaaactatgaactcggtgaaaataaaattagaaacttatttttatcatgaatattatttctaataaagcagtataaaagccctttgtgaagggtgttttcatatctgtagtgggcatatatgtgctacaatgtgtagcagcagctggaaattttttctgtcattactgagttttgaaaagatatttttctcaaaatgtaagaaacactgtcactaaggaagaaatgcatcttattagaatgagaatgttgtagataatgattatatggtttgtcctgagattgagattactatgtatgtgatggttctctttttgggagggagataatgtcaaaatatattagccaaagaccttcagaagtaggtgggaaataggcagaaatgtatacccattagcaattgattcctcagcatgctagtcaagcccattttttgacatctgttttattttggttcttgcctcttccagcattcaagctgtcagctcttgctctgttaacaatgggggctatgagctgaagtatattcagatcactcatgaacactacaggcactggttccttccataccaccagctgacatgagatggcaaacactgagaaaggaaggcacagtaagctcatattacctgctgcaaaggaacaacatgttgagagcaataaaacttttgccaacactgtgtaccattttgtaagattgtgggtttgaaagaatattttttcccctgcagtctacttcatggattgcttttgattaacagctctttcctttttttctctgaatccattggtggctgtaagtttgtatccattctctttggagggaggacacccaactatagcaatatgattcatggtggtgaactatggcagaattcaagaatttaaagtgattttaagtatctcactgagtttataaaaaatcccaaacaaagatttctggaaaatgcgtaaatgcacaaactaagcaggatgggtgagggcttttattcttcactatcaaaatgattcttcagcatcagtatgtattttgatactgaagactcattagaaacactgtatatattcatggtagtgttttggattaaaaatatgtcttctctcttttatttttatttaattaattaaaattctctgaaaagacttggaaggctaaattcatatccccagtagaggcggcaaggtggggaagctttagacctcctcccataatcttcgtttgctccccagtggcatccaccaaatgataaatacatttattagtatggaaaataaatttttctcagtcctaagtaaaatgtaattaaaatagttttttaaaatgttgatatctttattaatctgtagcatacattcaaaatataaactgtgcttgctagaaaaatgcatcttggatcacgaggtcagagatcgagaccatcctggctaacatggtgaaaccccatctctactaaaaaatacaaaaaattagccgggtgtggtggcacacgcctgtagtcccagctactcgggaggctgaggcaggagaatggcgtgaactcaggaggcggagcttgcagtaagccgagatcgcgccactgcactccagcctgggcgacagagtgagactctgtctcaaaaaaaaaaaagaaaaagaaaaagaaaaatgcatctgcaagactgcacttctttctgaacagattttttttaagatccttctgtatagaatttctgggactactgctgctcattcttcagatatttacaactttctatctcaaattacttctattctcccaatcagtgtgtctccaccctggcaacaaagctctcctttataaatccccattgggactgtagttcagtatcactgctcccccttttcatgccttgttactatcaaagatatggtctacataccctagagtttccttgactaggcatcattcttatgccacttgtagttatacaaaagaaggatagttttcatgaagtgacgtttcattccaccaggattgtaaaagtatcttcttattctcagacccaccagtttaacaggctcaaatatacctgcttattgttcttatttacctcttgttttttatgcatgagattgaaatttgtttatatatttcttgaccatatgaacactttctgtattttattgcccctttatgtcattttgccattttttatggacgtgctttttgttaatatacagaagcttgttatatattctaaacattaatgaaccccttaaatgttaatatattcaaatattttccccaatttaatattagatttttttacatagttgatggaagtttttcttgccattctaaagtttttttcttttgtgtaatgtcttttccttcacatttttctccaaatagaatttttactttaaaatacttcatattcaccaaaatatgaattttaaaattaattaaaatgcagaaatctttaatcataaatttcaaatatttaaaacttctactatgtaaagatgaaactataaagttttatttcaatgttttatgtatatatagtgttccattgtatagattgccatcatttatttgaccaatatcagttaatgaaaacttaaatcaatgtcctagtacatattcctcaaataatggtcagatatttccttagaataaatttctaaatgtggaattattgagtagaaaacatgtaatttctcaggcttctgatattatttactagtctgtcctcaggaaaagatgacccatttatagttccacagtcatgtaagagggctagatttttcatatctaccagcacagagtacttttattcttatttattttgcaaatatatataataatttataaaaattgtaatttataaatgcaaaggtatgatggggagagtagaaaaaccaaagtttaggaagccttggaagtcagtttgagtttggactggatgtggaagaaaaaatgttagagaagcttatctctgttgtcaggttggaagtgaaacagtaaagttggcattttatgaaaattgattgatgattaaggaatctgttgcaatgtttcagttatgattaaataagtttcagcaaagatgtaacaggattaattataactaagtttaggaagaaactagaagatatagtgagagattaaaagcaaagatgagagattttaagggtttcccatttgggagtgcggaatgacaaaagtatcattgtgatgactaggaagttgataaagagaagttttttggactgattagttaagatgatagtggtgagggaagtgaaggtaggagccaagtggagggcccattacaagttaaataatggacaggtgtgtaaggctcaagaatattttcatgttgtccccaggaaatcatcaagaaatatcaggcttccacttctggcattagaaaaaccaaggtataagataaatgagctaatgagctgaatattgaaagaattagaatgtcagatcatggtaactggttgagagttggagagtagaaaggagaacagctggacaacctttgttgagagacccagaatcatagaattttaaagattgtctagttcagttatcaaattaagtgttctctggaagttaattggatttaacaggccaaagaggttaaagaaggtacattagggaagacagtctgtgtatatgtgtgtgtgggtactcctgtatgtgtgtgtgcatgtgtgtgtgtgtgcatgcgtgcccacacacacatgcacacacgtctggggaggggagggtatagatgttgtcttagtcacttcaggctactctaacaaaatactatggaatgagtagtttaaacaacatacatttatttcttacaattctggaggctaaatagttaaggttaagtcgctggcagatagggttcctggtaagaagacttctcttaccttgcagacagccaccttctccctgtgtcctcacatggtggaaggagagagtgctgtcatttcttcctcttcttataaggacattaatctcatcatgggggcccaacctcatgatcacttttttttttttgagacggagtctcgctctgttgcccaggctggaatgcagtggcgcgatctcggctcactgcaagctccgcctccagggttcacgccattctcctgcctcagcctcctgagtagctgggactacaggcgcctgcaaccacacccggctaattttttgtatttttagtagagaaaggtttcaccatgttagccaggacggtctcaatctcctgacctcgtgatctgcccacctcggcctcccaaagtgctgggattacaggcgtgagccaccacgcccagccccaacctcatgatcttgagaggtgaagccagctggacgttgggtcgggtggggacttggagaaattttttgtcttacaagaggattgtaaaatgcaccaatcagcgctctgtaaaatgcaccaatcaacactctgtaaaatgcaccaatcagcaggatcttaaaagtagccaatcgcaggaaggattgaaaaaagggcactctgataggacaaaaatagaacatgggcggggacaagtaaggaaataaaagctggccaccccagccatcagcctcaatccgctctggtccccttccacgctgtggaagctttgttctttcgctcttcacaacaaaccttgctaccgctcactctttggggttgtgccatctttaagagctgtcacacttaccgcaaaggtccaaggctgcattcttgaagtctgtgagaccatgaactcactggctggaactaactccagacacaatctcatctaaaccttattacctccccaaggccccactttcaaataccgttacattaagggttagggtttcaacctgtgaattttcaatggacatgcagttcataactgaagtgatcctagacctatagcaatttggcttaaagattctcccagaattgtgtccttctgccttccacaatgggaatgaacctatccagaccttgaaatgacctctaaaacaactaaagtgaagataaccccaaggaagcatcgaaaattaataaatttatttaggactttacatattgcactcaaggtaaaggcactgtattttcaaagcattaaaaacaatcattctctacttcaatggcaatggccttaaaagttgaaattgtaccttttgtattttcagtagaaatggattttttggtcctaatgtcatcaacctcaaattccattactttatattgaatacactgagttcccctccacacctctccttctcccagtggtatttttgctgtcattagcatctcttgccttggaaaccattgacatactgatagcagcaacttctgctgaggtccttttaactttggcactgatcaatatatgccatgcaatttattttattttcatctctttagactttgttataaaagtaataagtattcactgaaggaaatttgaggtaaattagataataaaataacacaaatgaaacataataagaccacccataatctcatcacacagaagtaataattgttaacatattggtgtatattttttcaagtattttatttgtataaacacttttatggaataagattatactatatcttttgttttacaacttgatttattaaaatgtttttaaaacattttgtgatgtcattatttaattttccattataattttctattttatgatgcttaaaatgatggcattaaaataatagcttaaatttatttagaaatttttgtgctagtcaccactgaaagtacatatatatgcattgtatcactgaaatttcacagcgaccataggagattgatactgttactgtccctaatttataaaaagggaaatggaacacagtacaggtttgataattggcccagggtttcatgccgtggaagttacagaccaggacttgaagccagggacttttaactctagaacccaagatttttcaagctgactgtataaatatatagcatgccactgtttttgcaattgcactataacaattttctaatgttgggtacttaaaatttataccttttattgctttaaagaaacaatgaaaattcttccagtgaaatctttggttccatatacactattttcctaatgacaaatgccagtgattaaaattgtatggtccaacagttatgtgcataatttatgcatcaatattttttgcaaaaatctaaaagcagccaagtcgagccagcatagactagaaactggaagtaatagaatactaaattcaaattcttttatgatttccagcagatctcagcaccgttgtgtatattgtgggaagtaagcctaataatccttttttaaccttagagttatgtaatattttgaaagtctaaaagacgattcttatgaacttagatttgacaaaatctttaagaagtaacttttagaaagtgttttaaggtaaaaccttctacctagaaatgtgctttgaatatatataatggactctcagtagaggtttgatgacccattaatccagatctggaaacaatcctgtgttttctatttttgtgatatttcacctaaggaaatgttcacctgaatcctttgataattacagaaattatctggaagcagaataaatgacatattggagaattaaggtcaaatggtctttggtgacctactgtacttttgcaaatacatcaaccatttatatctaccattgccctaatagaatttcctggcatgcatgttttcaatattagtatgtctgcaaatgctttaatacatggaaattattgatggcagatattaagctatggtaacacattgaaaacaatttgaacattttacagtttaacattttccaagccaaaaattaaaaatctgacatctatatatgtacctgaaaatttgacttttctagaaaagtctagttcctaagttgcaaaccagtactccaccattcctcctgcactattgaaagaacaactcttgtaaaataatatccatatttaggaaagactaaacaataaagacttatttccattttttttctcatttttgaaataaactgttatcaaattctctccagattatttctgttacaaaaccaccacccattatgcctcctccttaaaaacattgtgcacgatgctggaaatgggttttccctagccagcactccaactgggtactgaaggttggggctgcacacatagccagtttcaaataactgaccccctattgtccctgctgctattgttctcaacctcctttcttcctgtatgaatgctccataattgtaggttgagtacaaaattctaaaatctgttttttctcattggtaatattggattatttaaaaaaaaaaaaaaaactattatggacatagtggtatgaagaactgtggaatcagatctggttggaatcccagattccccactcactgtcatggtaagcagctatttcaactcattgatcctttatttctttatctgtgattttggagatattaatgatacatatgtcataaggttgtgaatgaagcttgagtaggacaatgcatgtaaagagcttagtaagttgcttgactcaagataaattgcttgaaacctaaagcacagagtagtgtattttctgctacagtgttacaaagatgtttcttgacaaagtcagaattggaatgcaaacatatccataacaccaaatctgatgttcaaaattcatataccctatccagtacaaccttctcaggatctccttgctggctctcaatgcttgcttactgagttttaggaatcaaattctgtacaacctcaaacatttactacagtgtcatttctcctatcttccaggagcagagcttcatttccccttttacatttgtgtccattttagtcatcactgccatcccaatttaattctgtcttcttatcacttatcttctgaagctcttatcagctgggtacaccaccctttataatccgtcttttaaccatcctatctttatgggtatcatgagagagcccaggatcctcctccattatagtgtaggagttaagaaatgggctctgaagccatactacttaagtctgaagttctctgtttccacaaatcccactttttagcttggggaccttgaatacattttctgctttcagtttcttatctgtgaaatgtagattaaaattatacctacctaattgagttgttgatcagattaaatggatgaatgcatgttaagtacttgcaaatagcacctggaacctatcaagcacgatataaatattatctgttgttattattattattatttgttaaagaattccaaacatagctaagttatcacttccaaatttatccttttgttccctgctaccatccagtaaacggatcttacctaaatgatgtattgaataaaatgtgaaaagcctgaaactgtacggggcacagggaaacactcataaactgctagcctctatagtaaatagagtagagaggaattaaaatagataaacaaataatgagctagcattagaaagacagattttacaatttaagatatttgaagtaaaacaactatgagtggcatgaaaatctaaagtgtattcaggtttgtgtatagcaaaacctgagtggagttgaggaaatttagaaatgaaattcttctaaaaaaggagtttatgtcctttgcaggggtattgatgaagctggaaaccatcatcctcagaaaagtaacacagaaacagaaaaccaaacactgcatgttctaactcataagtggggttgaaaaatgagaacacatggacacagggaggggaacatcacacacgggggcctttctggggatagggggaaaggagagagagagtgttaggacaaatacctaatgcatgcaggacttaaaacctagatgataggttgatgggtgcagcaaaccaccatggcacatgtatacctatgtaacaaacctgcacgttcagcacatgtatcccagaacttaaaataaaaaataattaatttaaaagagttaaaaaaattaaaaaatactaaagtcagaaaagatttactagattcctactatgtgcaagatactaagagaaaaaagtaaataagatattcctactgccctcaaaaagtttacactttttgattctcagcccctcagcacttgacctaatttgccctagactttcttcctgaaagtccctttctttggattttgagaccctattcattcctagttctggttctgtttctaacacttaatcttcttctatatctcttcctatatgaatacacttgttcacctttccacatcgtgtaaactttttgagggcagtaggaatatcttatttgctttttttctcttagtatcttgcacatagtaggaatctagtaaatcttttctgactttagtattttttaatttttttaactcttaaattaattaatttattttttattttaagttctgggatacatgtgctgaacgtgcaggtttgttacataggtatacatgtgccatggtggtttgctgcacccatcaacctatcatctaggttttaagtcctgcatgcattaggtatttgtcctaacactctctctctcctttccccctatccccagaaaggcccccgtgtgtgatgttcccctccctgtgtccatgtgttctcatttttcaaccccacttatgagttagaacatgcagtgtttggttttctgtttctgtgttacttttctgaggatgatggtttccagcttcatcaatacccctgcaaaggacataaactccttttttagaagaatttcgtttctaaatttcctcaactccactcaggttttgctatacacaaacctgaatacactttagattttcatgccactcatagttgttttacttcaaatatcttaaattgtaaaatctgtctttctaatgctagctcattatttatctattttaattcctctctactctatttactatacttacactaataatgcctaacatttattgagtgcctacaatattccagacaatgtattcgttgttttacctgcattatttcacttaatatttacataatcccatgaaatattgttattatgtttattttacagataaaggacttaaggccctaggaagtcaagttattgtcccaaggtctcagagctactggctttgccagaatcaggctacaaattcatgtttccttcatcttttctctatgccattttgaaagtttaccatattaaatgttaacataaatattctagatgataatttttttgttgtttttgttgttgagatggagtcttgctctgtcgcccaggctggagggcagtggcacaatctcagctcactgcaagttccacctcctgggttcatgccattctcctgcctcagcctccctagtagctgggattacaggcacccaccaccacgcccagctaatttttttttctttttttttgtatttttagtagagacagggtttcaccatgttagccaagatggtctcaatctactgacctcatgatccgcctgcctcggcctcccaaagtgctgggattacaggcatgagccacagcgcccagcctctagatggtaattactatagcaattctgaggaatataatttttaataatatgtcttaacttttctttgaaagtctagtttctatccattggttctctaactgcatttattaatgcttctcaaagcacatagtctccttgtacctcagagaatgtggcatttgataaccagatttcttgtctgagctggctgcaatggtgttggaaattggctctgcagctgggctggactgcagttaggaaacatgattgtagatggtgaactgtcactgctgggatgtgaaccagacatgaatgctaagcaatagtgtccacagtttgcaacccaggaactgccaaattgacagctagactaaactgtagcagcataggaaaatgtggctagtttctccagtcagtcaatacaaagtcttatattgtactataatgaatacaatcttactgtcccaaaaactgagatgctgtcaattatgaatctcagttagattcttagcaagtatttcatgtgtgaacacccgtataagcctcataatggccctaactgtagttggtttggattagcttttacagtgaacatgcagttcattaagcttacagaaactccaacagcagctgcacatctctccatgaactatataggttttttgcattttatctaggactagatgaaagggatccataaggctgtgctagaaataagtcttgattctctgagggacttgaatagatatagagtgtgtatgaaatgaataatatcagtaatgagcaaaacttgaaaggaaaatctaaaggtttggggggttctgtttccttttaaggaagttgtggcaaattattgttttataataattttgctttgagaatttcttcaggcttgggatattcatttgttatttcactagacagaacatctgcttaccttcctcaccattctctcacatatttctttgtcattcatttccttcatgccagggacttctgcaagttcccattatgttccaagcactggggctggaaatgagttctttgatacaaaaaaacaaacgtctctgccctcaagaagctcatggtctagtggggaagacaattgcataaaaagagaatatagcaacacagtggtaaagatgtgtatattatattaaaggaaccccagtgggtagcatctatgccacctgaaagggggttcagaaaaggcttttaatagaagacacttgagttgaactttaagagaagtaggaatcagtccaaagaagaaaaatgccaatgtctagacatccccaatatataggattaccacacagatagagatcccattataattcatatatcaacaattaaagaagctattgggattttagagtagatatttttatttgcaatatatccaaatattttttcttaggactagaacattttctctgtctggtaaaatgccactgtatctttagatatgaacatgtgcattgtttaagtacatgaagacttcgttaaacatagacacctcaactttattagtagaatcactggctttagagcatctttgaagatcaaaaagtgagaatctagagaggtgaaatcaagagactctgaccagtgacacaccttctcagatgctctggggcttatggaggtatgcatggaagttaccagcatatgttttaaagaaagtgatttgaataaagcattacatgagtgtgttgggaggtagtcatgctgaggtcagaattagccagattctttccatgtcatctgcaatcctttcatctaacttccaaaagagtggttgctggaaaacctaaagaaatgtttaattttaatttttttaatttttttttatttagagacaaggtctctcactgtcccccagcctggagtgcagggggcaatcatcactcactgcagcctggccctcctaggctcaaacaatcctcctacctcagcctcgagtagctggactacaagtgcatgccaccatgcccagctagttttttaaaaactttgtaaaaatggggtctcactatattgcccaagctggtctcacactactggcctcaactgcttctcctgccttggcctcccaaactgctggaattacaggcatgagacactgtgcccagcgctaaggaaaaatgtaatatggcatcttttaggaaaaaagtattctggacttaagcttgaaatttgtgctgctgattttaataaaataacatttagctgcctccagtgtaaacctttcacagattctaaaagaggtgttttttgtgttttttttcttgcaatttcagaaatgtaaattggctattatagtttacaaggtaggtacatgttttgttatataaataactcagaaatatctctctggctcttcatacaatacaatctttgcaaagtagaaatatatcatgaagactaagtgaaataaatataatcatagccaagttttgattttttaaaaaaagaatattcaatgtttttattagactcaaaggtctttacaccccctccaggccccaggctttattaaggtataattgataaattaaaattgtgtatttttacagtgtacaatgtggttttgatacatgtatattttgtggaattattaaatcaagctaattaacataactatcacctcaaatatttatctttttttgtgatgagaacatttatgatctattcacttagcaatttttaaaatttacaatatattattattgactgtagtcaacataactctccagaaattatttatcctttctaacagaaatattgtatcttcaaccaacatctcatttctcccttacctcccttcccaggccctggaaaccaccattctgctctctgcttatacaaattcaaattttttaattccacatataagtaagataatacagtatttctgaacctgacgttcacttagtataatgtcccccaagttcatccgtgttgctgctcatgacgggattttcttcttttaaaagactgaatagtattctgttgtgggtgtcttttttctttattcatttctttatgcattcatctgtcaatgggcacttacattgaacatgggagtacagtaatctcttcaacatactgatttaattgtccttgaatatataccctgaagtgtgaataatggatcataaataaattccttttttaaaaataaatcactcagtttcaggtactctgttataagcaaggaaaatgaactaagacagatattaaccttttatcataagtataatttgcaaatattttctctcattccataagttgtcttttcgttctgttcattggtgttttttttgttttgttttgttttgttgttgttgttgttgttgtgttgttgtttctgtgcaggaggtttttagtttgactcagtcctgtttgtgtatttttgcttttttggccggtgcttttgaggacgtattcaaaaaataattgttcagaccaatgtcaagaagcttttcctctatgtttatttgaatagttttacagttcaggtcgtatacttaaacctttaattcattctggtttgattttgtatatggggtaagataagggttcaatttcattcgtacacatgtggatagttattgaagatactgtctattctctattaggtgttcttgacatttttgtcaaggatcaattaaccataaatttgtggattagtttattggttttctttctgtcccattggtctatttgtgtattttatgccagtaccatgttgttttgattagtgtagatttgtagtatttttgaaatcaattagtgtgatatatccagctttattccttttgatcaaaattgctttggctattgaaggtcttctgtggttctctatgaatcttaggatttctttctatgtccatggtatgtatacatttacctatgtaacgaacctgcacttcctacacatgtgtccttgagcttaaaataaaagttggaaataaaaaaattaaaaatgtgggaaatattttaaaatgcaatgagaattttgataggaaccacattgaatctgtagatttctttgggtagtaggggcatttcagtagtattaattcttttaatccatgaacaccggatatctttctatttgtttgtgttgtcttcagtttctttcatcaatgttctatagttttcagtggacagacctttcacctccttggttacatttcttgccaagtatttcatttttattgatgctattatatgtggaattgctagattgatttattttttgaataatttgctgttggagtataaaaatgcaactgatgttttgtgctgattttgcatcctgcaattttatttaatttgttttttagttctagcagtttctggtagagtctgcaggatttcctatatataagaacttgtcatctgcaaatagagacaattttatttcttcctttatattttggatatcttttctttctttctttttttttttttttttgcctaatttatctgtctaggaattccagcactatattgaatagatgtggtgaaagtgaacatctttatcatgtttttgatcttagaggaaaagcctttagcttttcattggttagtttgatgttagctgtgggctggttgtatatagcctgtacttagtcaagatacatttcttctacacataatttgttggaagttttttcatgaaaggatattgaattttttcagatgtttttacttcatccaatgaggtgaccatatgggttttatccttcactgtgttaatgtggtatatctcatttgttaatttgtatatattaaacaattattgcattccaaggataaatcctacttgaccatggtgtatgatcctttttttttttttttttttttgctattcctatttttttttattatactttaagttctagggtacatgtgcacaacatgcaggtttgttacatatgtatacatgttccatgttggtgtgctgcacccattaactggtcatttacattaggtatatctcctaatggtatccctccccatccccccaccccccaatgggctccagtgtgtgatgtttcccttcctgtgtccatgtgttctcattgttcaattcccacctatgagtgagaatatgctgtgtttggctttttgtccttgcgatactttgctgagagttatggtttccagcttcatccatgtccctacaaaggacacgaactcatccttttttacggctgcatagtattccgtggtgtgtatgtgccacattttcttaatctagtctatcattgatggacatttgggttggttccaagtctttgctattgtgaatagtgccacaataaacatacgtgtgcatgtgtctttatagcagctatgatttataatcctgtgggtatatacctagtaatggaatggctaggtcaaatggtacttccagttctagatccttgaggaatggccacactgtttccacaatggttgaactagtttacagtcccaccaacagtgtaaaagtgttcctatttctccacatcttctccagcacctcttgtttcctgattttttaatgatcaccattctaactggtgtgagatggtatctcattgtggttttgatttgcgtttctctgatggccagtgatgatgagcattttttcatgtgtcttttggctgcataaatgtcttcttttgagaagtgtctgttacgaaatgaaggcggaaataaagatgttctttgaaaccaatgagaacaaagacacaacatactagaatctctgggacacatttaaagcggtgtatagagggaaatttatagcactaaatgcccacaagagaaagcaggacagatctaaaattgacaccctaacatcacaattaaaagaactagagaaggaagagcaaacacattcaaaagctagcagaacgcaagaaataactaagatcagagcagaactgacggagatagagacacaaaaaacccttcaaaaaatcagtgaatcaaggagctggttttttgaaaagatcaacaaaattgatagactgctagcaagactaataaaaagaaaaagagagaagaatcaaatagatgcaataaaaaatgataaaggggatatcacaaccgatcccacagaaatacaaactaccatcagagaatagtataaacacctctacacaaataaactagaaaatctagaagaaacggataaattcctcgacacataacaccctcccaagactaaaccaggaagaagttgaatccctgaatagaccaataacaagatctgaaactgaggcaataattaatatcctaccaaccaacaaaagtccaggaccagatggtttcacagccaaattctcccagaggtacaaggaggaactggtaccattccttctgaaactattacaatcaatagaaaaagagggaatcctccttaactcattttatgaggccagcttcatcctgataccaaagcctggcacagacacaacaaaaaaagagaattttagaccaatatgcctgatgaacatcgatgcaaaaatcctcaataaaatactggcaaaccaaatccagcagcacatcaaaaagcttatccaccatgatcaggtgggcttcatccctgggatacaaggctggttcaacatatgcaaatcaataaatgtgatccagcatataaacagaaccaaagacaaaaaccacatgatgatctcaatagatgcagaaaaggcatttgacaaaattcaacagcccttcacgctaaaaactctcaataaattaggtattgatgggacatatctcaaaataataggagctatttatgacaaacccacagccaatatcatactgaatgggcaaaaactggaagcattccctttgaaaactggcacaagacagggatgccctctctcaccactcctattcaacatagtgttggaagttctggccagggcaatcaggaaggagaaagaaataaagggtattcaattaggaaaagaggaagtcaaattgtccctgtttgcaggtgacatgattgtatatctagaaaaccccatcgtctcagcccaaaatctccttaagctgataagcaacttcagcaaagtctcaggatacaaaatcagtgtgcaaaaatcacaagcattcttatacaccaataacagacaaatggagagccaaatcatgagtgaactcccatttacaattgcttcaaagagaataaaatacctaggaatccaacttacaagggacatgaaggacctcttcaaggagaactacaaaccactgctcaaggaaataaaagaggatacaaacaaatggaagaacattccatgctcatgggtaggaagaatcaatatcgtgaaaatggccctactgcccaaggtaatttatagattcaatgccatccccatcaagctaccaatgactttctttacagaattggcatatgatccttttaatttgctattacgttttgtttgctagtgttatgttgaggaatttgcatctatgttcatcaagaatattagcctgtaatttttgtttgtttgtttgttttgtttgtttgtttggtgacacaaagtctctctgtctcccagactggagtgcagtgccgtgatctcagctcactgcaatctctgcctcccaggttcaagtgattctcctgcctcagcctccccagtagctgggattacaggtgtgagcccttatgccctgtaattttctttcttgaagtgtccttgtctgacttttctatcaggatgatgttggctttataaaatgagtttggaagtgtttcttcctcttcacctttttggaagcatttgagaggaataggtgccagtttttaaaatatttaataaaatataccaatgaaaccatcaaatatgggacttttcttttttggaaagtttctatttactgattcaatctccttccctgtattggtgtgttcagatcttctatttctgagatgatccagtcttgatagattttgtgtttctaggaatttatccatttcttctaggatgttgcattcattggagtataactcttcatagtagtgtctcatgatcctttatggtgctgttctataaattgtaatgtcgtctctttcatttataattttatgcacatattctttttttagtgtagctaaaggttcatcatcttatcaaaacagcaaatcttagttttattagctttttctattgttttcctagttttaattttatttatatctactctgatctttctcattttcctcctgctggtgaattagggcttactttgttgttctttttctagttcctcgatgtataaattagttttttttttttcttgagatcttttttctctctcaatgtacgtcttttttgctataaacatatctcttagcactgcttttgctgcatgccatatgttttggtaagttgtgtatccattttcatttatctcaagatattttttgatttcccttttcatttattcttgacccattgattgttgagataggtgttgtttaatttccacattttggtgaattttctaattttcttcctgttagtgttttcaagttttaaaacattatagtcaggaaagatactggatatgatttcagtcttcttaaatttcttaatacttgttttatgacctaatatgatctacttggacaatgttccatatgcacctgaaaagaatgtgtgttttgctgctgttggataaagtgttctgtatatgtctaataggtctatttgctctacagtattgttcaagcccactgttttcttattgactttctatctagatgatctatccattgttgaaagttggctattgaagtcttccattattgtattactgtctacttctcccagcagtcatgttagtatttgccctatacatttacatggtgcctttttgggtgcatatacacttataatcattctgtaatcttagtgagttgactctcgtgacctcctttgtatttcataatagtttttgtcttaacatctattttctctgatataaatagccacctttcctctcttttgtttacatagaatgtctttttccattccttcactttcagtacatgtgggttttaaaactcaagttaatctcttgtaggcagcacataatttaatcttatctttttatttatgtagacactttgtgtcttttgattggagaatttaatcaatttacatctaaagtaattattgataggtaaagacttactactgccattttgttaatattgtcctgactacttagttccattctgcctctattattgtctttctttgtgatatgtgattttctctagtggtattatttgtttcctttttcttaactttttgtgaattttgtacagttttttttcttgtagttaccatgaggcttatgtaaaacatctcatagctatatcagactattttaggctgataacaatttaatttcattggcattcaaaaactacactttaccttttcctcctgcatgttttatgttatttatgtctcaatttacattttttgtatttatcctgtccattaacaaattattgtaaatacagttattttaatactttttttgtatttataaaccaccaggtttatttacataccaccattacagtatcagagtagtctgaatttgaccatattcttaccttataatgagttatactttcatatttttcatgttgttggctgacatccttttgttttaacttggaaaattcactttagcatttcttgtaagacaattccagcggtaataatctcccatggcttttctttgtcttggaaagtccttacttatctctcattcatttctgaaaattagatttgctgggtatagtattctttgttgacaggcctttttgtctttctttctttcattttaacatattgaatatatcagcccactctctcctcacctgtaatgtttttgctgaaaaaactgctaataatcttatgaactttcccttgtatgtagcaagttgtctttctcttgttttctaacttctgtcttatgtttgacttttgaaaatttcattattatgtgtcttgatgaagatctctccatatttaatctatttgggttatttgggcttcatggatatggagattcattttcatctccagatatggggagtttttttaatcattatttcttctggcccctttatctttctctgccccttcttgaactaccatgatgcatacattgtttcacttgatcttttctcagaatttctgtaggctttctttacacctttttattctttttttcttttcatttccctgtctgggtaatttgaaatatgctttctttgagcttgctgattctttctttgcttgattgagtccactgttgaagctttgtataaaattttcagttcagtcattgatttgtagtgccacaacttttgtttggttattttttatagcatatctttgttctactttttattctgtacatgtattgttttcctaattttattttttttttatttatgttcttttgtagctaagtgggcttctttaaaattattttgaattctttgtcaggaagttcacagacctctattttttaaggaagggtcagttactggtgctttactttttttcctttggtggtattatgttttcctgatgtttatgattatgtggacataaattagtatgtgcacatatgaaaaagtaagcacctatttcagtctttacagacaggctttggaaagaaaagttccactagtcagtttatccaaagattcttggaagaccatcttgcagggttcatgggtagacttgctgctagagtcttggggcctggtgtagggtcagaagcttggcaggcttagcacctggttccacaggtgtaggcttagtgcctgggtccacagggttgagcccagagcctgagtccactctggagtctggagcttgaatctgctgcggtgggcttgaatcctgagtcactggggctcagcttgtggctgagatccactgcagtgcgcttgtttactgggtctgtgggagtggtcatattggagtttggatcctcaggggcaggcctggaagctatattcacaagtcctgaatttgtacggactatcctgaagctagagttactgggattatagcttggtacctaggcccataggggcaggcccagggcctgcttccatgggaacgggcctagagcctaagtccataggggctggcctagttctggatctagcctagagcctgagttcacaggggtagttctggagtctgggaatataggggccagcctggtgctaaggtctactggggtggacctgaaccctgatgtactatagccagaggcctgaagcctagattcattaatgctagtctgaggcctgagacaaccactggagctagcctggctctagggtaggcctgaaacctttggctgtggggtccagcctggagcctggggctgtagggtcctgcctggcattggagtgggcctgaaggctttacctgtacgtgctggtctggaacttggggctatggccgccaacctgatgccagggttcacaatctcaccagcatctgttattttttgactttttaataatagccattctgactgatgtgaatgttgcctcactgtggttttgatttgtatttctcttatgattagtgatattgaactttttttcatgtgctttttggccacgtgtatatcttttctcccattccataggttgtctctttgttctattcatagttttcttttgctgtgcagaagctctttagttgaaatagatcccatttgtcaattttggcttttcttgcaattgcttttggtgccttcatcatgaaaacctgttcctatgttcagaatggtattgccttggttgtcttccagggttcttatagttttgggttttacatataagtctttaatccatctcgagttgatttttgtatatagtgtaaagacaggatccattttcaatcttctacatgtggctagccagttatcccagcactatttattgaacagagggtcctttcccatggcttgtatttgtcaggttggtcgaagatcagatggttgtgggtgtgtggcctaatgtggtgcttttcttctcatgtttatcctccttgagttcattgaaattttgggatatgtggttttagttatcaaatttagaaaatgtttgatcatttttacaatttatttattattattatactttaagttttagggtacatgtgcacaatgtgcaagttagttacatatgtatacatgtgccatgctggtgcgctgcacccactaactcgtcatctagcattaggtatatctcccagtgctatccctcccccctccccccaccccacaacagtccccagagtgtgatgttccccttcctgtttccatgtgttctcattgttcaattcccacctatgagtgagaatatgaggtgtttggttttttgttcttgtgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgacgcaataaacatacgtgtgcatgtgtctttatagcagcatgatttatagtcctttgagtatatactcagtaatgggttgcctgggtcaaatggtatttctagttctagatccctgaggaatcgccacactgacttccacaagggttgaactagtttacagtcccaccaacagtgtaaaagtgttcctatttctccacatcctctccagcacctgttgtttcccgactttttaatgattgccattctaagtggtgtgagatggtatctcattgtggttttgatttgcatttctctgatggccagtaatggtgagcattttttcatgtgttttttggctgcataaatgtcttcttttgagaagagtctgttcctgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttctcttgctgtgcagaagctctttagtttaattagatcccatttgtcaattttggatttattgccattgcttttggtgttttagacatggagtccttgcccatgcctacgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagaaccatttattaaatagggaatcctttccccattgctcatttttctcaggtttttcaaagatcagatagttgtagatatgcggcgttatttctgagggctctgttctgttccattgatctatatctctgttttggtaccagtaccatgctgttttggttactgtaggcttgtagtatagtttaaagtcaggtagtgtgattcctccagctttgttcttttggcttaggattgacttggcaatgcgggctcttttttggttccatatgaactttaaagtagttttttccaattctgtgaagacagtcattggtagcttgatggggatggcattgaatctgtaaattaccttgggcagtatggccattttcacgatattgattcttcctacccatgagcatggaatattcttccatttgtttgtatcctcttttatttccttgagcagttgtttgtagttctccttgaagagttccttcacatcccttgtaagttggattcctaggtattttattctctttgaagcaattgtgaatgggaattcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttatgccagttttcaaagggaatgtttccagtttttgcccattcagtatgatattggctgtgggtttgtcatagatagctcttattattttgaaatacatcccatcaatacctaatttattgagtgtttttagcatgaagcattgttgaattttgtcacatgccttttctgcatctattgagatcatcatgtggtttttgtctttggttctgtttatatgctggattacatgtattgatttgcatatattgaaccagccttgtatcccagggatgaagcccacttgatcatggtagataagctttttgatgtgctgctggatttggtttgccagtattttattgaggatttttgcattgatgttcatcagggatattggtctaaaattctctttttttgttttgtctgtgccaggctttggtatcagaatgatgctggcctcataaaatgagttggggaggattccctctttttctattgattggaatagtttcagaaggaatggtaccagttcctccttgtacctctggtagaatttggctgtgaatccatctggtcctggactctttttggttggtaagctattgattattgccacaatttcagatgctgttattggtctattcagagattcaacttcttcctggtttagtcttgggagagtgtatgtgtcgaggaatttatccatttcttctagattttctagtatatttgtgtagaggtgtttgtaatattctctgatggtagtttgtatttctgtgggatcggtggtgatatcccctttatcattttttattgtgtctatttgattcttccctccttttttcttagtcttgctagcggtttatccattttgttgatcctttcaaaaaaccagctcctggattcattaatttttgaagggtttttatgtctctgtttccttcatttctgctctgattttagttgtttcttgcattctgctagcttttgaatgtgtttgctcttgcttttctagttcttttaattgtgatgttagggtgtcaattttggatctttcctgctttctcttgtgggcattcagtgctataaattgccctctacacactgctttgaacacgtcccagagattctggcatgtagtgtctttgttctcgttggtttcaaagaacatctttatttctgccttcatttcgttatgtacccagtagtcattcaggagcaggttgttcagtttccatgtagttgagcggtttttagtgagtttcttacccctgagttctagtttgattgcactgtggtctgagagatagtttgttataatttctattcttttacatttgctgaggagagctttacttccaagtatgtggtcaattttggaataggtgtggtgtggtgctgaaaaaaatgtatattctgttgatttggggtggagatttctgtagatgtctattaggtccacttggtgcagagctgagttcaattcctgggtatccttgttgactttctgtctcgttgatctgtctaatattgacagtggggtgttaaagtctcccattattaatgtgtgggagtctaagtctcattgtaggtcactcaggacttgctttatgaatcttggtgctcctgtattgggtgcatatatatttaggatagttagctcttcttgttgaattgatcccttgaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcaggtgagatgggtttcctgaatacagcacactgatgggtcttgactctttatccaatttgccagtctgtgtcttttaattggagcatttagtccatttacattgaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatacgaaattctgggttgaaaattcttttctttaagaatgttgaatattggcccccactctcttctggcttgtagagtttctgccgagagatccactgttagtctgatgggcttccctttgagggtaacccggcctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccgtcactttcaggtataccaatcagacgtagatttggtcttttcacatagtcccacatttcttggaggctttgttcatttctttttattcttttttctctaaacttcccttctcgcttcatttcattcatttcatcttccattgctgataccctttcttccagtttattgcatcggctcctgagtcttctgcattcttcacatagttcttgagccttggttttcagctccatcagctcctttaagcacttctctgtattggttattctagttatacattcttctaaatttttttcacagttttcaacttctttgcctttggtttgaatgtcctcccgtagctcggagtaatttgatcgtctgaagccttcttctctcagctcgtcaaagtcattctccgtccagctttgttccgttgctggtgaggaactgtgttcctttggaggaggagaggcgctctgctttttagagtttccagtttttctgctctgttttttccccatctttgtggttttatctacttttggtctttgatgatggtgatgtacagatgggtttttggtgtggatgtcctttctgtttgttagttttccttctaagagagaggaccctcagctgcaggtctgttggagtacccagccgtgtgaggtgtcagtctgccccttctggggggtgcctcccagttaggctgctcgggggtcaggggtcagggacccacataaggaggcagtctgcccgttctcagatctccagctgcttgctgggagaaccactgctctcttcaaagctgtcagacagggacatttaagtctgcagaggttactgctgtctttttgtttgtctgtgccctgcccccagaggtggagcctacagagtcaggcaggcctccttgagctgtggtgggctccacccagttcaagcttcccggctgctttgtttacctaagcaaacctgggcaatggtgggcgcccctcccccagcctccctgctgccttgcagtttgatctcagcctgctatgctagcaatcagcgagactccgtgggtgtaggaccctctgagccatgtgcgggatataatctcctggtgcactgtttttttgtgtgttttttttttgtatttattttattttatttttatttttatttttttattttattttttttattatactttaagttttagggtacatgtgcacattgtgcaggttagttacatatgtatacatgtgccatgctggtgcgctgcacccactaactcgtcatctagcattaggtatatctcccactgctatacctcccccctccccccaccccaccacagtccccagagtgtgatattccccttcctgtgtccatgtgatctcattgttcaattcccacctgtgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaacaacagtgtaagagtgttcctatttctccacatcctctccagcacctgttgtttcctgactttttaatgattgccattctaactggtgtgagatgatatctcatagtggttttgatttgcatttctctgatggccagtgatgatgtgcattttttcatgtattttttggctgcataaatgtcttcttttgagaagtgtctgttaatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctttgcagaagctctttagtttaattagatcccatttgtcaattttggcttttgttgccattgcttttggtgttttggacatgaagtccttgcccacgcctatgtcctgaatggtaatgcctaggttttcttgtagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggttactgtagccttgtagtatagtttgaagtcaggtagtgtgatgcctctggctttgttcttttggcttaagattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttaagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccccggccagaacttccaacactatgttgaataggagcagtgagagagggcatccctgtcttgtgccaattttcaaagggaatgcttccagtttttgcccattcagtatgatattggctgtgcgtttgtcatagatagcgctgttttttaagcccgtcagaaaagcgcagtattcgggtgggagtgacccgattttccaggtgctgtctgtcacccctttctttgactaggaaagggaactccctgaccccttgcacttcctgagtgaggcaatgcctcaccctgctttgactcgcacacggtgagagcacccactgaccttcacccactgtctggcactccctagtgagatgaacccggtacctcagatggaaatgcagaaatcacctgtcttctgtgtcgctcacgctgggagctgtagactggagctgttcctattcggccatcttggctcctcccctgaaaatgttcgatcattattcacacttttttctttctcttactctgtcttctctcctttagattttctagttatgtgacattttcttcttgctactttccactggtcactgaaggctctgattattttgtcttcattaaacttttgtgagataattttagatttgcatccagttgtaagaaataatatagagagagcctatgtatgatttacccaatcccctttaatgctaacatcctgcaaaattataatacaatataacaaacaggatgttgaaattggtgtaatcaagatacagaatatttcattcattgcaatggtctctcgtgttgccatttaatagccacagtcacttttctccatccctactccctccgtaaccccgaaagctactaatgtattccccatttatataatttttgtcatttcaagaatcttatataaatagaatcatgcaatatgtaacctacatggactggatttttttcatccagcataattccctgcagatttattaggtttttacatgtaacaatagttcatttttatggctgagtagtattccatgatatagatgtatcacagtttgtttaaacgtttttcatttggactgatatcagttgcagcagttatgaataaagctgcttttttctatgaaaagtttttaatacttttacatttaagttagtgatccatctttggttaatatttttggtaaagtatgagatgtattcttgctgatgcatttgttgaaaaggttatccttctttattgaattccttttgcacctttcccattaatcaagtgggaatatttctgtgaattctcttatgggctctccattttattccattgattgatgcatatatctcttcaccaatatgacatagacttgattagtcttgaaatcaagtaaatgatcttaccttactcatatttattataactgttttagctactgtactttttgccttttcatatattttttggaaaaacttggttatatacaaataatgttgcttggattttgataagaattgtattaatcctgtatatcaatttcaggaaaatactcatatttttattacactgagtcttccaagccacaaatacaatatatctctcaatttatctatctttaattttgtttatcagtattttatagattttagtatagaagatctataaatatcttgttagatttacatcttttctctttttgagctatggtaaatattattgccctttaattttactgtccatgtgtttgtcactaatatatagaatataactgattttttatgtttatcttttattctgctaacttgttgaactcgttttttagttttggagtttataaattccttaagatttcctgacaattatatgcaaattgaaaccatttcgttgcttttctgatctgttgttattttatttacttttcttgcctttatacactggctagaacttccaaccctacattgaatagagtcatgagagtaaacattcttgccttgctgtcagtcatagagggaaagaatctggtcttttaccattgaatatacagatggtccttcatatctgtggcattttatctgtggatttaatcaacaatggaacaaaaatttttaaagaaacttaatcgttgtgtctgtgctgaacatgtatacagaactttttcttgtcattattccctaagaatacagtataacaattatttacatagcatttacactgtactaggtattatcagtaatccagggatgatttaaagtatatgaaaaaatgtgcagaggctatatgcaaacactacatcattttatataaaggacttgggcatccatggatttttgtattcatgaggggtcctgggaccaatctcccatggatgttgaggaacaactgtaatgttagctttaggtttcttgaatatactgtttgtcaagttgaagaagttttcaatactctcattttttctgagattttaaaaaaagtatgaatgggtgttgaattatgccaaatggttttttctgcattgattgattatcatacgaattgtcttctttattctatgattatggtgaattagattgattgattttttaatattgacctgttttgcatggtacaataaattccatttgatcatgttgcatattttttgtacaaatatatatatatagtatatacatatatagtacatatatagtatatatatgtataaaagtttcattcgtattttgttaaggatttttgcatctttattcatgagtgacattggtgtattttgatgatacacaaatcatcataagaatttctttcttctttctttcttctctctctgtctgtccatctgtctgtctgtctgtcttttttcttttctttctttctctcttaatatctttgcctgatttcggtatcaggaaaatactagctacactgttttctggaagaaattgtagaattattgttatttgttctttaaacatttggtagaattattcggtgaaaccatctgggtctagatatttttcttttgagactatttaaatgatgaattatttgtttcatagttacagggctatacaaattatctatttcttatgagtgagttgtggtagcttgtgttttttgaggaattagcccactttgtctaagttgccaaatttatgtgtataattatttgtagtagttccttattatagttttattatcatcggtgtccgtagtaatatccttgttttattcctgatatgggtaatttgtgtcttctctttttttttcattgttaatcttttgttgtcaattttattgacaacattgcaataatgttctgtattgcttttctgttttcaattttattgatttcttgtattatctttattattttctttgttttgctttctttgggttgattttgctcttcttattttaaattcttaaagtagaagttaaaattattgatttaagacttttcctctttttcaatgcaaacatttaatgctgtacattttcctctcatcactgttttagctgtgagttcaaatttttgatattgtatttttatttttattcagctaagtgtatttattttcccttgacacttcctctttgacttatgaattacatagaagtctcctgcttagttatcatgtgtttggagcttttcctattatctctctgttattgatttgtcatttgattccattgtggtttgattttaattccattacattttttaggtttgttttatggttcaagatgtagtctatcttggtatatattctgtgagcatttgacaagaatgtgtattctgctatcactgggtagagtagttaatgtcaagtagatcctacggtcttacggtattgagttctttgttgatgctagttttgtgtctagttctatttttaattggtacaagagtgctgttgaagtccccaactataattgtgcattagtctatttctcctccatttctaacagcttttgcctcacatatttcactattttattttttggtgcacatacatttagggttgttatctctcattggttgattgactcctttattattataaaatgtcccttcctatttctggtatcttttttttttgctctaagatctaatttatctgatatagccacagatatagctgtgtccccatcaaaatctctcatcttgaattcccacatgttgtaggagggagctggtgggagataatttaatcatgggggaaagtctttcccatgctgttctcataatagtgaataagtctcacaagatctgatagttttataagggggagtttccctgcacaagctctctctttgcctgctgccatacatgtaacacgtgacttgctcctccttgccttctgccatgattgtgaggcttccccagccacatggaactgtaagtccattaaactctttttcctgtataaattgttcagtttcaggtatgtctttatcagcagcctgaaaatggactaatacagtaaattggtatgagtagtgggatgctgctaaaaagatacccaaaaatgtggaagccactttaaaactgggtaacgggcagagtttggaacagtttcgagggctcagaagaagacaggaaaatgtgggacagtttggaacttcctagagacttgtcgaatggctttgaccaaaatgctcataacgatatggacaatgaaatccaggctgaagtggtctcagatggagatgaggaacttgttgggaaccagagcaaaggtgactcttgttacgttttatcaaagagactggtggcattttgcccctgccctagagatttatggaactttgaacttgagaaagatgatttagggcatctggtggaagaaaattctaagcagcaaagcattcaagaggtgacttgggtgcagttaaaggcattcagttttataagggaagcagagcataaaagtttgaaaaatgtgcagcctgacaatgtgatagaaaagaaaatcccattttctgaaaagaaatccaagccggctgcagaaatttgcataagtaatgaggagccaaatgttaatctccaagacaatggggaaaatgtcttcaggccatgtcagaggtcttcatggcagcctctcctgttacaggcctggaagcctaggaggaaaaagtggtttcatggggtgggcccagggtcctcatgctgtgtgcagcctagggactttgtgccctgcatcccagctgctctagtgatggctgaaaggggccaaggtagagcctgtttaacctgttttgatttggagaagcacagaaaatgaggcacacagagattcacataaagatgccatgtatttgaggagcaatctgcctgtgtggcaatagagaaggagagagcttttagactatgaagcctggaagtttacaatggccccttaccctgaccagaacttcctgaaaaaaagttaacaaaggaaatagtaaataaagtaaatatatactagcaaataaaggctgctattaagtaaaggctaatattgaagaatctgaaaagcatcagcagaaatttattgtaagagaagagtatagaagtgggaaacaatatttaccatcaaataaaaagtaattgccaataggaaaatgttgcacagaacacattaaagaaaaccctttgaaaaattcaaactaaagagactttttataaagatcatatataaaaataaacaacaaaaagtgataattttgaaaaagagcaattaagggaaattagctctttcagatattaaaatattttataaagcctaatatttaaatttatgtgatattaggatataaatagtgagaaagaataaaggaataaaatagaaagtataaaaattaatatgaatatatatatatactttaacatatgataaagatgacatctcagttttcttgggaacttggatagccacttggaaaaacttaagttgaatctctactttatatcctaacaagatacatctaaaatggattatattttaatgttaaaaaataaataaatcttaaatgtactagaagaaaaattgaatacctcctataaaagctaaaagaaaagacagagcatttctcaacagcaaaatgtaccataagataatgtcaacagaacaagttaggaatacatttgcaatacaattcatatcaaaaagggctaatccctttaatacaaaaaatcagagaaaaagataatgtaatcaatcaaacaagatgcaaaagacaccaagaggcatacagtggaaataaaaataactattagatgtataagttctatgtcactctaaatatatgacttataagttggagctaccatgaaatatctttttatttattagatgtttaaaaccataaaattttaataacagaatctgtcaaaatgtgggaacacactcttactttgctaatggaaaggtcaatatgtacaattacaagcaagagaaattcaaactttcaaacatctaattacaaacatgtatttcctctgatgtttgacctagcaatttaatttatatatatttccatgtatgtaaaattacatctagacatatttattctttcaaccactgtttgtaatagcaaaagactgggaacaacccaaatatccattaaaaggtgaaggtttaaataaatgatgatatattcatacaacagaaggtaatacaaatctaaaaacagactaaaataaagtcttctttatgctctaaagtgaaaggatctccatgatatattatgtaaggaagcaaggagaaggatttaacagtttttaaatctctgctcttaatgctgcatataaggagcttggaagtcaccactccatccagttttctaacaagtaaaaaaacagaacagactgaaaaataacaaattttctaggattcatcagagaggtgaggatatagaacaaactgcttcccacaatattggagagataataagattaatacagggagtcatgggtttaccacagcagagacttacaagcaaaactgctgcaggaaccagtgccaggtataaaaacctgaactataattgataaattgctagagactcagagaggacaaatctgagacttgtatatcccaatggaatcctgccaagaagaggtggggtatgtgagtttaacctgcaagagtatgaccaggttctcatagtaaatactggaggaagacttcccttgtgtttcaagtacagggagaggaaatacaccagagtacactgctctttgacaaggcctgccctcaggagaagctattcaaacagagccttgtctgctgaggttttgtagcctaactgacatgtgggaagggaaatacccaaatctagccatcctatctcatggaaaaggaaggggggctgagaaattgagactattgggaggttcatagtccagagacacagtccagaggctcactgaaacactgagatctaatcataagactacagaatggtttccttccccccatcccttaacaagatattactaaaggcctattttcagcagttccatttacatggtaaatcatttctgactatgaagaaaaaattactaggaaaaaaaaaaaagaattagaagaaatagagtaagcatcaggaccaggtaaggcagggatattgaaatgatcaaacctgaaattttaaacaacaatgaaaaatacgctaagggctctaacagataaagtagacagcatgcaagaacagatgggcaaatgtaagcatagagatggaaatcctaggaaagaaacaaaaagaaatgctacagatcaaaaatactgttgagaggtgacagtgtgctggcagtcttcacagccctcgctcgctctcggggcctcctctgcctgggctcccactttggcggcacttgaggagcccttcagcccaccactgcaccatgggagcccctttctgggctggccaaggccagagctggctccctcagcttgtgggcaggtgtggagggagaggcgcgagcgggaaccggggctgcgtgggtgcttaagggccagcgtgagttccgggtgggtgtgggctcggcggacaccgtgctcggagtggcggccagccccaccagccccgggcagtgagggatttagcacctgggccagcagctgctgtgctcaatttctcgctgggccttagctgccttcccgtggggcagggctctggacctgcagccaccatgcctgagcctccccccgcaccccaccccccaccctccctgggctcctgtgctgcccgagcctcccaaggagcgcagctgcctgctccacagtgcccagtcctatcgacacccaagggttgaggagtgcgggcgcacagtgcgggactggcaggcagctccacctgcagccctggtgctggatccactgggtgaagccagctgggctcctgagtctggtggagacgtggagaacctttatgtctagctaagggattgtaaatacaccaatcggcactctgtatctagctcaaggtttgtaaacaccaatcagcaccctgtgtctagctcagggtttgtgaatgcaccaatcgacactctgtatctagctactctgttggggccttggagaacctttatgtctagctcagggattgtaaatacaccaattggcactctgtatctagcttaaggttagtaaacacaccaatcaccaccctgtgtctagctcagggtttgtgaatgcaccaatcgacactgtatctagctactctggtggggacttggagaacctttgtgtccacactccgtatctagctaatctggtggggacgtggagaacttttgtgtctagctcagggattgtaaacgcaccaatcagtgccctgtcaaaacagaccactaggctctaccaatcagcaggatgtgggtggggccagataagagaataaaagcaggctgcccaagccagcagtggcaacccgcccgggtccccttccacagtttggaagctttgttctttcgctctttgcagtaaatcttgctgctgctaactctttgggtccacactgcctttatgagccgtaacaccgcgaaggtctgcagtttcactcctgagccagtgagaccacaaaccgaccagaaggaagaaactccgaacacatccgaacgtcaggaggaacaaactccagatgcaccaccttaagagctgtaacactcaccccgagggtccgtggcttcattcttgaagtcagtgagaccaagaacccaccaattccagacacactgtgacagaagtgaagaattcctttgatgagcttattagtagactggacacagctgaggaaagaatctctgagcctgaggctataacaataaaaaccttcaaaacaacaagtaatgaagatgatacaatagctaaaaagaaattatttaggcagtgagggtaagtgtattagtcagagttctctagagggactgactaataggaaatatatatatgtatatatatatatgtatatatatgtgtatatatatgtgtgtatatatatgtgtgtgtatatatatgtgtatatatatatgtgtgtgtatatatatatgggagtttattaagtgatattaactcacaccatcaccaggtaccacaataggccatctgcaagttgaggagcaaggaagccagtctgagtcccaaagctgcagaacttggagtccgatgtttgagggcagaagcatgcagcacaggagaaagatgtaggctgggaggctaaaccagtctaggcttttcacatttttctacctgctttacattctggctgcgctggcagcagattacatggtgcccacccagattaagggtgggtctgcctttcctagcccactgactcaaatgttaatctctttggcaacaccaacaccctcacagacatacccagaatcaatactttgcatgcttcaatccaatcaagttgacactcagtattaaccatcacagtaagaaagtcctctgtaaggcttcccttttaacaaaaagcagcctcaaatcatttttgtttctagcaaaatgcagcctgaaaaatcaaactgcagatgtagaaaagcaagctagaagctttcacgggtaaatgccagcagctttgacaatagaaaaaggctacctggaggccaggcatgttcaacatgggactccatcttccctttcctttgtcaactgtgtgaactgtaaggaacagatgtaatggcacaggccaggtagagaactcatttgcatgataaaaagattagggtggggtagccagcttcttcatgtgctatgtaaatgacacacctggtccaaccaaccaatcttttgggccccatgtaaatcaggcaccgccttctcaagcttgtctattaaaacctgtgcatttcatcacaaaactggaggacccgcttgggagcccctctctctctgcaggagagagagctattctctttcttttgcctattaaacttccactgttaaactcacttcttgtcctagatttctctggcatgagacaacgaaccttaggtatttaccccagacaatgatgctgcttcaagaacaaccaaaaaatagaaaaaaaaaaaacaaaaaaaaacagaacagaatattcagggagtgtgtgacaactataaaaggtgtaacataaacagaaacagaacactagaaggagaaaaaaagtgaaataaacaggagaaatatttaaaacaataatgctttagaatttttcccaaattaatgtcagacaccaaatcacagatccagaaggctaagggaaaatgaagcaggataagtgctaaaatcaaatattaaaaaaaattctgaaagaagtaagaggaaaaaagcaccttatttttagaggaacaaagataagaattatatccaacttctcctctgaaaccaggcaagcaagaggagagtagggtaaaatttttaatgtcttgagtgggaaaaaaaaataatctcgccaacctagaattctgtactctgtgaaattacactacaaaagtgaaggagaaatacagattttctcagataaacaaaaattacagtggtttattgctactagacctgctttgcaagaaaaggatagggaaggaaaataatatagctcaaaaacttggatcatgataaagaaagaaataacactggaaaaaataactaacagtaaaataaaaacatttttcttcttcttaatctaaaagataatagtttgttcgaaataatagcaatagtgtatttgcttatgtattctaatatatatatagatttttatatgcttatgtgtaattggaatgaataatagcaatgatacaaagaatggaaaagaagtatcaagattattttgttattatagggtactcatactacctgtgaagcagaatagtgttatttgaaagtggacttggatttgatgtatattgcaaactagggcaaccactaaaaagtgtaaaaagaaagaagtataactgatgtgctcagaaagaagagaaaatggaatcgtaaaatgctcaatgaaaaccacaaaaggcaaagagcagaaaacaaacataggaacaaagaacaaacgcagcaaaaggaaacagcaacaaatatggcaaatattaattcaagtatacaaataatcactttgaatatccatagtctaacacaacttaatacatttacactgttggatagtaaaataacacatcttattagaacatgtgggatatagcaaaagcagtgctcagggagatatttacagcattgaatgcatatattagaaaaaaggaaagatctaaactcgaacatctaagttcccactttagaaaacttgaaaaagaagagcaaattaaatccaaagtaagcagaaaaatagaaataaaaaagttagaggagtcattaatgaaattcaagacataaaatcaatagaagaaaaaaatttaaccaaaagctggttcttgaaaagatcaataaaatcactaagctctagtcaagataactaaaaacaaagagagaagacatcaattactattatcaaaaaggaataggggatatcactatatattgcttgaatattaaaaggataactaaagaatactatgaacagaccaagcgcggtggctcacgcctgtaatcccagcactttgggaggccgaggagggtggctcacaaggtcaggagatcaagaccatcctggctaacaccgtgaaaccccatctctactaaaaacacacacacacacacacacacacacacacacacacaaattagctgggtgtggtggcgggcccctgtagtcccagctactcaggaggctgaggcagaagaacggcgtgaacccaggaggtggagcttgcagtgacccgagactgggccactgcactccagcctggatgacagagtgagactccatctcaaaaaaaaaaaaaaagaagagtactatgagcaactttatatgcacaaatttgctaacttagatgaaatgaaccaattccttgaaagacatagtttgccaaaactcacacaagaagaaatagataatctgaatagtcccaggtctagcaaaacattgaatcaattaataaccttccaaaacagaaagcagtaggccagatgggttcactagtgagttctaccaaacatttaaagaagaaattatacaaattatctttaatatttttcagaagatattagcagaaggaatacagcctaattcttccaataagaccatcattaccagataagattattacaagaaaagaaaactaaagaacagaccaatatctttcataaacataaatgcaaaaatcctcaaaatacattagcaaatagaatccaacaatgtataaaaaattacacaccacaatcaagtgggatttattgcatgcaggcaagactggttcaacatctgaaaataaattatgcaatccatcacattgacaggctaaaaaagaaaaattgcatgatcatatcaatagactgggggaaaagcatttgacaaaaccaatataataaaaattctcagtaaaatagaaataaagggaaactttgtcaacttgataaaaacaatctacaaaaatcctacagctaacatcatacttaatgataagaaactgtaaactttttcactaatatcaaaaacaaaccaaggatcctctctcaccacttctttgcaatattgtgctggaattcctagctaatgcaataaaacatgaaaagcagataaaaagtctacaaattggaaagtaagaaataaaattgtcttcattcacagatgacatgatcatcaatgttgaaaatgcaaaataagagtaaaaaactctcctggaactaataagtgattataccaagattgcagaatatgaagaataagcttagtaaattgttttcctatatatagcaatgaacaagtgaaattttaatttaaccatataataccaaatctacatgcagaaaactacaaaactgatgaacatcaaagaactaagtaattaaatattttatgttcatggatagaaaaactcaagattgtcaagatgttagttcttcccaatttgatgaagttccaatgcaatctcaataaaaattccaggaaattatttcatggatattgaaaaactaattctaaaatgtatatagagagggaaaagaccctaaatacccaatgtaatattgaaggagaaaaacaaaattggaggacgaagacaagacccaacttaaagacttacaataaagctgcagtattctagataacatggtattggtaaaagaatagatgaatagatcagtgaaacagagcagggagtccagacgtagacccacacaaagacatcaactgacctttgacaaatgagcaaaggcaatacaatgaaaaaaagatagtcttttcaacaaataatgctgaaacaactagacattcacatgcaaataataataaaagacagataaaataaaagatgtagaccttacactcttcacaaaaattaactcaaaatagatcatggatctaaatgtaaaatgcaaaactataaaactccttgaagaaaacataggagaaaatctaaattgccttggctttggcaatcactttttagatacaacaacaaaacatcttccatgagagaaataattgataagctagactgtatgaaaattgaaattttctgctctacaaaaggcaatgtcaagagaatgagaagataagctaatactaaaataaaatatttgcaaaagatgtatctgattaaaaaacttatctaaaatatacaaaggacacttgaaagtcatcaataagcaaataaacaacccaattaaaaatggtttaaatatcttaagaagcacctcaccaaagaagatatacagatgaaaaatgaacatataaaaagatgcttcacatcatatctttagggaaacacaaattaaaacaacaatgaaataccactacgcacttattagaatggccaaatttcaaaacagtgattatatcaatagctgatgaggatgtggagctactggaactcttattcattgctggtgggaatgcaaaataatataggcactttgaaaaacaatttggtggtttcttacaaaactaagcatattcttaccacatgatccagcaataatcatccagtaataatgctcctttatatccaatcaaaggagctgaaaacttacacccacagaagaatctgcacatagatgtttactgctgctttacttataattaccaaaacttggaagcaatcgagatgtccttcaataggtgattatatcaatgaaccgtggtacatccaaacaatggaatattatacagccctaaaaagaaacgagctgcaagctataaaaaacatggaggaatcttaaatgcatattactaagtgacagaagccaatctgaaaaggctacatatcacatgattccaactatattatattatggaaaaggcaaaactgtggagatagtaaaaagatcagtgattggaacagagaggcagaacagaggattttcagaatagtgaaaatactctgtatgatattatgatggtggatacattgcattatatatttatcccaacccaaagtatgttcaacaccaagagtgaaccttgatgtaaactaaggactttgggtgaccataatgcatcaatgtaggtttatcaattgtaacaaacgtaccatactgttgggtaatgttgataataaggaagattatgtatgtgtgtatgtatgtatgtgtgacagcagggggtatatgggaaatctctgtaccttcctcgcaattttgctacaaaactaaaagtgctctaaaaaaataacacctaagaaaagtaacttgcacattttaaaataagcaatgagtcaaagaagaaatcatgagaaaaattagacaacactttcagaagagtctaaataagacccaattcaccaaaacttatgaaatgtagctatacagtgataaagagaaattatagctgccaatgcctgtagtaaaaaagaaaaaggattctacatcaatcaattcacttcccaccctgaaacactggagaaacaagatcaaactaaacctagaactagtagaaggatagcaataataaagattagtatagatggataataataaagtaaaaaacagaaaaacaacagagaaaatcaatgatagcaaaattacattgtttgaaaagatcagtaaaatgcaaaacctcaagttagatgtgtgtttaaaaactgggaagattcaaattactgaaatcaaaaatgaaaggacctctctactgaccatacagaacaaaaaagaggaaaaaggaatcctttgagcaattgtaggttaacaaattagataacagatgaacaaattactagaatgacatgaattactggaactaccttctcaagaaatagaaaatctgagaaattagtttctcagattagacatatcataagtagagattgggttaattattttaaaacttctcacaaaggaaaaccccggcccaaattgttttagtgaattataccaaatatttaaaaattaatataaattattcacaaatttctccaaaatatagaagaagagagaccacttcctacctcattccattaggccaaagttgccatgatacaaaataatacaaagatatcacaagaaaaaaagctacagactaatattttttataagtatagatgtaaaaatcttctacaaaatactaggaaactaaatctaacaacatatgcaaaggattaattatacactatggtcaggtggattttatctcaggaaaacacgttcattcaacatctgaaaacaatgtaatacaccatgtcaatagaataaaggacaaaaaccatatgatcatctcaatagatacagaaaaaagcacttgacaaaatccaacaaagtttcgtgataagatcactgaaaaaactagaaatataaaagaacttcctcacctggtaagggaatctattaaaaacccacagctcacatcacacttaattgtgaaataatcaaagctttccccctaaaatcaagaataagacaggatgtctgttcacatcacttctattcaacatagtactggaggttccagacagagcaatgagataagaaaataaaaagcatgtggctgggcagggtggctcatggctgtaatcccagcaatctgggagaccaaagtgcgtggctcacttgagaccaggagttcgagaccagtctgggcaacatgaagaaatctcatctctacaaaaaatacaaaaattagctgggcatggtgacacatgtctgtagtcctagcttctcaggaggctgaggtgggaggattacttgagccctgaagatagaggctgtggtgagccatgatcacaccactgaatttcagcctgggcaacagagtgagaccctgtgtcaaaataaacaaataaataaataaactaacaaatagcaggcatcattattgaaagaaacataaaatatctgtttgcagatgacatgattttgtgtatagaaaattcttaaaaatatacttttaaaaactattagaactaataaaaattcaacaaatttgcatgatacaagatgaacacaaaaattatattttaatatactagcatagagcatgcagaagtgaaattaagaaacaattccatttaccacagcatcaaaaagaaaaaaatgcataagaacaaatttaataagtgcaaaagtgatatactgaaaactaggaaacatttctgaagtaagaatctaaacaaatggaacgatatctcatgttcatagatcagacatcctattgtttaaatggcaatactccccaaattaatctgcagattcaactcaatccctctctatcaaaaaaagcaaggagtagaacaatgtatattgttctgtattacttatatttccataaagaatgtctagaaacattcacaagaaactaatgaaagcatttatgtatcataatagttgggttgaaactggataaatgtggggcaggttgactatatatattgtttttctttttacaccctgcattattttttaaaagtatgggagaggagcaggattggaaattatcttgccccactctagcagtctgtaagatagacaagcctggattcatagaatcagactagaatgactgacaaataagcagtgtgtggaggtaatcctcataggatgtgtggccgcccattactttgaacttccagagaatattactaacatccattgaaacaggaacaagtaaaggggagaaaggctagcttacttaatccaatgggattttaacttctttatcactatccccacagcagctgtagcgagggccctcacacatctctccagtcttccttttcctcacactgtcacctcttatccaaagtcagaggaaacctagagaaggtagtagattttatctatgaatgatcctgctgtgcaaaggagaaaagatagggaaagactgggaaaaagagcagaggagtcagaaggagttcctgctgactctttacctaacttgggtaccacagggcaggagataaactttggagaagagtgcaattaagcaaacgccacttcagctttgatctacatttaatttgttcacatttgagggttcagatccaaaatgaaaaagggttttatggctgaatattatttcattatatatgtaaaccacatttcctttgtctttttatccactgatagacacttagtttgattccataccttggctgttgtgaatagtgctgtaataaaagtgggaatactggtacctcttcagcatactgatttcctttttatgagtatgtatacccagcagtgggattgctggatcatatggcagttccattttcagtttattgaggaacttctacactgttttctatagttactgtactactttagattcctcccaacagtgtactggcattcccctatctccacatcctcactagtatttgttactttttgtctttttgataacagccattctaactggggtaggtaatatctcctagtgattttcatttgtatttccctcacaatcagtgatattgaatagtttttcatatacttcttggccatttgtatatcttcttttgagaaatgtccattcagatcttttgcccatttttaattgcattgattttttgtttttttttgctattgatttgttagttccttacacatgctggttattaatctcttgtcagaccaatagattgtaagtattttctcacattctgtaggttgtcttttcactttattgattgttttctttgctgtgcaaaagctttttagcttattgtaattccatttgtctattgttgtgttgtctgtgcttttgagatcttaccccccaaaatctttgctcagaccaaagtcctgtagcattttcctagtgttttagtagtttcatagtttcaagtcttgtaatgaagtctttaacccattgttagttgatttttgcatgtggtggaagataaagatctagtttcatttttctgcatatgaatatccagtttatccagcaccatttattaaagagactgtcctttcccccatgcatgttcttgatatctttgtcaaaaaccaactgagtgtaagtgtatggatttacttctggattctctattctgttgcattcgtctaggtgtctgttttatgccaatatcatgctgtttgggttattatagctgtgtagtataatttgaaatcagagcttgtgatgcttctagctttcttctttttgctcaggatgattttagctattcagggacatttgtggttctatacatattttatattttttttatttctgtgaagaatgtcattggaatcaagcttgagcttgtatacagattttaacaatattaagtctctcaactcatgagcataaatttccaccttatcatttgcagcaggatgtgtagaactggaggtcattatgttaagtgaaataagccaggctcacaacaacagatatcacatgttctcattcttatgtgggagctataaaagggggtcttatggaggtagagggtagactgggaagggaagagggatggggagatgaagagaagttggttacggagtacaaagacatggttggatagaaggaatacgttctagtgtaaaagagtacagtaggcaaattatagttagcaataatttattgcatttttaaaaatagctagaagaaaagaactttaatattcccaaaacaaataaaatataaatgtttgaggtgagggatatcccaattaccctgatttggttattattcattgtatacagttttcaaaatatcacatgtacccccaaaatatgtaaaactgttatatacaaataaataacaaaactaaaaataacagctgtgcaaacatttttaaaaggcttgctttaaatgggtttcacatgaaagtaggaaaggactctctggagtctttaccatctttatgtgagaaacacattggtcccagtggtctctttacctttcttagtccatcctttcactctgtacatctttctgaactcaatgaattatacactattgctgcttaattgctttcagaaatggacccctgcacaggtgggaatggatgtgttcacatatgtcagagtgagaatggcacggccaggtgtgcctgtcatgcagggtaccagctgcctgaagataaaaacatttgtgaaggtaggagactgaaactgaaggattaattgtgtaattgtttgaaattttgtggtaattcagttttgaatagtcagaacagctaggagaaaaggtgttttcgtttattcttaaaaaggaacatttaaattcttatttgatcatttgaaagctatttttataccataaaacttcagtgaaattcttagtaacattttaaaaaatgacataggatagttccagacttaatacgttttgtttctcattctgaagtgaattccagaattaatatttcaaaatcttctatagccacacaggaagttttttattataggctacagaaggtggggataacctttgaaaagcaagtatatgtaaatgagtgttttcagaagtcaggaataattaaaacaaaaaagaaagaactctataaatacaaaatcacacatttatctttcctagaactagcaaaacagacatactttaattcaaagatgaaagtgacaaattcttccctcacaagaactgatacattaagtaatttctctggggcagtcttgtcaaaagtctcattttaataacttttgagaaatcactttttttatcatgatattttcatgaaatgagaaaccatttttatcatgatattttcatgaaatgagaaactatttatttggagtaactacaaaagtaattatgacttatgggactgataaaaattacgaaaaataattagtaatggaaatttgtgttttcatttttttctttaggttgaaattaagatgatattttctgtggattttttaaacacacttttctaacagagaacatttctgctttggtcctctgtttccacagcacctatctagctcagcacctggcacagaataggatcatcttaaataaatatttgaggaaaactgacaaatgtttgcagacatagatatagttatgtatatttatctgtctactgactttcacactcctattttaacatctgatacattatttatagaaaatctatcctcagaattactgcctgcctattctattacaaatacattagaagaatgagtatttctcttaagcaccctggtggggatgatatgtagtatggaggaagaaccagtttaaaaaaatgtgagacctatccccttaaagggaggaaggagagatcgcctgagccacacaactgaagttacacacactgaatagaattgactactgatatcaggagagagagggtatcagtgtctaagtggcattcccttgtgacaatcacatgtataacagaaaccatggattgctaaatatgaaggccccttatctgccttgcccgtggccacacatactaatgtaaatcaaagagatagtcctaaagacaaattacaatgacttcttccctgcattataaggaatagattaggcccatttttgtttcattttctctttttttcttattaatagatactattaggttctaatagaagtgtttgagagcataagaccaacactagtggtaatgtcataagcagtcagcttattcacaaatactcctttatataaagaatatggaacctatgtggtacttactgttacagtggatgttgggggtgggggtcaagtgggagcaggtgcattggtccattattgtagtttgtcaaaaagtcatcattatagctcctaagacatagctgttgtgtctgtcttcctgcagatataaatgagtgtgctgaaggtctttcttactgtggccactgctgtgtaaactctatgggatctttcacttgtgcctgccaaactggctttgagctgggagctgatagaaaacaatgttacagtaattggcaacagtcacagcccaggtaatgtgtggcattttacaggtattaaacatgagtaatacataagagaattacattgtgtgtcttgctaaagcaggagctcctgagaaggatgtggatggaggcttaaaaatccaacccctttattttataggtgagaaaacagaggcccagagtcaatggagaatggtttgcaaaataatctgtagtgtcattagcaaggattaagcctcaggttttctgacttggggctttgttgggttcatagatctttgtgaaaattctgccttcctttatcagttctgccatgcaatatttattgaacactaataactccattgtaaaactcaagagaaaggaaagagcaggagtgaaggaaccaccgtacaagaagcagctctaagctgcaataccatgcctcatgcattggatgttctaatgagaatcttccacattggccctccccctccctccctcatttcctttcattatgcctattgagcagctgcttcctgctttgtcttttcttccactgattcatttccctatcccttctcttcaaaacattcatgatccatatcatataaccttagcatcttcctccctaggctcagttatacaactaaatatatccctttttaggaacatattaaaatgttaatatgctgagcgattagctatagttgctattacaactatgttctcctcacacgtcatccccactggtccactacttaatctgtagatgagcacactttctactttactaagctttaatctatctgatacaaatttcctcaagttcaatgttttctacctcaacatttgccatcctcatccatctctacttctgtccttttctaaatggcagatttttttttcttatttttatggctgatttctccatctctgtctcagtacatcaagagacagaggtcttggtacatcaacaattcatttttcttcttcatcttcttcttcatcttcagactctatctttctctcagtgacttcttccttctttttccagttcacgactatactttaccaggtaaattttactatgttgaaaacataaccatgctaactggttttgctttaaattcaggatcataaatcttaaatgattaagcagcattggtggacaaacatactgtcagaatatgtctacttttaccctcatcaaaataagtgtttaacatctcttccaaaactttatatcaccctccttttgacctttgtcctcatctcatctcttaggtcatcaaataataaatgcaaactgtcatccaaggtaacaattaaaccaaagtctcccatagattcacatggaaaggcttcagtcctattaatatgaagcaggtagccctattactatcaaaggtcatcttctccatggagctttgggttccattctctcttcacatctgaagatctttgcttttgcaattatttccctcttttctgaattatcagttctttcttctgcatcattttcatcagcataacaacatggccaagtatcttctgtctttaaagtactttcacatgagtccatatttcataaaagctaatgtctgactctatagccaatgtctcctctttctcatcttgcattctctcatcagcccatactaatcaagttttcatctctactctgccacttgtcacccatgacctctatgctaccagattggatggtagcttcttcaattttatcctaattgacctctcagtagttttcaacacttctgactaccctcaagtcaggcaaagttcctgcctttatggaacttaaattcctacagaggagatagaaaacaggaaattaatcaaagaaatgtatactattatcttatatagtgttaatatgcaatgagaagatccaagaaaaaggagcagtaataactaagaccctaaggtagggctgagcttgatgtttcaggaaacagaaaaccagtgtgggctggaaaagaatgaacaaggtgtagagacagtcaatgagagcagtaggcagggaaagggaacaatcagattatactagacttggccatcgcaagcggtttgaattttattccaaatgtgacaagaaggcattgggtagttttgaacaaacaaaagagttcaagaagagcaaaagagttcttctcaaaacactcttcacttctgtgttactacatttttctagtatttctttccatctctggcccttctctcaatgtaaaatttatccaactgctctccttttaactacatatgaatataccaaactattccgcatcactacctgcatgactggtaggcatttcccacttggtagaaccaaaacagaaatgctgattttgagtccgagtcccaaagagccttttctcagttcttcacatattaatcaatcatccatttagtgacaaagtcaagaactcagtgacagaaaattaataagtgactgaactaggatttgacctagagtcttcctgcctcagatataatatcctttcagcttcatcatgtgtttatatacgttatgtctctttattagttttaatgaaggaacaaataaagatggtgatatataaaataaatatttaagctttcttacctgagctctttcatgaagagatattattagagtaactaaattcctcattcttccttccgacataaaattctatgtgtctttaattctacgctccttaaggtctgttggtatatttttattgcttaaagactacatttttgctacagtgatatttgccttttaaagagcaaactaaataagatgggagagaaatttgactactaattaagatacaacttcctctgaagtcaggcttttttttttaatgccctaaggagtcctttcaggccgagaaaagtgtggaaggatttttctttgccttaagtattttggctttaatgtgaccagaggtttaggggatgagtatattttacaagtgtatgaaattaaacctcttgtaatctgactggtgcttcctcagttatcaggaaagagggggtcattattgataagttaggaggtacatacaagttttctgtagaatttacttgggaaagaaatttgctctcaagttgaatacatttggtagaagtttatttttacatttattttccttctgtgaatatttggctaagctctttctgcagtcctcaccagacctatatttactaactgaaatacaaacctttcctagtgaaaactggtcttttgacttgtttcaaaacctatagatggaataagtccttttagaccatgatgtcatatatatatatatatatatatatatatatatatatatatatatatatttttttttttttttttttttgagacggagtctcccactgttgcccaggctggagtgtggtggtacaatctctgctcactgcaagctccgcctcccgggttcacgccattctcctgcctcagcctccagagtagctgggactacaggcacccaccaccacgcccggctaattatttgtatttttagaagagacggggttttactgtgttagccaggatggtctcgatctcctgaccttgtgatccacccgccttggcctcccaaagtgctgggattacagacgtgagccactgcgcccagccgagtatgatgatatttaacaatgaattatgtgcccatcatctaaagtacgttttgaaatgatgcttttttcttttttagagaacagtgttttatatttatgtagttttttctcaacaggtctcaaaacactttgcagtataaccattgaatcttcatagtgtactatgaattagctatcattgtcttataattagaaattggaaaatttgacatacagaacacttccttcaaattaccaagcaatatgtaatatagtttaactatttcacacatatttaatgtacatcttatctagcaagcaaacaatatatttgctacttataaaaatgttttaagtatgatttctaaagtactataataaaaacattttttatcatctgaatcaaagaatcaaaatctcagcttgcatctggtaggtagttatggatctgagtttgcactttttttagttccatatatctttaaagaagtgaccatggtatcatttatattcaaatccaattaccaccagcagtctaaagctgtattgatgcaatatcactggaaaagagcatgaataagagaagcctatgtaaaaattgtcaaatggatactttcacctctcttcccccctgaaaaaatcaattaatattagaaatttattatagttttcagtattttaaatataacctaatccagggatcaaaactctaacaccaacacaagacaggcaataaatataaatgtgtaagacaggctaagcataaaagataggaaattgtaaggactgttttgaactggagagggagttttgggcctagagaggacagctattgcttgattgcttgcctccagctaactgtcacctagagggagtgtgatgccagtgtactagacccactgatttattcaacaagtgcttactgaatacctaccatgtgctaggtgctgttcctaacactatagatacaatgataaacaagtcaggaaaagttcctgcctttatggaacttaaattcctatagaggagatagaaaacaggaaattaatcaaagaaatgtatactatcaccttatatagtgttaatatacaatgagaagatccaagaaaaaggagcagtaataactaagaccctaaggtagggctgagcttgatgttttaggaaacagaaaaccagtgtaggctggaaaagagtgaacaaggtgtagagacagtcaatgagagcagtaggcagggaaagggaagaatcagacttggccgtcgcaaggggtttggattttattccaaatgtgacgagaaggcattgggtagttttgaacaaacagtaatatcatatgattttcactgtttaaggactactgtggctactccctagggaatggacagtagggagtgtctgtaaaagcaagattagagtcattcaggtgagctgtggtggtggctttaattaagctagtagcagtagatttgagatttattttgtagacacagctgagatgaattcctaatgtggatgtgaggaaaagaaaaatcaagaataattcttggtttggggctttaggaaacaggtgaatccgaatgtcttttaccaaaatgtggagtccaatagaagaacaggtttggaggtgagatatagggtatgtttaaatcataacttctatttctgctgtgtgaagtttaaggagccaagtagaaataacatgtaggtagtttctatctatttcctaactaaatagaaaattctagaagtttatggtggtcagagcttgagtgagcagcttgtcaagatgtaaatgtcagtatttaagccatgagcaagaatggggtcacttacaaagggagggtgtctggaggagtaagcaggaggaaactgagactgtagactccaacattaagtaactaaaatgtgacacagagacaggaaagactgaagaagaatgtccagtaaggtttaaggacaacttggataatgtgattttctgaagaataaaataaaaaaaagttgggagaagtaaatggtcaatggtatcaagtgctgctaaggattaggcaatgtggcagtaaatggagaacaatgtggaatctagggagggttatcttgcctcttaatttattttttacttagacagtaaaattaacatgttcagtatataatcatatcaattttaattgtaaatatatagatttctgtaaccaccattggaatcatgattaagaatagttttgtcaaccccagaaaactccctggtgctacccttggcttgtcacttattccccgtctctaacctttgacatctacttgatgtgttctccctcactggaattttcttttcttgggaatgtcatataaatggaattaaactgtgtgtatccttttattcaacataatgccattaagattcagccaagttgttgctcatatgaagagttctattctttgatgagtatggatatactatagttggtttattattcaccctttgaaggacatttaagttgtttccaggttttggcaattatgaagagagctgctataaacatttgtatacaggtttttatatgaacatagttttaaaaaagatttttctcttcagtaaaaacctagggctggaatcacaaggtcatatgataggtgtatatttaagtttataagaaactcccaagctatcttttggaatggatgcaacatgggttattggctttaaaaaaaaaataggagacctttaatttgtgatgaaatggtggaaatcctaatattttcttaacttttgtaacaccttgataatcaaatcccatataactgcaggccactagtttccaaaccttagtgcaactcaatccctctgttaacagtgggaaaaatactgaggatcagagatttaaaataattgaagattacacagctgtaaagtgtcagatcttccaactttaaatgttgtgcctttttctattatgtcacactaacttttcttaggaaaaatattacaccacatttcagtgaaatagattacatgcttgtcaaattattttctctttttctttccttttttttttttttttttttttttgataggggcttgttctgtcacccaggctagagtgcaatggcaagatcacagcttactgtagccttgatctccccagctccagcaaccctcccacctctcagcttgctgagtagctgggactacaagaacgtgccaccacgcccaactaattttttatatttttttctagagacagggtttcactatattacccaagcttgtctcaaactcctgggctctagtgatctgcacaccttggcctcccaaagtgctgggattagaggtgtgagccaccaggcctagctattttctctttacaaatgatattatataggaaaacatctctgaattagaaagctttgattcttaccagccctgctaccttaggcaagtcttttatcttttctgaacctcagttttctgatcctaagcaaaaatcatgttacttttatgacttataatatttagattaataagcacatatgataccttgcataatatagactggcttttacaaccaacagtgccgtaaatgttattgaagtgatttcatgtcaattgaccttacttttctctctaagcaatgatggagattaatttgatagactctaagataccacatatggttcataaataggtaaaaatgtctctttataagaatggcaatagcaagcatatgtcagaaaaaaacttcaattctgtatcagaaagatctgtgtgtccctgtcaccacaaccagagacatcatttgaaataggtttctctgaagagtatatgttaatgtatcaagaaaaatatcagttcccttcactaatctttcctttagctttctaattttgcttagtcctaaactagctgtttctaaacccaaaggggttcttatttttaacaataaattgattagcataatccttcttttgtttattcaatcattggaaacctattttgaacatctgttatgagctggggagtgcaagatgatgatggcgcagtgggctgggcacaatgacagggatgtgccctgggtgcttgggagcatctgaggctgctctgtgccctggactggctgctggggagtaggccggatgatttctggaactgtagtggatgtctaggcagtttatatggtgacatatgctttcaaggagtgttacaatcccaaagactcttgtcttgtttttttttttttttttcctccagctttttttcttctaaatgattcataagttaagacttagaggaaatgaatcaatgtagacactctcagtaagagggggtgtgttcaaacaacataaataaagacccatagaccttctgtggtaaaaatggcattcagagtatctaaagtccatattttaacatggattctaaacatttttataattcttattttgtcacttagaaaatgagagactataatgcctgtgtgctcaggacaattggcattcatctgctgaggctcaggcccaccaatatgcctgaaattagtagcatgtaccagccaaattgattttcacagtaataatttgtttatgtaataagtgattctcgtataaatcaaagctcattagtgcatcaacatgaccctagttacatatgatcaactaaatcattgggtttatgtttacacctttgctccaaggttattttttaacagtattttcatgtgcttatagaccgtaaaaaggacgcataataacatactattagctcaagaacaggaatgtcagctagcaaacaacctatttgatttctgattattgatttaatatatatgtatatatattacatctattatatcctgaaaatactgagaattcccaaaacatgtttcctttaaggtaagtgtttaataaccagtggtgtattcatcattacctttctgtatcactcaacattatttatatgtttattagtatataatgtggtatataggcatttacaatgcttaataaccctcagacttttacttttatgtgtatagagtgttgatggatttctaataaagtttgtcatcctctcaacagagagaatgtgtccgttactgacatatattcaggtttgtctgttatgctaataatcctcttttgctcattttggaaagggattgaattggaaattgtcaatagctgtgaaaagaacaatagtgtttgttcccatcaccgtgaacatgaaattggtgctccccgttgttcctgtaaccatggacaccagcttgattctgatgagaaaacatgcataggtaatgtttggtaaatgccatttcattcaaaagttgctctggattcatttagccctttaatctgtagtacttacggctgtactgtgagccacatctctcaaactgtaaagacaaataaattgaagagtgtctctggctactgaataaatgtaaaagaagggttacctgtcagaagacaacattacatttagatatttaccttgaagttaaaggagatttaaaacactttaatgaaatatatgcccttaatagatttatttcaggaaaatattccatgatctatccaactatgtgatgtaatgtgtaattccaacaacaaatgctgtcacatacctcagttctctacctcaagcagaaacgaaattatttgcactggttttcaacttgataatgtttgggatgtatgttcaactttgatatgacaagtagctatattctaaaagacaacttaaaaaaattcattctttggaattcccagctcaaatccatttttaattgctaattttctcaacatattattggagtttatatcatttgagacaatgaagaaactaaaattccaccctagttttgcttcataatgaaacattcctgagaaaaaggagtatctactataaataggaatagcaagtatcaaactacattactatgtgccctggttctgagaacacttccaagtccctaaggcagtgatttgtcatcattcaagaattatgacaccttatttgcttgttttcttttgttatgcttaatatttcctccgttaaaaattacaatacaaaatcttttgaccatttcatactactcaatatggttagatagagacaatttgaagtatgaaaaactcaatggtttaaatatttaggacattttactttggcagtatgatgacacagaatgaaactcaagaaattttgcagtattctggttttataaattcaaaacaatgccattgtatttatttatgcaacattgctttcaatattgttctcagaatctacagtgggtaacatattgaagccagttgctttcctcacctcttattatttaatgaaaaatatgcttacttttatttcctaccttgataagatttgtaaccatagaaaaaattaagggctttcttccttgattgcttcttttttccctccctcttttccttccttctatctctctgtttgttcctcttttgagtattgataagagaaactggaattttgccaaactgtttctttgcgacttaaatttggtgttttctttattttttgaaaaataccattcagtaaagttcttatttacagctagaaaaaaatagcatctgccagggtcaaaatgtagaaaagtgcatatttatgaaatttcagccgtcagtatgacaatgttatattgtttatggttcaagttaatttcatttttccgacaagaaaaagaaaatgcaagccaagcactgagtctcatgcctgtaatcctggcacttttgggggctgaagtgggaggattgcttgagtccaggagtttgggaccagcctgagcaacttcaagagactccatctctataaaatatttaaaaaataaccaggcatggtggtgcactcccagctacttgggagactgaagtgagaggatcgctctagcccaggatattgaggctgcagtgagctatgattgtaccactgcactccagcctggatgacagggcaagaccctgtctcaaaaataagtaaataaataattcaatttcatttcatctaaaacattattttttaggctttttaaaagtttttcagatttttaaaaagtcttctcagataccaccaaagacttcgagcatatcggtctcaagatgccctgttctcaaatagcaaggagcaacattgcattacacaattggaaaacaagtccctcagtctatcatttagtgatccattttggattctttttctattaacattcctctggggctatttctagtttgtcccatgtataccatcctcatttggaactcatctgaaaccccgttcttcctacatcacaagcctttcttaaaatgtcttgccacttcaactgttaaatcacctgttttctaaatttcttttcaaattttattttgttagatctttgcttgctactgtaaataggaatagcaagtattaaactacgttactatgtgtcctgattctgaaaatacttccaagttcctaaagcagtgatttgtcatcattcaggaattatgataccttatttgcttgtttttgttatgcttaatatttcctcaatattctttaatatttccttttcttttgttatgcttaattttcccttttaattgtcctcatctctgatgatcatatttttcctaaattggccaatatgccaaatattttaccattgtacccaaattaatccatacataaaaatttagccttaatcaaaagtagaggaccaattgcagccaggcaaaacactgaaacatttcagctctgatttcagaaaagcatcaaaagtgaaaaacttgatcttctgtatctcttccccatacatagtcactgaataaggttaaataataaatattttctaataactggccaattgttaaatttagtgacttcattgctagtcagacacttgcattttatatacctgtctttcaaattgtgttaacacatctctaggttttagccctaataagtttttgcctttggataggtttaattaactatgtgctaactggctgacttatttttacattttttgtacattcgcatatatattttttcaaagttgatactaatatatgataaaaagaaaatcctttgatttccttcatgcatgactgttttttatgaagcagctgtgacattaatctgttctcagacaaataagtaaaatatgtatatgtacattccaagtgaataattgcctttacactagtgaataattggtctttagaaatgagtagttttttttgttttttgagacagggtctcgccctgtcacccaggctggagtgcaggtggtacaatcacggctcactgcaacctcgaacttctcagctcaagcaatcctcccacctcagtctcccaaagtgctgggattataggcgtgagctattatgcccagccttgaaaatgaatttttttaaaagttttttattctctacatcatactatttaatcagtaggattaataaaaggaaggtttaatactagaaaggaaaaaatatcatttagaattttgtgagtagttctgcttttgacattttgtgggaaaaagaatgttttatgtctaaatgaccttcatttagatattttatggtgacccttcaccttgattgattgtattttctttcctttctttcttttgtcttcattttcttgagttgataccctttccagggttaattgagacattgaccctttttatctgtggctgcttacgtagttatggcatagtaggattttgtaaactcagcactgacaggccatccaccttaacagctcaacaacagaggggcttgaattgaaccaaggcctagagccaaaaaaaaccctgaccaaataattcccaggtgttcggcctaaggaaagcagggcaaagtgtccgttgctacttccttggccaattatgttagaaatgatcgcctcaaaactcaggtgaaataggttatcctttggctgaaaacttacaatttgacatcttctggtgcgtttctattttccccagggcagttatatcttaataagaagcactcaggattgtagaattctgaaataacagtgctaaagaaggcttacagatccttacttagaaaactgctcacctaacaggacatttcagggtaatgatgtcacagatggaataaaaaaccccagacctcactcatcccagtcacagtataatctaaatattcaaacaaatgctctgaaatggtctataatttaaaacataatacttaaaataagtcttctgccctctctcagaactgtagttgccacttgtcttcccagtcaggcagttgggaacacttgcttgcgaacactctttgatctgaagttctggaagaacaaacatgttatggagtctaagactgtctcctctttgcagctgtcaaatgttcaccaaatggaattttttggctcttttttcttaggctgtttttttgttcttcaacttctctgtttattcagtccaattactgtttaaactagaaaaatagcagagatcacttttcctatgcctataaatgcatttggagattatttacattcttttaaaataaataacaggcatagaagaagcatgaagaaacataaaccaaaagtaggtctccttatttttgtgttaaggtttcttcgctgtttgtattacatggcctgagaaatagaaaatgattagtaaaacagttttaatttagaagtgtagcttatcagtgcttctatagggtcgttaaattcctatctctgcaataacagcagtgttctttcccccttcagatcttgacgaatgtgagaatggagaagcctgctgtgcccagctctgcatcaactatttaggaggctacaaatgcagatgtcaggaaggctttcagatcacttccaatggttgtgaatgtgatggtaaattcctgagatttaacaagtaataattgatgtgacagggcaataaaggaagagaaatgtctgaggcagagggctagggtgggcaagggaaggctttcacactaaagagacttgactttctatgtggttctaccatttactatcgtataataaacttggacgactttaactgcaatgaaccttagctgctcatcagtaaagtgatgacaataataggattagtggggaaattaaggaaagtaataaatgtaaagtgcctagtgcaatggctgacatagaaaaataactaaaagtagctattattgttatcatatttattggtccataatcactttcacacaatttaatgtatattaaaggcaaatgagagattctgaaaggcacactgtcaaaggaaccacccatggcaaacttgactggaatgagaaagctggttactggaagacattttgaatgagttttttttgtttgtttgtttgtttttttttttagttagagagcaaaaggaccatcagttcacaagccacagtctaaatctgtaccagaatcccatacatatctgatattaatatagctaatgcaagttttaaaatgagtcatttacaatttcttaacttacatgttaaaattagttcacttacctttcaggtgattttttgcttgtatatatttttttttgatataagagtttgaatttagtgagtagagcttgttgactttgtttatacagttaggaatagctcatataaccattgctgtaatttaaaagtttaccttaaatatttaatctttaaattttcatttagtattattattaccattattttgaaccaaatttttcttaacatcaaagattagaagattgatatctattctaataacaatcaacttatataagactgtaatgcctcagagaaattagtttttctttgcttaaagaaacacatttcagaattctgtcaaagatgatagatagccaagctcccccaaccttgcaatgaagataacagcaatgaacacacaactatgatatctatatatactaaacacggtagcgtatattgccatttaccacattacatccaattaacagagccaaaaacatttttaaaatttcatgtaccatctgctcttaagcagaatgagccaagagatgattgtatggcatgaacatacatacttgcatacacgcatgcaaatggaaaaggcatcaacaatctgaggtaaagcttagaagctcatacatgaacttatagtattgtgaacatattgaccaaagtctggactcagacttggtcataaactagtaagttgcatgcaatcaaggcctaaaattctttcttctctaaaattgtccacaaagcttgtactgacttgtacctagaataagttttctatcatatatattgaataattcgagagtgaatgaacattctacaaaagggtacacagcctgagaccactgaattaattaattatttaattatttatttatttatttttgagaaggagtctcgctctgtcgccctggctggagtgcagtggcgggatctcggctcactgcaagctccgcctcctgggttcacgccattctcctgcctcagcctcccaagtagctgggactacaggcacctgctaccacgcccggctaattttttgtattttttagtagagacggggtttcaccgtgttagccaggatggtctcgatctcctgacctcgtgatctgcccgcctcggcctcccaaagtgctgggattacaggcgtgagccaccacacccggcctgaatttattttaagtttttcatctaaacctcacaaacaaggtctcagaaataccttgtctgtgtagatgaagtagagtaaacttgaaaatgagtgaaataaaaataattggccaagtgtacttgagaaagaatgtgggggctatgcttgctttctatgtggcagtacattgttattgtttaataaaggtcacaagaggaacaccaatatgtctattatttcataagatctatcttatctctcaatgcctaaaagcagatattgtttaaattttcttagatgtggatgagtgtctggatgtcagtatagtctgtgaccaactacattaattctgtgggaacatacgaatgtagttgtgaagaaggctacagaattggaaatgacagaaaaacttacccctgtaagtcactgaagaattttattgtattaatatattttctaaactacttccagcctcatcttgttcttcaggagcaatggaggccacatatttcttaactcaacctgccttcccctttctgtcttcacagactaagatctttccttattttcttttgttctctctgctacagttttaactttgtgctggcagcttctcaccttcatttacaatagacttttgaaatggccatctcaaagcattttacctttctgttaccccctgccttggctgtctagttcaaactctctcatttctctatcaacctttgcacagtacttccttcttttaaccaagttgaaacctcgcattttcttctatggccttagctttagatgatgatgagctagaggaagaagaagaggaatgagaagttgtgaggtttccaggtcttctattcaagagcccacctcaacagcttcattatgttgctacttttctgcctcccacctacaaagatgaagaagatgaggaggaagaggaaaaagatattcatagagaactgactgctttgcacaattttggtgtgtaaaagaatttaccttactatacttacttctatttttagataatttactacatttttgtagacaattttactatcaatatttaatgccatcatatgttttaacatgaagtttgcaagaaaagtagggccaaagtcacttcttcagagcttcctatgaaatccatcatcttttgtcttttttatttccttttgtacaataaaggagtgctgtgtaggtacttgtagaagtgggagtgcagtgtggaggggtgttcttgaagttaatacagggaaatggagcagaaaaatatctttaaattagcataatggggagaaagattgaaatcttataattctattaaaatttcactagaaatcaccttagatagttaaaatttaccttaaatagccctaaaatgtagttcctttctaggttttaaaatgcagagaactaattggttaatatgcttaaatggaccagaaaatcttcaaaatgtgagcagtttttcttatatatctaaacaacagaactcaagcgtcgacttctgatcaaagtaaatctctatcaaaagtaactgtttgcagccagtccactgcttcttttttttcctttgtaaaacagagctgttctttttattctccctctatttattgtattttaacaatatcaaagcttgatgattgctttagaatgtattcagaaaaatagaaatatttttacgcagtggtcaaatcataatatcatcaataagtgtctctatataaaaatagaagtactttaatgtttcttaattaaactcctgatgctttggctaatcaaagtcagaagagaaatagttgggggcggcaacaacaacagtcagaacttgagttgccaagatctgcaaagaagagaagaccagacaaggaggatggtctcagatgcttttctcctcaagccatttgccaattaatgggttgtgccaggaatctgaaagatagctgctaggagcttgaagagtgaagcacatttatcagcagtttcatgatgttggggaggcagaacatggagctcaggcctgccaaaggagagaagccttggtaaatatgccaagttttcaattagggcatcttaaagtccctaccctagaaacagggacaaaagttaaaatggaatgagccttaaacaactgaatacacatctctccacctttattctatatgataatttccctcaaaaacagaatggataaataaatacattgtggtacattaatacaatggaatactgtataaccataaaaaataaactctcgcatacacaatgtgtatgatctcacatacattatattgaatgaaagaagcttgacaccaaagagtacatacttttcaattctacctataaaaagttcaaaaaagggaaaataatctgtggtgatagagatcaccacgatgcttaatttatgaaattaatgattgaaaattattaagtcacttttgagattttggattgctagtaatattatgtaccttgatctgggtggcatttacatgagttatttacaatgtgaaaagaagtttgaagtatacagtttagatttgtgtacacttctctgtgtattaaattttaataaaaagatttactcagaaaacaaaaatacacataaaaaattctgaaagaaaaagcatcaaaatttcaggaacattgaattttttttggtctcaaatcaatgataatttcttttttaaaaaagaaattcctaaagattctaagtattcttagggacaatattctaatgtaataattggaaaaagtaaaataagctttattttaaaagctatatcttgctgttgtcctttttaaagattctttaggaactatgctcaaagatctttttttttttttttttttaggaaattaagggttttattttgatttttggttacgtagtcaattatggacgaactaagatggtatcacattacagtctgtttagatcacatctttggacacaattgcagcttgagctgcaaggactgcatgaatggaggaaagtgccaggaaggaaagagtgaatgctcctgcccagcaggttgccgtgtcattctttgtaatgaaagtaagtgacaccctgagaattgggtaagtgctccaaactactcctttacatatgttctccccaaaatgttttaataaagtaagcaattgataagtatgagaagacaatttatttgttgggcataaataatgcttatgaagtgctttaagttttaaactgaatatgtgatttaaaaaggagattttatgttccctaggaaactcaacatgctgtctcttgtttatccatggaatgtaaaagttaataaaggatcctaatattctaggcctataaaaatccctccatttaaataaatcattaggccctgacaagctattcccaatgaagaaaaaaggaaaggatttgtgctacaaagtgcaatttaaatggacttgcttgactgtttgctacttggttttgtgtacttttttgttctttttctttttaaaaacatgtaaacacagccaatgacactggtttaatttttttattcaagtctctcatgagtaagttcaaagatttaaaaatgatactgcccaaaattcctttcctctatattttaaatgaaggtatgctttcaggagttcaaacttccaagtgataaaatgtattgactatctttgtttcttctttctctttttaaattcattttatgagttctatttatataagtgttttgtcttagtttttgtgattggcttggaagatgatatgaacagattttcttttgaactctctacatatgggaggaacacagctgttgttactcttatatgatatagatgcaaaacttcagtcataacatagtgaaatggtttaaccaagattactagttagggttttgaggatcttcctcatgcatccctctgatcatgtttctctgctgctgaaaagctttgtgcctttcccttcacataaagtgtatacatcttacccagtcactagtggccatcagactctcataaatccttttggctttttgtcctagtcttaacgcttcacctaacctattatttcccgcatactaaaccactcactacttaatgtgctgcatttttcatctttgtgccttttgctaaactgtcatccttgaaggcctatttctgcctattgcatgaagctttatttgatggcctcagtctaacacagctatttatgtttttggtggattaaaaaaaaattctctctctctacattggattattttctatcttctttactagactgagagcttgctggccaggtcctattcatgcttattcattgtgaatttctccacactggaggtatccagtgcatgaatgaacacatgaataaaacttggtgttgaaactcccagctatattgacctgcaacttggcacactcaaatacataaaattgggatcaaataaatattattgcatgaccactagtaagtcaatatttaccttatattgtaagttttattgataaatatgcatctcccaatacttatccctaacatagtaaaaaaactaaaaaatctatctcaaacaaataagaataaaataaataaaaatttaaaaataaaaaataaaaatataaaaaatattttacacactagtaaatttaaaaactaaaaaataaaataatgaaaaaatctgtctctaacacgtaagaataaaatatctctgacataaaattaataccaaaatattgaaaatgagcttgctgataaaatagaaatgagatggcatcttctttggctttagaaaaccttggggatctctcaaatatttatatgttgcaataaaggggagtctacccctgaaagcagaacttctatcttctttgtactttctctatatccttctcttatttcttttacaacaatgaaaacagaacaatctatttaggagaaacaaaaaacaattgttcatatttttttaacaaaaagaaggagtgggaatattttctttaaaatccctattggccaggggtgctggctcatgcctgtaatctcaacactctgagaggctgaggcaggaagatcgcttgaggccaggagtttgagaccagcctgggcaacatagcaagtcctagtctctacaaaaataataataataagaagaagaataagaataaatccctttaaactacaataagcagagaccagttattcattggctatatttttaagattgccagcttttcaaatgcagcaaaataaatgaaaaaagaactttcaacagggatctagaagtcagttttcccgttgagtagatcttctagcccaatacatttattagtctataatgaaaatatctactttgatttcttagaggtttcttcaaataaatatattgaaacaattttaaaatgaccacatattatttaattttaaaagcacacttttagaaccccatttcttatgaaaggtttcatatcgagatcatttgttattgtgagactgtatctggtggaaaggaaagataggagtatttttcatatgtcaaatgagtagactaaaacatgggaggagagatttatgactttttttttacatcatccagctatggtttgggacgtgtttgttttacatttttcttccccagaatctctacactgtttgatctaatgaagtatttggcaaatctatagactatatgataatcacagtttactttgtgagggagtgtcaaattatagtgtcggtttgtctatattgatgactcgccataatccagacgctgtgcaagccatttaaacttccttagcttcattttacaggttaagtgtttaaaaattgccccttctgtagttgctgttaaaatgcaaacattaacaaaatgtaaattaataatataggccacaacaaatgcttgttgccagtctctcattttttgtttatcctttccttttttccctttcatagtaacctatggcttgaaagcaaagaaaagggtgaataagaagccaagttccatattagcatctggaatgggagcaggggatgaatggagcagattttataaatgtaattttataacatttagcctattatgataaaatgtcaattacagttattactgaaattatctcaacagctacatttgcttacattacaatataaagtcaccgacatttttcccaatttattgttttatagagcactaaacacaaaaataccaacaacctaatgaaaactgttgtttgcctgactttgtcttatctttggcaatgcaaactaccttgggacccccatgagaaccttagctgcattcattcctggttaaaaatacatgacattttaaaagcatttttccctcagttttcaaaatagaagatgcagtttgtttctcgttagggttggaattgtacagcaaagttgtctgggtagcttttaaagtgtgagggttagagtttaagaaatgagataaattttgcatttgaaacttgttagcaatttcttcagtcatcattattttaactagctgtatcagtaatcccctcgggagtgattatgctatacaaactaggaacatgccagaaaattttcctgggtctgtaagccactgagtttttaattacttggtatctatcctgatagaaagagaagctattttttccctccatttgtatcagaacacgtatgttccattgcttgttcatcttctctagtttcttcatagcttattccccagagaccagtgagaaagaatgtggcagcatcggtaattgtcagaatggaggcatctgtgatcttctgactgggcactgccagagccccccaggggttcatgggaaaacttgtgaagatagaaggaatgtctggtgccagtcagttaagttcttggggtttctaatgagaagtaaactaagtgaaagttgcatgtgtatttttcaaaatggcctttttctgaagaagtaaaagactgtgaaagctgtgtctgtatatataaaagagtacaattgttttgactgatgacatgtgtaacaacgaaataagtgatatttaaatctccaactgtgatctaagcaggacgaatcctcttacagagaaagcctttttcttctactgagcaaaaagttacaattatgtatataggtttagatgtaggagcttaggagaagttattttctctgcataacaaaatgaagaacaatagagctccttggggaaaccagggaggaagacagatgaaaattagagaagaaaagggaaggaggtagagagaaaaagaaaaaaagagatgatggataaaaatctcacaaaataccaatgagtactgtgcatagattttgtgtgtgtgtgtgtgtggaaaccagtgaagaggccacaattcctacatgggttaataaagcacaaaaaaaagaacctgcttgcacatgcacaaaagctgaaggcagagagtcagtgaggatgtaagtctctagggatggccagaaatcatgaggagtttattagcttctcacagttgatagaattggggagctggaaatgaagtttacttcactttctgagatgcagtaaggtccctgctggcatttcagttacttatctttgtgagcaatgttcatttatttatttaaaaactacattaaatggttgcaaggaatggcaccagacattatgatatgataacaaaaaagaaataaaagctattatgatgcttccatgtggaacttgcgattttgttcaaggcaaccataaattacaaatactggtagggattacctaccagtactaatatgtggttggaagtgagaccatgaggacaatgcagactgtatgagcctgagagagagacttatggagaagtcacatttaagcaaaagcctgcaaaatgtggagagataaaacaggagaagagtgaggaaagagctttcctgattaagaggcagtaggaaggcatgggatgctctatgaaacctgcagaggccagcggagcggagcacaggcagacagggagacggtagtgcaacatgaggtcagcaagctcaggggccccagtcttattaagtttggtgtttttgaccagacagcaatgacgagtcattgtaggatttttaagcagaggatacagaatcatcttggtggttttaaaaagatctctctagcctcagttcaaccagattggaaacatttcacctttctcagtctcctgacttcctataacaataactctagcaagttttacatgtggtttaatattttcttcatttgtcctctcaccttccaggatgcccaaaagggttctttgggaagaactgcaaaaggaaatgtaactgtgccaacaatggccattgccacaggatgtatggcgcccatatgtgtgagccagggcgccatgggaggttttgtcatctgagtaacttgcaggcacttaatttgctctgtgtgtaaagcgtgaagacacagaaaagtgcagagactactgtcagacaaaggaagagagtaaaaaatgttttctatagttttatatatatgacaaatatgttatagcctttagcctctttatagaatctagattttaatgaatgaaagaaaaatgtttctaattttgttttacatctgattaatgtttaccttaattaatgggagtggattgttaatagtctctttaagtagatgtttgatactttaccaaagttgaatacctcgggccagaacaagtttcttttatttctctgttccagaatgaagcagtctcattctctaagatttctaatattgcattttgactattaatcacatttttcaaaggatgcaagaaaacatgatcactaacaaatacttcaacccagcagtaacttttagaatttctcccagtgggataactctgaatgttctccatcccaccttgatgctatgtgcaagtatctatgagcctgcaaaaatcttcaccctgctcctctacctatttcacatcctcttctctttttgttaacagactaatgcctctgaaaatctttcctgattgaacttcagtgttttagtccatctgggctgctacaacagaataccataagccaggttgtacataatcaacaaatacttgtttctcacagtactggagactgggaagactgagatcaagacaccagatttggtatctggggagggcttacttgttggttcttagatggcatcttttcactgtgttctcatgcatggtggaagggacaaggcagttctctggggtctcttttaagatcactaattttattcatgaaagctccatcctcacaacataatcacttaatcactgctaataccatagccctgggagtcaggatttcaacatatgaattttgggaggacaaaaacattctaaccatagaaccacttaataccataaccatctcttgataacagacaccttttagagtcttatgttttattttaatgaatatccatgattctcgtctattttataaaagccatgtccataggaaagataaattataaatataccaataagagatccagtgaagtcatcatagaacactaaacctggagcatgaggaaacattaggcctagacaagcaacatagaagagaaggggaaaggtgtgggaaactatgagcaatagaggtgcagatggtatgttccagaatgttatatacctcctaggatatgccaagagaagaagattgacctagaaacaaggataatatttgtattattgttcctgtagtgtaacaagacacatcccacttttagtattaactttagaatatctaaaaaggttacatcagatgttatggcaaaaaaaaattgaatcattattgatctggtcaaaaatgtaaagggataacttttcagaaacatcaagttgaagtttttagggtttaatgatattggcatagcacatatttattcatttgcatgctgcgaggagttgaggcacaggaaaaaaatcagcaaacatgtttgttgtgttggtggtggtggtggtggttagcattttgaatatgactatctttagggaaaaatgatacattctagttctttgcaactcccttattgcttggacttgaagatttatttattaatgtcactttcctggtcttcaggaacttgagtttgcaactctatatattcgttttttagtcccaccataacaaagtaccacaaactgaatggcttaaacaacagaaatgcattgccttgtagttctgtaagctagacgtccaagatcaaggtgtccccaaccccctgaaggtgctagggacagatctgttccaggcctctctcctagtttctggtagttccttggcttgtggcaacttaacttcaatcttcgtatggtacatgtctctgcatacaaatactgcttatttataaggacagcagtcatattgaattagaggccatcctattccagtatgacctcatcttaactacttatgtctgcaatgattcaggttcaaataaatttacattctgaagtactgaaggattagaacttcaacatatgaatttttggtggacacatttcaatgcattacaaaccccacttttccgtatttccaaatatattccagtactgatatgttcttaatatacaaatggtcacatttaagcattcctctgtgtctgtgttgtcttctgaaccataattctatgtgctgaaccagaaagaatagggcatgaaggacaattttgagtgaggatttaggaatgagcaagaagaggcctacattaaggcaggcaacagcctgagagaccctgggacctggtgggtgtacgaaaggatccaaaacttggaagccatagaaaaggagatagaggatcatataagttattatctacattgggaaacctgaaaaggactctgttaactttagaggtagctctgtactatccctggcaattgggactaggatggccctacatggtggcatcataaccatcactttgaatgatctctactaatgtctctttccatccactggaaagtcaagtgttctctctaagcagctttctacagcaaagcgtatgtgggcacacaatgcaattaccttgagcctggaggccacttgaaggattttttacttggtatgtcacttggacatctgtaataggggagaaaataatgtcagagggatatttcagaaaaggaattgaattactgtaacactcctcaaagagaaaactatgggtatgttttcctgaatgcaaaggtgtgactttttcatattagaattcctgtgctgccttccatccctaacactcaatggcaaagagaaaataatgaaaggaaggcaagtaccatttgccaaagatgtggccaagataacgctgttgtcaccatgaaacctttatgttatcctacatgatgtaaaattatttctgattaccatagaatggaagggaatgaaaacaacggccagccttctcataagtgcttgtccgtcatctccatgctgcagcaggatgaatatggggcctggcaggccttagcattctttggagaatattaactataggcaccaatggagcacattgagaagcaatttctctcccggaagcaccaaagccttttaagtagttcaggcttcactgttcacgtccagttgccaaaaagcaaatgaattgcctgatttaaaagacatttgtttcctcatttttttggcagtcaggatgatcctcttgttttccccataatcaggctccacagaactacatgcctgtgcactaacaatttaaaataaacaaagcgtggttttcaggtgaccgctttgcctctatttgcttatagactgtctcgaggatgcctacggagctggctgcacttcagaatgtcagtgtgtggaggagaataccctggaatgcagtgccaaaaatggtagttgcacctgcaaatctggttaccaaggcaacagatgccagaaaggtatgctctgatgatagattttctttcttctttaataataatcctcagcctttgttcagcatcatatgattattaattagttaatccaccagtgccctcagaagatgggtaagctctattaatcccctatatgcaggtgaggaaactgagacatagggcaatagagttatttaatgcagtcttcttagcctctgctgcttcctgtccccttgttagcttgagcaagagaagaaagatcacactgcagataattatattcagaaagactaaagctagacaactgcttctttaaactgaactaatcaacccaaggcactactaacttccagaattagaattgttttctttatatctaaggattgatcattcaaacaaatgtaattcaaagatgctaatgcttaaccatagaaaaactttgaaaagttttaatatggttattggtgttttggtttttcaaatttgtatgtattacattttttataaatataaaagttattgtatagtatgattacaattacaagtaacatatataggtatatatgtgtgtgtgtgtagatgcatataccatttggaaaaaggtattccaagatgccagtattgactatctctggcttgtgcattcatgggatgctctttcctaggtacctacataactctttcacatttcaaaaagtctcatgttccttttttactgaatcttgtcagtactaccctacttaaaactgtaacttgtaagtttccaaacttttttctttttttatactgctgatcattttctaatacagcacatactctaattatgatgtcaaatatttattgcctgtcttttcctgctataagcagaaccccatgagtgaagggtatctaaaaattttgttcagccaagtatccccaaacttctgaaacagtcctgatatacagatattgctcaataaatattttcttaaatcaatacataaatttgcatttttattctttatacatttttcttgtattatcatgtattttgcattaagcacttattattatatttcagaggaaaatatcacagcatttttttctctttagtacaaccttgtgtaaaatcagaaggagataataggttcgaaaggaaaccatcatgtctttggggccacttacagaggcaggcactaggattgaaaatggtctttgacactcacgtatcctcactttctccttgcaatgccatcttcagaggatctgcagggcttttctggagctggatggacaggggagtttctctgttccaggttgtctagtggttatagaactggagagggtgaacagtgatgtccatctagatttcatggacagagtttacttaggtagctggattgtgactttctagacattagggaaaggaagttggggaaatagaatcctaacatgacactaacgggtttaatgtggtatgagagtaggtcccatgccaatttctaaacatcttcctgcttcaaatgatttttaagcccagagtcaaccccttattcattttcctcctggagaagtcatgccctggaagtcaatgtatgaggagacaatgccatataacaaacctgggtaaacttaatttattctgataacattttcttaaagcagctgctgaatatactttattggaaaatgcttctgagattcccactgtgaaggaaaatgagttgaaagtatatgtaaatcagcaaaatagagaggtcaccataatctctggaaaacatattatttttcaatcagataactttgtccaattctgatatttttgtctaaccacaaaatgaaattatgaatcagactgcagcaggtgaatggggttgctatgattggcagttgaaatcaaggcaaaaagagctctccaagagttgtgcatgatgaaaatcaggcctgttgtttttctttctcttttttaaaagagtgaagtagcccaagtgctcctagagacagacatatctttaaaaatcttaactccagacctgtgtctagattgcagatgaatagttaattaaagactggaaattgtttcaatggcactaatgaacagtattttccgcaatcagcaccaggccttatttagcttatcagcaatgacttctaagaacagaagagctggtttctacaactaacctgtgaaatagcaaaaaaaaaaaaaaaaaaaaaaaaaaaaaaaagaaagaaaaagtaaagcagccggtgtctttgccttgtttagattagtttgtagcctagagtattttgcacactcactgcaggcagacctcagaatgtagaggactctggcccagctggccccttgacactatacaacccctggatcatgataagaaagaaagattttttttagaagagttccacatcagatgaacttcgaattttgaacccggtgaatctttaagagcagattaattggcctgaaagatgctgagtacctagtattgtagagtaaattcgggtgtagtggctgagcgcaccagtttcagaggccaggagatctgggttcaagctttgtgatatagagtaagtcacttaacttgtgggagcctctgtttctcatataaaatggaaataaatttgcttatgccatagggttctcttttggaagtatgagctaatttacataaagtgcttaacagagttagtaatcaacagatcgggtatgaatatcccagaaaatattataattctgtaggacaagaagatacttcacagcccaacttgatttgatgtaacttttcataagtgttatatttttaagaaagttccacctttttccttgggttaaaaaaaaatgctttccaccgggtttctaattccagtggtttatatggaagaacacacactgaaacctctcactgagccctcagtggtccctgcagcatcaactgtcctttgctagttcaaagaacagtcaacaaagcagatcactctttctcttctcccaccttatgcactgtacactctcataaagtacacagttcataaacctctggtgtgattattttagctcacaaaagaagcagtcttagagaacaggatttaggcaacaatttgagggcaacttcctgagtgccacgcctcctgagcttcctttacaaattacatctcattttcaggttttgttctgtgcaactgctgctaaagatatatatcaaaattgcttccattgttactgtctgaaaaaccacattttcagcaaaaagccaacctctgtatctgtgttttcaaagtgacaagatatagtatcatgttgatttcttcagggaatacttttggaagtgttataaatccttggaggctactaggatatttctttctttgcagctctgtcacacacacacacacacacacacacacacacttttccaacttggttaggcaacagtagaaatcttggaccattttgagacttcttacaagtctacgtttctttctctctctctctttttattttatgtctgcccagatggcctctggggaccagagggctggttctcctctgcaccctgtgaaaatggaggtcagtgcaacaaaaaaactggaaattgtgactgcactcctgattacacaagaaaatcctgtaccatatgtaagtcataaacctagacgaaataaccaacaaagttaataaaactgttaactttaaaaatgcttttttttcctgctatacaagatattgctatgttaggatgcatgttcccaccatttattgttgtgtaacaaactaccccaatactttgtggcttaaaacaatgatttaatatttcccttaattctatggtttgatgaggcgattatactgctggtgtcccctggggtcactcatgtgactgcttgggctggtagatatttgagaacagactgggcatggctgggctgctcaaccagggaacttgccctttcctttacaaaacatttccacaaggttaacttggactttcctatagcgtgacagttttaagacaataaagaaggagcattccaaaagtgtgcaagcaaaagctatgtgaggtggaaaagccttgcctcagaagccacacattgtcactttcaccacattctattggttaaagcaagtcatgggcaagccaagttcaggggaaggagaaagagattctaccttctgaagagaagagtagcagaagcttattgcaaaagaccttcaagttgagagatatggttgcagccatttttggaagcaatctaccatagtatgctattcaaatttatactgaaaggcactttaagaacctattagactagaattatcattcttgtcagatgggagcagattagagagtgatagaaagtgattagctacatcgaactagtttcaaggagccagtagaactactatcccgctgtacccttttctggttgtgattatttgtaagttgtgctaaccctgcctgtatcaccttctctactccattgacaatgaaacacagtgacttgagaatgtgaggaaaactatgggctggatagtaattatacttttttttttacattactatttatttgtctaataaagattagcaaacatttgtgattatcattttatgaagtgtgaacagtgatttgaattagctttcagtgcttaggcctttccattaaccaacaaatatataaaatcagaaacaccatatataaaatgtaagcagatagtatttagcactgagctaatcatatgatcactttgggaaatattgctgcccctagggagaaccctcaggcaaaagttacaggactagatctttgatgactttctgtatatagcaagatactttattttagaaccattattctggcacttttgacaagcatttcaaacagtagaatagtttactggagaagcagttggctatccctaacctacttgtttgcttcaaaaaaaaaaaaatacctcttaaaggtaagaatttacatattcaaaaggtagttacttgctatttccacagtgaagtgacattttctcttgtctaactcaactttaatggaataattattaagcagatagtgataaagtttacactgttccagttgtcaagtgatataaatagaccatttaagaacaagtgaagaaaaagataaactcctcattctttaagatattaattttcatagttatgttacagttctttccttttatgacttcaaatcccagaaaaacatttcatgatagtcctgagagatttgttagtgataagtaatactatttacattttattggcaacttgataatgatacatgtattgaattcaatatgcaaaaatattccctgactcctagtccagtccaattttagtattacatgctattatctgattttacacacacagacacaaacacaaattatataatcaccataataagatatttaggaaaatgaatggagccaaatgatagaattcattaaaaatgcttcacgcgtacctcacaaaaaatgtgtgtggcattttaaaagtggcatgtatttgaagaaaagcatacaacatttctctaaatatcccgttatggtgctcacagaattttaaaacctagttactctgcataatgaactgtaaaaatactcataggctatataagtaatatattttagaggcaggaaagaccaaaaagctacgtttaaatatattggctttttaataaatcctgttgtttggaagttataaatacaaatacttggggaaaatctttttaaatcttttatttcactgtatttaaaaaatcctctggattatggtagattggactttgttgctgttttttgtttttgcttcctaaacagtatgtgtatggtgtggcatggccatgggggtggaatcacaggcactctcacacccttgataagaatgcatcatctatgtgaagggcagttaaatcttacatgtcaggccttttagcaaataatcagagaagggctcccagccttttctttatcccagcattatttataacaacaaaaaaagcttaaagtagaaacaacctaaatacccactagaaggagaatgattgagcaaattatacagcatatcactggactcttctgaggccattaagtttcatgttttagaagaatatgtcatgtcagaaaaattgacattgagttgatgttaaaagctatatgtacagaatgattcaaatttgtaagaacatgtagctatgtatgtatatgggaaattgtagaagaaaggacagcagtttttaaacagtgtccatctctagatggtgggactatgggtgaatatttttctcctttatacatttctgtctttttcatatttactagtttactactttttccttaggaatcagagaaaaaaatggcatcatctttagaccaattggtgactaaatatccaagaaaaatagttatctattcttaaagtattctctgttggcctaaactgttcccataatagtgaagatatttttttccttcagtcatatttaacttattgctattttaattttagaccattttctcctttttctcctattgtgaatattaaccatagctcatcagcactaccaaaactcttgaaaaataaacacctaaaagaacatagtaacgtttcctcctaatattttatttccctttcgtcagaaacctcattttctattccttagtcatttagtgattacttttatttttcaggagcacttacaaaacaggccccttcactattaaaggagagaaaatcagaaaggagaaaagacatgggaagggagatactaattccaaatacatccatgcttcaaatattatttgatcaaacttcataaaaaccataatgaacacaggtgtaagccttcctcagtgctaagctggcaaatgtttaacaggctctgtgaaagataaaagcactgagttttagtgtttgccgatttccaaggtataatactcctaccgtggtgatttcaagcaatcaatgtgatttcaaatggcttgcaaaattcctgaaaatgtagcagttggctttcccgagccggtagttatggctccagcataccattggctggcaaatatttgtattctgaacacaccaaacaatttcttaacttttactttctctattgatatgaagaaattattacttttcaggtatcagttttattttactgtttctaaacagataacccgattgacctttttggttgaattaaccaataaatagttccaaccaacaaaaatttgctatttagataggctattttattttcaagacaaaaatcaattgtttggctaaatggattcaagattcaaaaaacagacaaaagaaggtattgagttgctttatgtgtaaacacagtctcctcagtcttttactctagaattcatatagctggggttttgactcaatctagagaatcctttaacaacctctaagctgttttccaacttcctctaccacacccagcacgaatgagggctggtatttccttagtgacacacttttgttaaaaaaaaaaaaaaaaaaagaagaagaagaagaagaaaaagaaaagacagttaccagttatccaaggtagaagtaaaagagtatgtgtaaagcaaggcaaaacagcaaacaagttttaaaaattagaaaaacaattaaaatctgaaatattaccaaacataaagagctaaggtacaacaagatacttcctcctctctgaaacaattgtaaatcagatttttaaagttgctgtaaaataaattgtatttaaataatacatctcctatcctttcccacagtgagatgcatttcccttaccaatctggctctcagcaggcggtccagcccgatgaagtatcagcaaaatgtcagctcccacagagaagtgcgacagaggcaacagtgcagcagtgacaggcctttcaaaaagctattgtgcaaattcagttttaaaatagggatgtagttgaggactgatgggtatttcattaccaatgcgttcatctcccccatcgtccaagagaatgagagggggtcatggtgcagctgatataaagccattaagttgagtagcggttgatttggtctgtagaagatttgtcttcctatctgtatttttgaaaagttaatattcaaattagctgtcatttttagtacatacctgctaaaggggggccaagaattgttctgttttctacttgatcaccttccagtgtctcaattagatcattaaaaacaaagttaatcatgtcattactttataaacctcattgagctactgatactgttcataatgaagttcgtagcactaaagacccatcatcaacctgtctctagccagcttttgaccatgcttacgtataccctacatattttagtcattcccccaacatcatgtacatttaaaacatggtgccattgttcattgctctttcctgtaatacatgttttcttcttccatttttattccctcaagcatttattcctcaagcatttttattttccagtatatgtaaacaaaatactagagcccttctttccatagcagcaccaatcatattgtattataattagttgcctgctattaagactgcttatcattaatttttgtacaccccacttttcaatatacaaggggtactcaataaagatttgctagattcaattaaagaacatttttgacaacttaaaattccatcgaaataatttactgagtaaaaaaaaaaaaaacttgcaaaacacagcgtttatgatactgaaaaatacccagtaaccaatactcgttaaactggattgaattactcagccttttaatatagcaagaggaaatcaagaaagctgtagcaccacagctttattggtctgtactccatttctgaaaacacttttcatgagaagatttttcaatggattagaagactaacatcagacaatgatgattccttagcttcatctcaagagtccagattatttccttctatactcactttcaatgtatgcaatcattccttttaaatacaacagagttaccttagaaaagtaaacaaatgtaggctggacgccgtggctcacacctgtaatcccagcactttgggaagccgaggcgggaggatcacttgaggtcgggagttcaagaccagcctggccaaccccatctctactgaaaatacaaaaattagcctggagtggtggcacacgcctgtaatcccagctactcaggaggctgaggcaggagaatcacttgaacccgggaggcagaggttgcagtgagctgagattgcgccattgcactccagcctgggcgacaa

SEQ ID NO: 566 - DNA, 577003 bp, Homo sapiens
actctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtgtgagtacccgcgccccctgctatgcccgctgcaggggaccactgtccctggccccctggggcgtgctccgcgctcgcgcccttgggcccccgcgcgcgtgcacacgtggtggcttttatttcttcgcacgtgttcgtggtcttccttctggagcctctcccctcccccagccccacttctctcatctctacagcttgaaccttttccccgaggacacccaatgaactgcccggtagcttcaggctcccggggcgagagccaggcagacgcgggacttaggctgcgcggataattgggagcaattaggtcccaagatacgtaaacttcaaccgaacggggcgcccgggagctagggaatgcaaagggaggacaggcgcccgtgtgaggcttgagagtatactggagaggttaggaggtgatggcggggtaggacggggagaagtgagggggcatcgagggctaggtcctcagtcctaggggcggagtaggggaagctgctacttggagagagctgctaggttttaagcgcgcccggaaacacgcctcgccaccacccagccaccaccaacggaaaatctgtcagtgcatgtagcccttcctgccacggagaaggtggccaaggtctagaggaggccagcaggccaggcgaagcaacgctcccgcgctgcagggggcggggaggcagcggggaacctggggcgcaggaacgcgggcggaggtgcgatagcagaagcgcaaatgggtcgcctctgacagagatcgggcagtgggttaagtccccgtttgtggcgcggagtcaaagagtgtgtgtgtgtgtgtgtgtgtgtgtgtgtgtgtgtagtaagccttctccatctagcagagaatgcttaatgagaaaatgattggaagcaaatgtttatttttcccttaggcatttaaaacctttcagtggctttaaagtttactactgtttttcccacaaagtccattcattcagtctcctattagagttacgtttatctgggcattttaaggttgtttttataatgttacctcgtgtctaattctttttttcttcctcttctccttttgcttcctctttttttagtattattatttctgcttcttttttgttaagatgaaatataaagacatcaaccttagaagaccagtagagaaagttgcagatactcgctgatacattccttgtttcctagtaaaataagttttgagcacacggactaggtttcttttagaaataagttatgtcatccatacatagctctctcctgggatgcagaattagcatcaacaccagaaacgtgttttgaaataacatggaagaagggctggttttgtaactaggtgaacctggaattcaaccacataggagtcaggaaattggtggagtctacaatctgtggggctctggtgtctggaaaattttacagtcccagattgacgtgaacatgtagcattaggcagaatattccagccaactttccgttttacaatgcacacaaggagaacggttgtgttgcatcatcattacatcaaaaagtataacttttatgtaaaattcacatttatttaaatgtggttaggataatgatagagaaatgcaactgacacttttctcgttaatctcctctgacctgatatgtaattaaacatattacttaataagcctggtaaattattttgacctgtcagaatatactaaaataatttagcaattataatgctcaatttggtagcaaatatatatactgtataggttatgattttttctttacaacagtatgctcaaaacatttctagcctttcttttttttatattatgcattgtatattcagagagagttaaagaaagccttggttggtgcacatactttgcatctcctaacttgttcttgaacatgaatgagaacttgcaacacaacattttcttttccatgtgttggtgttaacaggtttgtatgggcttacagaattttaaaacattaataaatgatttttccaaaggttcaaggttggatacttctctgtctaccaggctttatcagtctagcagtatctttagtagtagacaggaaataaattgtgtacttaatagatgtagcaaatgtgaagttttgattatacattttagagtctgaaactgcaatgcctcagcaattagataggggtgctatatccacattagcacaaagagggaatggatagtatcatcttttgggaggattgtgcacaactaagcagaccctgaggaaagaggccatctttggcagttgctgcttgtgattttaaatgagctttagaatagccagactttacacattacattcatttatcgaagttgctttatgctgtaagtttaactagaccccaataaaataatttcgagagaggtgtaactaactaattccctgccagcttgggaatccccaaatcttattttaataacagtatttgtagcatattaaggttcttgccaagaacaagtgcaccgtgattaatgaggtacttcaggggtgaatttacttggtcaaccagtgttttcactgccaagaaacaagaaaagcatgtttaaagttatgcttgaggtaaatataaatttctattatttatgcaaaaataattattataatggtattttagggttataaaatgtcttttcaagagtacatatcctagcctattgataggatggctggacagagcaagggatgacctacttcaaatattttcccttaaactttataaattagtggagattaggagatccttgcccttactattctttaggatttacctgacagccatatttcctatcttcaacttttcttcattttattagtgtgctattcaaacatgaggtggctcatttccctgaatgttgtttgtccctttttaattcctccttgtttaaggaaaattttgaagaataatgagggtagtagggggacacaggatgaggcttcatatataaatttgcgttgatgcagcaaatgtggttctgagaagttacatgggaaacggtgttgcagatacatgtaattgatcactttgcctaatgtatctttgcctgacttaatgctatggatgtgaattatagatattaaacaaggagacaagaagaagtcacccaagctaggagctctgaagtcatcctttttctcatacttactccttctggtcaggcaaaaggtcattaactattgtttgtttactttataggtatttttcaaatacattcccttttcttctttaccacttctattccattctgtttcttacctctccattagatgatttgtaatattctcctgcctgatcatctggtttctgttctcagccttctctctgctctaacatcatagtattgttcgtaaaatgcaaatcttatcatatcatccccttgcctaaaatatttccatgactcttatcatctactccttcatctatgtatccatctacaattattagagtgtgtaatatgtgctaattcccaaattaacaaggcaaaggcctccactctggaggaaggaaaagacgccagcaagggactactacaagcctgtgaacaagtgtgaaacaatgttattggtgtgcttagagagagaggttacaaagtgacatgagaaaagaaaaagaagtgaagcccgggcagaaaagtcagcacaggcttcaaaggggaagtgaggtgtaagctgagtttccacaaatgagtagttaattttcaggtgggcatagcaggagggaatgaacaatcttgacagagaaaacagcttgagtaaagatatggagttgtgaatcagcacagtaattctaggtactgttaagtattttcagggtgaggaaagccacaagaaagggtggtagagcaaaaggcaaatcaccaatctgttggatagattctgatgctgaccatagaatcttgtatttatcctgtaggcagtagtggtcattgaatggtgataatcaggggaatgatataatcagatataaattttggaaagatctgcctttcattagttcagcaaataaattggagtgcaaaatggagtcaatatggcctataaggagatgataccaattgtgagaattttccattcattgttgcattcatttattcataaacttattctgtgaaatgtctgttgactatcgactatatgctgtggatcatactagaaaggtgagagatgattgcctaaggaactaaggcagtaactgtggagatgagaaggaggagtttaaccaaagaaatgttaaggagataaaatttgcagattgttttcaccagtctgacatgtggtatgaggaagatgattctgacttggttgatttgaggaatggaagtgccattcactaatatatgggacaaagagtgaagggcacatattctggtgaatataatgggttcggatttgaacatgttgggctttttgagtcattcaggtggagattttaagtggtgggaacatagcagtgaacaaggcacagtctatttccaaccacgttagatcagcaaccagaactgtttctggcacatagataacactcaataaaatatttttgaatgaatggaatcatttacaaatctggagtttaatctaaatatgtaaccagatatttagctttgaaagcctctgtcagttttgtggtaattaaagcaataagtagaaaaaatgagatagtccaaagaatatatagagtgagtgagggcatagtggaggctagagactggggaacaccaacaccaagcagtggatgaaaaagtaagagccaatggaagaacctgggaaaagctttacagcaacccaaaggccgagggaaagcctgggagatcttattttcatgaaagcaaaggaagatgcatacggaaaaaaggttatggccagcagtttccaatgctgcagaaaggactagaaaagttaggtaagatttcattggatttcttatgaaggaggccactggtggcctttgctgctgcagcttcagtggagtgctaagagtcataaatatgattcaagtggactgaggagtggttaagacttgggaaaatggacccagtagtgtaggttagactccagattccttggaagagttcacacaagaccctcagggcatagactactatatagctactcccctctaatatgcactctaagccccacccttactgcactgctccaccctgtgtctcaccaccatgtgtttgctcatgctgttctcttggcttctccccacatcttgcacccttgctattaaactcctaatgtttcttcaaagtacagttcaaagatcacttcctcttgggcatatttccaaacagttcccttccctctgccaggatgagttaggtgccccttctttcaggttccatggcactctaccaatgtcattataatggtgcttcccccattgtactgtcatcgtgggctacttggtctgtctctcccacatgacagcaagcttccatacagtgaaatttctacttatttctaaatattaagtgcctaacaaggtgccttgtgtctagtagaccctccataaatgcatgcttaactgagtaagtaaataatttttcttataagccttccacagaggagcttcagggtgagccgaagctgaaagaactaccaagtcttttcagttttcttagacgtaagatactgacgattcatttaaaagaaaaaagatatgggactagaagtaggagattagtgctttgcttgtagctttgccactaattaattctgtaagtcatttcacacatctgggtctccaaatcttcatctgtgatatgggcacaatcgtgtctgtgatccgagatggtggaggatactgtagagagtctaaaatgctatcattaaagagaaagagtatttggaataagaagcaatctgatccttttatcatttcctttcctcttctctgagcttgagggttgcctcttaactagttgctttaacttaattcctaaatccccaaggtctctgtgctacatagtagccaaagttatctttctttctttctttttgttagtttgagatggagcctcactccgttgcccaggctggagtgcagtggtgtgatctcagctcactccaacctcagcttcccaagttcaagcgattttgctgcctcagcctcctgagtagctgggattacagacgtgcgccaccatacctggctaattgtttttgtatttttagtagagatggggtttcgctatgttggccaggctggtctcattctcctgacctcaagtggtctgcccacctcagcctcccaaagtgctgggattacaggcatgagccaccacacctggcccaaagtgatcttcctaaagacttaacagaacacatcactcctcctctgcttggaggaggatctgtttattgcttgtctctcccctcaaccccaattctttaaaggcaggggtttctgtcttattattatatcaccagcacccagaacactgcctgtcacataaaagatgctccatgcatacatactgattcatttactgacaccccagatctccaaaatacactattagttcccttgtggcagatggaattttactctgttggccattctatgtgtcagactcaattagacctaatgaattactttactacctacatatatattctattctgaattaagtttatgtctgtagagactgatgtttacatattctttttgctcctgcattcctttaaaaaatcactgatttctcttaagtctacagaggccttgtagaagttatactgctttatactgtgctgatatataaaatgtttcatactcttctaatcagtctttagaaatctaaacaatgctattgtacttgaagaccatattacaattagaaatgttgaaaagtgttacaatattagtactgggaatatgatagcctaaaaggaaagaaatgaaaagggtatttcaaaatgaaacgaaggactgatacaaaaaaacactataaacaagaaagatagccagcagccttctgaaaattgcttgcaaagaagtagcgccagttttaatttttaattgcaaatggctattttggcagatgaaaatgccagcagagcatgttttatcctagcccaatggtgtgaaactacttgaagcccaattgttgaacagtcacagctcatagttatctttaatatgtatgtgttttcattttaatttcctttttcttcagccatttatgagtgcgttatttgaagttttatttggttgcaacctgggagaaagattggccacacatctgcactttttttcataattaaagaaattctttgatggtctcagagtttcaggtgatcttttaatcctttgcaatcagtgtgtctgaagagtgagcttcccaaatgttattaaagtcatcaatttctaaacttaaaaatagcttgaagtttttcatcatatacatttgtgtattgtgcatatatatttcatactcatacaaatacacatgcaacataagcacatacatactgttatcttttagcagagaatttgtgttagtgtaaatatttctatttccctttgttttgatcctctaaaagtaaaaaacacttgaataaaatgcaatttagaaataaaaagaacattaaatttactcttgataatatagagcttatctcttaatttgaaagataattaaatttttacatgatgaagagatatacaccttttacaaactcagtcatagtggtcattgttctcatttattgtacctgtgaggtaattctagaatccctattccttcttcagtcagtggctggataatctaattataatgttataatccatcatttctctttttgaacagtcaatttagtttaacatttgcttaacagccattatgtatgccaggtaatgtgctagatgctggtggttcaaagaaaggaacgatgtggacctgacctcaaagaaatccattggagaatatgacagatttagatttaatgatcaactttacttttcctatacaggtaccagtttcttaatctataaaatatcagtaccagtttcttaatctataaaatagaaataaaatattacttcaaggtgttatatgtatagtatatgtgtacataatgtttaatatatacatattaacagttagcatggtggctctcgctgaaactagagggaaaaatagagacaatgtgctggaaggctgtatttatatgataaaggtctaggattttatcctatatgtgatgggcaatctttgaggaagataggatttaggcaaataataatgtcattggatttccattttagattggtgattctactagctctatcagtgatggcttgagggagacaaaactggaggtagaggataaattttaaaactgttgttccaacttaagcaagagataattaggacttagactggggcagtggtaggaaggatgggggaaaggtgtgacaatagagttgaaatgtattagtgaatgattgaatgtggaagattaagagatacagatttgttatttccagattattggattgggtgcttgggtaaatagtggtgctattaactgaaatcaatagaggtggaacaacaggttggcgaattgcaggggtgataaaatgagtttagctttggaaatgctgagcttttggtgcctgtgggaattccaactataaatgtacagcagctcttggatgatgatttaaaagacataaaatacagacaggagttataatcacgaggaaggcaaataaagataaagggtaggaggtcaaggatggaaatctggagaataccaacatttaattgataagcaaaggaaacaaggaatgaaatggagtagacaggaggctataaggaaacactagacaaaaagatggtcagggttgtggaaacaaagggtattgagagagtttcaaaaaaaaataaaagtaaccaattctgaaatgtagagagtggtttagtaagataaagatccatcagaaattaccattggatctggcaatgtggaattcttcagtgatgttataaactcatcagtgttaaccttcagtgaagcagtgagggcagaggcagattgctgttagctgagaaatgaatcagaagtgaggagaggaaacagcatatttaggccatatgttcacttagtttggcaagaataaaagggagattggacactagctacaaggaaatacaaggctaaaaggaaaatcaagagagaataaagttatagagaagaagtttttttatcacaaataatagtcattttaatgattatgtgctggacattgttctaaattctttatgcacattaattcttttattcctccgaataaccctaataagtaatattagtgttatcatcttcctttcagcaaaccagaataccaaagtagggggaggtttagtaacctgtccaaagtcagcttctgagttaatggcagaacagggctttgaaccaaggcaggttggctgagagccacacatgcttagccactatattttatttcctttactttgcctgttagagttttagattttttctttctttctttctttttttttttttttttgagacggagtctcactctattgcccaggctggagttcggtggcgcgatccccgctcactgcaagctccgcctcctgggttcacaccattctcccgcctcagcctcccaagtagcagggactacaggcgcccgcgaccacccctggctaattttgtttttgtatttttagtagagacggggtttcaccgtgttagccaggatggtctccatctcctgacctcgtgatccgcccgcctcagcctcccaaagtgctgggattacaggcgtgagccaccgcgcctggccagtttttttttctttttttaaaaaatcaacttttattttagagacgggggtacttgtgcaggtttgttacatgggtatattgcatccaggtagtgagcatagtacccaattgttagtttttcaacccatggctcttctcttcctcccgcttctagtagtcccaagtgtatattgttcccatgtttacatctttatgtgcttagtatttatcttcacacttctaagtgagaatatgtggtacttggttttcttttcttacattaattcacttaggattatcgcttccagctacatccatgttgcggcaaaggacatgatttcattcttttttatggctgcatagaattctatggtgtatatgtaccattttttttttttatccaaaccaccattgatgggcacctaggttgattccatgtccttgctattgtgagtagcatggcaatgaacatatgagtgtgtgtgtctttttggtatgatgatctatttcctttgggtatatacccagtaatgggattgctgggtgaaatggtagttctgttttaatttatttgagaaatctccaaattgctttccacagtgactcaactaatttacattcccactaacagtgtataggtggtcccttttctctgcagtctcaccagcatctgttgttttttggctttttaataataatcattctgatggtatgaggtggtatctcattgtggttttgatttgaacttctctgaggattagtgatgatgagcattttttcatatgcttgggggccactcgtatgtcttcttttgagaagtgtctgttcatgttctttgcccactttttaatggggttgttttttgcttgttgatttgtttaagttcatagacttcggatattagagctttgtcagatgcatagattgtgaatattttctcccattttgtaagttgtctgtttataaatcggagacgacacaaataaatggaaaaacattccatgctcatggattggaagaatcaatattgttaacatggccacactgcccaaagcaatttacagattcaatgttattcctgtcaaactacaatgccattcttcacagaattagataaaactattctaacattcatatggaaccaaaaaagaacccgaatagccaaagcaatcctaagcaaaaagaacaaagctggaggcatcactatctgacttcaaactataaggctataccaaacaaaacagtgtggtactcatacaaaaacagacacatagatcaatggaacagaatagaaaattcagaaataaagtggcacacttacgatctgatcttcaataaggccaacaaaaacaagtaatggggagagggctccccagttcaataaatggtgctgggataactggctagccatatgcagaagaattaaactggacccctacctttcaccatatacaaaaattatctcaagatggattaaagatttaaatataagacctcaaactagaaaaatcctagaagagaacctaagaaatagttttctcaacatcagccttggcaaagaatttttgactaagtccccaaaagcaactgaagcaaaaccaagaattgacaagtgggacctaattaaactaaagagcttaggctgctataatcttgattgtggatggtacgtgtgggcccagggctcctcatatcagatgggtagagtaattataaaaactactttggggtctagtatagctctcagcaaaatagtgtatgcacaataaatgtttgttgaataaatgaattatagttaaaatgccttattacctagaatcaaggaattacttttaactttgtactaagcatgtttgtttctctgccttcacattctaaccagcttaagttctaatttttctttaaatatttttctgacgtgctagcttattttcttatcattatgcacctcccatagcctttattatttggattatgtattttattccttaattacattattacattgtattctaatttggtttttatctaattctttgcaaatagtttgtgtatgtaaagaaaccaaagtaccctctttttttgtatcctatatagggcattatgcccaggttttcattcttttggttttgtttgtttgcttttgtttgtttgtttgttttagagacagagagtcactctgttgcccaggctggagtgcagtggtgtgatttcggctcactgcaacctccacctcccaggttcaagcaattctcctgcctcagcctcccgagtagctgggattataggctcccgccaccacgcctggctaatatttttgtatttttagtagagatggggttttgttatgttgaccaggctggtctcgaactcctgacctcaggtgatccacctgcctcagcctcccaaagtgctgggattacaggcgtgagccactgcgcccggccttcattctttatttttaatcaaaattcacctagcttattaccactagtggaactatttgaatgttttaactttatatttccaaacaggaatttccttaaattctactagttcgtattgcgtagcaacttatattgattatctgaataataatttgttcccctcacccttttttttttttttgagacagagtctctgtcacccaggctagagtgcagttgtacaatcacagctcactgcagcctccatcacccacactcaagcaattctcccacctcagcctcttgagtagctgagaccacaggcacagaccaccatgcccagctaattttttttttattatttgtagagacagggtctcactatgttgctcaggctggttttgaactcctgggctcaagcaatcctcccgccttggcctcacaaagtgctgggattataggaatgagctgctgtgcttggccctgaataataatttcttaatgtaatttcctataaacattaaattcccaatttatacagtcatcatggaatacctaagattcactacaaaatagcatcattgctttgtttaagtctcataatggctgaatatagaacatgtttactccaaactgattttttgatttttttcttctctttaaaataataaatactcattttctttacactagtgtgaatacatttcattcagcttccatgcttttctctctccccttccacatttacattttccctggatgtttcttactttccctttccccttggtcttattgtatttttcttccagttaaattgctcctagttttttttttttttttttttttttcctttctctctgtgcttctacctttctggaatggtgtttctccccatttctttgtacaaaatgttgctttcttttcctctgaaagctgtctgttcttaagagatgcattgaatttctaattacatgctctaagagtgtactgcctacgtagactgggtacctaatttacatattgctctatggtaattaatagagacttctagaaaatgtggattttagaaatataaggggagaaccctatttttcttagggttttagttatgctcaaatttcttagaaaataaggagtgaagccttaaaatcgctgaagttttctaatatctatatattatttctgaaatttgggaatagtcagatattcagtgaataattttaaaagtttttaccttctgttttggaagttgactactttgaaagttgactatatactttggaagtatatagttaagaaataaattagaaattagtttttatgccatgtggaattattatataaaaatgcacaataaagaagtccaaatatatttgtaacatagttaaatatcagttaaaaatatttaccccagtggctgttataatcattaggagtttctttactcagtgagccaagaatagatctataatctggcatcacagagctgtactttttctgttttattgagaggttaaagcatggtctcaaaatgcaaatgtatcataggagtacataggagatagaaaaccacctgcatttttttctggttgaaaatgtttccaaagcatagaccttgtgaaagcgattctcataaccttttctagaatgaaaaacaagtttaaggcttctatttctctaaacctgttttctctcacacctgaatgaatctaggaggattgaatggagttgagaatttagattcttctccccgtgttttgagtcattggctacatttctcagctttctggtttgtaaaattaggatataattcttcaatgtttgtttaataacctgacctcttgctaagtgtaagaccctagagtaggaactatagggcttaacataaataagacatagcatattccctcaagaaattttcatctagaaagatattcatttactgtttactgagcctcaaaaaccatctctctgaattgacttaggataaaagcaaagtttggcctttctccagtggcatttagctattgctccttttgaagggatttacaaggtaaactccaggatcaccatgtacagaactgctgattgccagttctcttgaccccttgggaaactttggagctcggcgttcagctgcctgtgcaagtgggcgttctgctcagggcattcccacactgagaccaacacaggagttcccactcatcatagtaatttctaaacagtagtaattaaactagttaaactaaatgttctagttaataaaacattctgagtatgtttaatttgctccaaagtattttaaaaaataagaaagaaaccaatgctgtttcataatactttgtttggagatgttatttttttctccctaaatgggttaagaacaacagtataaaccaaaagttgtgtttttttttaacaaaatgaagtgtctgtttattttcagtatacactttaagcttctaatattgttcacttaattctattacatgaaaggaaaatattatacctagccttccaagaacacaatatgcagtggacactcaaatattgaatgagtgagtgcccactgcatattgtgttattggaacactttggaaacacttcttccatttgttcaactttctccagtcatgtggaaaatggcttttttcttcaactaagagtggtacttcccagtgcagctaaggtcaaaaagtgttagaaatgtgtgttcattgcaatctctaaagtgctttttatccatcttttaaagactacatacttcaaatggatttcagacctagatcagcagtcagattaaagaattgcaaagtgagattaaactagttttaaatttatcatgcctgatgataaaattctatagttctgttttggtatgtcaaatggaaaaggcagagaaattgattggcaatccaaatgacatttgggaactcacttagaaccttcaagataggatcctgaacccaaggagcacctactcttattcatctagtccttgacatagaagaaattacagtttgttttggggaaacagttttaacaagctcgaacattcaaatttgccttcaagtatttttctctagaagaaacccgggtaagttcccttagcttcagatccatcaaggaataaacaaaatgagatgggttaggatcttcccaaacgaagcagctaccctagttatgtaggtcctactttagttgtgcactgagatcgtcctgcaatccttccaaaggtaggacaggaagcataataggaaagaaaactatgtagtcatcatatttgtgccaatcgtgtggactcctatacagtagttcaggctaccagtttggttgggccatgcttcagtagcccattattcctttcactcagtagaatggctccagttattcctctgaaattggaagttagagtttcacagtatctctagcaggaaagattgccttacatggttccagatcttttacatctagtattggacttgatgagctactttacaattacatttcctaaactagttgggtcatgctgctgagagctgttttccagagctagtgggtatggagttttcttccaggcttcagggcaggaagtggataataaaaatacatttatagatggcgctaagtgaggtagcctagacaaccataaataagaataatcaaaccatcacgttgtactggagaagacagaatattcctctaattgaagggtagctatcataatttaaaattgtcatcatgaaggattgtactttttttctccaaaacaggttaaaggcaaatacctattttttttttggtttcttgttgattcaaattccctttccacactgcaatcttagtatagatttctggagcacatgataatatatttaaaagagctattcacaataaatctgttatgtttttgtacttgtttcaagggtgacatgtaaagttagtggttgctctacagtaagcatctggtagtggagcggcagtgcagcatgacaaggacctggactgcagtgtcagccctgggaatgtgcagaaacggagaataggagaaaattcaaagggaggactggagttcttagctctccattggcttctggttggcaaaagagatgaaagaatcaaaatgttcttggttccaagcaagtgtgactgtgaccacgcagaagttactcaattctgttttaggtaaagaacaagcacaagtagacatgtggcctgtttgggctttgggaaagacaggggatcatcagttaccaatgtagagtgatggagaagaaataaggtccttggagaagagtgtatggaaaaagatttagggaatactggcatcttgggaaatgagaagagaaagatttgcaaaagggacaaagaagagaaaaactaggaaaatacaacatccacaggaagactgtctctcaaaggattgcaatgggataaaagtattacaaagaaaagaagtgaaaatgtgtgatgatgtagaaagccaggatagaaggcgaggggccagaacctagaagaaaactttgccatctaggagtggacagcatgtgcagtgccatgtgttaggaggacatccaatttcacaggaaacatgatgtcctggaaaaaaaggccagaacaacccagcaactaggtggtgtgcagacatagcaatcagtttttcaaaagggaccatgcagggtgaggggtgtccctgaaagtatcactgtataactaggatggggactccagaagagagggtgatatttagagagcctcgaatgaaaccagggatatctggttggaaagcaatcttgcagtctctaagagagatgctgataagtgcaaagcagttctaaagagcttgagataatgcaccaaacggtgcttgcaggggagaagggagacagattagggtgcataattgataaataaatgggtaaagagagagggagaatggtagattaggaatcaacaaagtaaagctaaacttttatttctccaagcagctggaggtctgtacaaataaaaaagcctcaggaacccccttccctgagaagtggaaagattaaagtaattgagaataacaagatcctggagttatggtaaataaaagtttaggttggttaaaaaaaaagtttggaatggcaacattgggagctatgataaggcaacattaagagataaataacgcgatgtcttgacaactgcaaaggccctgatagagttcaggcatgatcacgtagaaggctacctggtgtgtgagattgtgagaatttctctaacagtagtgtgcagggtaaattttaaaaagcagatggagccctaacccaaggctggcaactttgtagccaaagtaaagggaatgagaaattttctagaagtcacacacactgaacatgtgtgaccttgaccttgggcaaatcgtaaacccctccaagcaccaaccatctgataaatgtggaaataaggagacaaagtgttaaagctccttatataattgctgggcaaaaaaaaaaaaagtaatttttatactttgtaaccatatatagtctatagcctcttcagaggaggaaatgctgcaataatagacacatgtgaaaaaacatgtgttcaacgaataaataagtgaataagtgaattagcataacacttatttaacaacaacattgtatttggtgccaagattatagagccagatatttcctgttgtgtgtacaagttctgtgagcttgaacaaaaagatttttcttcagaaatcaagccatattttataatctctttatttttgagtgtatagataaaaacacactcttaaagcaggaactactgctttgacacatttaagtaataggattagagagctggaaggacctttggtgaccaactctagtgctatcttttttagatgggaaaacagcctgcaaaaatgttaagtagcttcctcaggatcaagtactattggagccagcattggtggtcaatcctgtatagaaatgacttcagttgtagatctgtgaccttccttacttaccttcctctaccaaaggtactctataattcttaataaatgaatattgacattcattttaaatactattgtttgttcaactgttccatgaagaatattctttaaataagcattgtagtgctaacagggaaaatatttttcccttttataaacttctaatagctggcaaaagatagtaatttccatgacttttctttcttctaaggaagttaaattctgaagacggtgtttttcttggagttaaaccatatattgacttgttctttaaaggatctaataagtgaatagatcaagtaagaaacaaattagtatttagcccattcagttgcagcactgtggtttctttccagatatgaaaatgtgagaaatatttcctgaaatcaagcaagtgggagtgggaaagagtatgtataaatgttacatgaggaatccaaaatcatcatcagcatcacacacacacacaaaaatacatttattatttcacacacaatttcattacacttggtaaattcattagggcaaggcaaatgtattcatccagacattcaaataagcagaaacatctgtgcagtctttaaatctgccatgttaaacaggcctaccactctgtttatatgccccaaagagcctgaaccaagacagacgtaagtaggagcagctggatttgaccctaactcttgaaaatcctgccctgcttgagaggtaaggcatatcttcagctttgcaagcacactattttgtgtgtgtgtgtgtgagagagagaaaatggttaaaattaatgtgaatttggttctccctcctcatatttgtctatattaatatactttttaattgttaatattatcattagaaaggtgatggtttcatgaatgaattatgaaggagaaaagaattttggtatctaaaattgttggccaataattgaccattttctgcctgggtcatgtacgtgcactgagaggttgaagtgtactgtgtgtgcttcttcaggcatttcctatttatctgagacacttttgagacagagaggtgactggagaaaatgaagggttctcctttatttttatgaacaattctctacgcctcattactctcacaatttttgaatatctacaatcttttctctcagttttcttaacctccacgctgatggtcctgattcagagctacttcgtttattacccaaacacagcttggggaagggaagggggatgtaaggcagtagaggcttaattccccttgttattatacatggctattgctatttgtcctagggaagagggttagcttggccctactagataaagagcgtgttaaaaaggcctcccaaatttacaagtgaaaaacaaacattttgcgagtaaaaaacaaacacacatatcctttgcccattaaacattttgttttgttttttaaaatgagcaagggatatgaacagacacttttctttttaaattcttatttatttatttatcaacttttattttaagttctggggtacatgtgcaggatgtgcaggtttgttacataggtaaacgtgtgccacagtggtttgctgcacagatcaaccctatcacccaggcattaagtccagcaaacagatacttttcaaaagaaaatatatatgtggccaacaaacatatgaaaaaaatgctaaatgtcactgatcattagagaaatgcaaatcaaaaccacaatgagataccatctcacaccagtcagaatggctattgttaaaatgtctaaaaataacagatgctggcaatgttgtggagaaaagggaactctcataacctgttggtgggagtgtaaattagtgcaatcattgtggaaagcagtatgatgatttctcaaagaactaaacatagagctgccattcaacccagaaatcccattactggatatgtacccaaaggaatataaatggttctgccataaagacacatgtacacgtatgttcattgtaacactattgacaatagcaaagacatggagtcaaactaaatgcccatcagtggtagactggataaagaaaatgtggtacatgtattctatggactactacacagacataaaaaagaatgagcttatatcctttgcaggaacatggatggacctggaggccatcaaccttagcaaactaacacaataatagaaaaccaaatattgcatgttctcacttataagtgggagctaaatgatgaaaacacgtggatgcaaagaagggaacaacagacactggagtctacttgagggtggaagttgggaggagggagaggaacagaaaaaataactattgggtcctaggcttagtacctgggtaacaaaataaatctgtacaacaaacccctgtgacaagagtttacctaaataacaaacctgcacatgtacccctgaacttaaaagttattttaaaaaaggcctcctttggtcatggagatttgtacacaaacacagagcattttccattgatcctcagttaaaggcaccctgcagttatttaaccctgacttcacataccaaaggaagtctaattatttgatgtgtgctaaacatcctcagtgtggtgctgctgttcagccacattaaattcacaggacaagtctgcaccctatgtagtacagattgagtatccttaatccaaaagtctgaaatccaaaatactccaaaatatgtaactttttgagtgctggcatgattctcaaaggaaatgctcatcggagcatttcagattttggattttggattagggatgctcaaacagtaagtgtctgcaaatatttcaaattttcaaaaaaaacctggagaggccaaaacacttctggtcacaagcatttcagataagggatactcaaacctatcaatctgttaaactttttgatgtctcctaaagacagccacagctgttatgtatttgtcacagaaaccagaattttctttaatttagagatttctttaatttagatagtttgcaaagatgtaagcataagaatgttccctgaaacattgttttctaattttaaaagtctagaaaaaacataaaactatgttattagcatctagttaaatcaatgatggcaaaactgtccaagggaatactgcatcctttgaaaagaatgaggtggatatgtatgacatggtatagcatgatttctaaaatgaaaaaaaaacacacaaggtataaaccagtatgtacagcacataacaggtatacactttgtaaattaaaaaatacacacatagtaggttgttctcattctgttccataaggtcactgcaaatactgaattagcaaataccgactcattgctcctagtggaaatacagggttaggtcctatgagcctttggtcataacattttcatcaatggatcaatacataaccttattttatgtgtgtttctgtttaaagatacattatttaatatatattgttgattcattaacactgaactcacagtttgtaagtcatacctgaatgttgtttatcttacacatattttctccgtaaggcacatcacagccttcctgtgcttaggaatgctagatcacccttcagtctggttcagtgttagctgggaacatatgtgagaggagaggttcaaatttttggctggtctgcacatgtctgcaaatgacctcaaaagtgctgtattaacttagaggttacaaatcaattttgagtagataaattctcaaatatgaaatccacaaataatgaggatcagcaatacatagacagcatgtatgcatgtatataaatggaaagtttctggaaggattaaactactagatgaaagttatctttagcgaatagggctgtggggaaggaatgagacaaggtgcaccttttatcataaccctctttgccctacatgacttttttactgtgtgcatcccgtagtccttcttattctctgtctcctccttttctcccaccatcactatcatcgtcattctctcagcaagccagtgcattttctgaagaactctagggacaaggttttatttgagccaaattgctcatagtgaatattctctgaatcaggctcctggaaaagttggtctacataattttgcaaattaggagtattttacaaatgctaagtatgacacttagaacatgagttctcagggtaatttgtgtcacataatattaccccatatcccagcatgctgggatggcctggactttgggtaccttttgtctgtcaaatactcttacttaggggtcatgcacagtggctcatgcctgtaatcttagcactgtgagaggctgaggtgagtggattgtgttggagcctggattttaagatcaatctgggctatatagtgagaccttgtcaccaaaaaaaaacaaaaaaaaacaaaaaaaacatagtagctgcgtatggtgggtgcatgccctagtcctagctacttgggaggctgtggagggaggatcacctgagctcaggagtttgcagctgcagtgaacaatgatgatgccactgcactccagcctgggtgatacagcaagaccttgtctcaaggaaaaaaaaaaaacacacatacacacaaaacaaatcaataaaaaaccccaccaaatactcttacttacattcttattgcaggttgccagaatggaagtttaataagtaggaaatgaataatattaataatataacaataagtattaagtcagcatatgacatatggtatggaaattctcttcaggttgaattcccgtttttagtctacctgcatctccctcatagaaaggagaggaagggaagaggtagtgagtctctgggtttggtcctcactggctttgcgctgggcccactcagagttcttggatctcaccttcctcaggatgtccagactcaagagcattcagttgtggtttgtccttatcatgcttggcttcttgaatgagtttgaaatcttgctatttttaacttgtaatttagaagattggaaaaggttttaatttttgtttgtttctttctttgcatatgtcatggtgagtcctttaatgaaagaaaagcctgaagagaatgtaactacttacctccctgaaaggcattttttcttaatgaatgtagagatttccacttccccccaggtacttcatgtgatgtactgtgcccctagttaattgcaagctgaagccaagctgactgacagtaaatcaagaaaatgatgtataaggcatgcccaattatagatggaatacattcatattaatggtatcccatggactatcaccctatgtccattgttaatctgtaatctgaaataattcaaatctctgtataattgggtttctgacagcaggatcccatccatcatactacatcttctcaaatattgagaatattgtcttttaaatatgtttgtatacatatacacatatatatatacatatataatgaaactgtgaaaaatacatcttcatttgataaaaaaaagtcaacaggcttataaagaataactttagcagcaaatgatgagtttattttaaaaataaattttgtaaatgtatggacctctaaaaataaaaatactaaaatttcttatatgtttattttccttaccaaatatgacagttatccacaagtggaacagattgtagttattgctgatcttatgtctgaaaaaccacatggatttgggggaaaaaaaagcatatggttatctattggtctacatagtttactgttgcatgggtagacagaagctttcagtaaaactaaagggaccttttctgatcaaaccctgtgtatggctgatatatgttctgccaatccagccttgtttgagtttaagggtgccttctggcctggggtcaatttctctgtgattggtttaatgtcatttgcccataagcatacattgcagggtgctgcccaagggcaagtgcacagcttaggtacatcatctcatttacaaatcaccatccggccatgtctatgagcactgagatatgaatcatcattatttatacactttagtcatatttgaagttcttcttactaaccctataaaactctcaaatgaattagaatcctcaaattcacataactatcctatccatttcctgtaggcagagccatatgcaaaactaacccattattgagaggtgcttggtaaacataggcacagaacagactctaatcacgtcttgtaaatctggggtccattataaataataaataaagttttattgaaacaccattatgcatattcattcatttactgtctgtgactattcttacattacaacaatagagttgagtggtaacaacagtgatctacagctgaaaaagctgaaaatgtttactatctggcctaggccagaaaactatactttctatcatgtgtccttgccgtgtaggcaggtgacttatggagaaatgggatgaaaaaaatggacatggtgagtcaatcatcagtagagttgaattgaaagaatgccattagttggagtcagagtcatggcaagagagagagagtgtaaggtaaagttgtgaggaagaagaaaccatgcattaagaagagaaacctggtcaggagacagaaggctgtacaacaacccagaaaaaacaaaacaaaacaaaacgaaaaaaaaagaaaaaaaaaaagagatgccataagatgagagaaagaaagagagaggcagagacagagactgagagactgatcatctggcatatggccctgaggcagagattagcttgttcctcaacttccctaggtttctgatagctgttcagttcacagacacatgcatgtaatgcccctgacctccaggacccccatctatggacagcaaggagctctttttgcaatcaaaagagagggaccaaaacagatcattatgtattgcgccataatgaggcaaatttatttctcttatttgtaagttcctatgggaatgactcccccattagatcacagtattgacgataagcatgaataagctaatttgggtagaaaagtcacttcatgtagtagaatgtaatgttgactgttaagatatctcatacatcatgaaattaaataagatttcccttttatttcatttgttcagccactcagtaaatattgaagacctattaagtataaagaagtgcaagacagcttgatggattagaacatgtatgtaacaaacccactcccagggaacatgtacaatcttgtatgaaagttgagacagatacactgatgactaccacacagagaaacctatggtaattaagtttgataattatttatagcagtcacattatgtactaaaacataaagaacataaggccattcaccatggctattgagatggatgaggctgagcctttgacgttggaagaacagtagcactgtacacaagaactgaggatcacttcttgccatcaagaccagggaagccatcatggaacatcgtgcagtgggcacaagagatagaatgcccattgcaacatcattggtaatagaaaaaaatgaaaatgtccataaggataataatgagtaaataactggcagtgtcattgtataggaaaataccatacagtaattgaaaggaatgaattagagctacatgaatctatattgatatatctaaagcctaatgttgagccaaaaataaaggtgcaaaaacatttttatagtgtgagacgaactatgcaatattttaaaacatggcaaccaatacttttatattacttagaccagcatacatatgttgtatagatttttttttaatgtttagacttggtagatactaggatagcttttaaatatggagggggaaaaagagaggaaaatgatattaaggaggcatatgcaggagtttctactgtatgtgaatatttaaatttttttaaaacctaagcctgcagaaatatagcaaaatgggagatgaatacatgggccttcattttttttttttttttaattctcagaggtcttctgtttgaaatatctcagaagaaaaaaaaagaaaagcctacgtgtgtttatgtggagacacattccaaagaagggacatgtggctggttatactcaaggtggttatgttcagttaatctaccaaactggatgatacgggtcaggacccagttttagttcagagatcctcagttttattgtgtgcttagtcgtattactcaaatgagtgaaattagcttttgatagagtcagggtaccacttcatgtgaccaaacaaatgcacgaagcctggagatggctgtgtttgagcacaggctttgtcctgctcgcagatgtgcaactgtgcatctatggacagcagtagagggcttctaagaacactggtggcaaatatgtcaggagtccctggccaatactgttgatgcgaagctaaggttctaaacagttttggatcacagcctctttcagaatctctacgtattttaaaaacctgtgaagcatgtccttaaacagacatgcacgtgtatgtgcacatatgcatgattacataaatttccacaagttcataaaccaaggggtttaagaaccttagttaggaaactcgtgtataggcacattaccttagataaatttggtcaaatcctccagtgaagataactaatggtgcagtttctgtgaaaacacacaggactctgaaaatggagctacggacccagtaaagagtttgtacaactcagtgagacttcctaaattcattgatttacatactctactaaccaccatcaatcttggcacacaaatgaccagaatatacagaatctatctttgctttatttgttttgtaatggttcttgaatgcttctttaaagaataaaactactggacatagaaaattcttcagcttgtacaatcatttaggatggtgtaattcagatgaagcattacacgtgaaaaggaaactcagtcagatgacaagcaaattcttggcatccaaccctgaccaccaatgcagaatatgactaaggaataacatttttagtaaaaggtcacagacaacatgaacttaacacattttattcacctggtggcaaatagaaatgaaatcccagaagcttggttccttgaataaatattgcagcaactgacacatccaaatatatttaatacaaacagtctctcattgcaagtgctatgttttttctgaccattacatatttttactcattatttacacagctaatgactgttttataatgttaaactcaaccttccatttttctgaaattatgtttatatagttattggtttgatggaataattaaaatgcacttatgtgagatataaactaagtttccttttcctgtcttgtttcttataatttaatctgtattaggtcattcaactagtaattgttattctaataatttcccctattttcttttctttgaactggctgactagctaaagtgtataaaaacagtgactcatagacatgcattttgaagtaaccaatataaataggtacattctggttatatcacattttagacaactgcttagtcaaatgaaatgcaaaaagaaaaacggaaagaaaactatttcaaataccttgaaatgtgtgcttcaagctgactttcagaataggtgcacatttatatagctatgtaaaaaagaaggggaaaaacacagaaattccaaaatattttcaaactggcttagacatcttgacactttactgttttcctctgccaggagagtaaatgagtggtttgccctctggggaaaaatccatttaaaagcgaaactattttaaatgcatacctttttacaagaaagaaaagaatagttcttagtagtgggggagtgggtaggatatatgtatatggaagggcacagtgaaatgtattagtatagggtcttgtttacttgtaagtattttcttcctttttgtcattcctcacacatttacatggttagcactggtgatacaaagaagaaagaaatattcctagccttcacgtggttttagtctaaagggagaacactcaggaaaaacagtgtgcatcaacctagagatgccatgagaatgaaatgtgcagtaactaatccatggaggagaggatggtcagagggggtcgtgtttaaattgggtcgattaaggttgcaaagggtcagcctattttaagagggcaggtgggaaggaataggaacagaggccaaatgcaggagataatattttgtaaactgttttgtaaatgataaattgtaccttctgtgtggaggtaaagtatgaggggagatttctgccttcttcctatcttgttcttatatatttgttcatatatttaacatagctacccccttatggtattataattacctgattaccttttaatctcatctgtgaagtccctaagtgtaggagcagtactttatccatctcttttccctagtgcctaacaggtccagacagctggtagatacaaaatgaagactcttttagttgaactgagtgaatgaaaggatggacagatggatgcatagatagatactctgtaattacaaagaaatgtacttgggctatgactccttcagtggaaaaaacaacatagcagaaaaaatgcaatacatggggtgtggtagaattgtaaaaatatttttactagaaatactcttggactttatgacaaattagaaattatttccttctatgcctggcccttccaaaatttcacattcatgcatacactagtatacttgttaaattgttggacaaaaatctccttcgatttagaagtctattatttcgttgagatgacagtttttaactagtaatgaaagttttccaatgaaaacactctaattttgcaatgtgtacctcaattttgtgaaaataaacggctgagtatactggaacaatcttaattctgttgaactccttaaaatgatattacatatcaaagagtacacctttaaactactaatggaggaaaatagaataactcaaggagagcaagcagacagctggaatttttgggaaatgtctgtggtatttgggtttatttttaagggaaagaaaaatttcccattaaattttataacacaataacacttttaaaacttatactcaaaaagaatctttataatgctgttgtaaaactcagattatattttattcatgaattacagatttcttttttgatgacggtggttagggtaagaagcggcttttataagctttatttatctcttttaattacctccttctcctgtctcaatgctcacacttacactcactttaaaaaatttttatctttcatgggatctatatctaaataacaccacatcatatgtaaattaagaaacattccaaatattctccgggacattgaaaggaaatcaagcaaaacattctgtaatgtgtaggcaactttaaaagtgcttgaggcagaagcaaaaaaaaaaaaaaaaagtgagagaaagaggctttctagcctgtgtcttttttagttagatgtttcagaagatgaagaaattttaattatgtgcttccttagagtgagatattaattcctctgaatcattctctccaattttgagtcccactctcatttttctctccctcttcttttctcctggtttttccccctccctctttaccttttctcctccctctttttcctccctcccctttccttctcccacaaaaagccagaattgcttggtggtaattccctagaattgagcaggattgaactgggggtcactctggctttgtactgttccctttcttatctaacctgaatatccttggatctgtaagactttttctgatccatatcacagcctttttctctcctcaccgttgccagtgggatttctcgtgggcttttggagaggtagaaggcatacttgtgaatgtcaaaagagctgtattcctgtatcctgtttcaaccctgaggagaggcactgtgctagtgaggaaagaacacccaatcctagtcaaaggactgagttcaattcagcctcacaagaggctctaagtatgatcttagacaaggaaacttcaggccccagttttcccatctagaaaatgagagtggttagaactatatcacactgaggattatgtgaatttatatatacgtatataaagccgtgcacccaaatgctgtttacagcattctgtgatgaattccctatttcagttggtaccatttattcacagacaatcacaggtattcagagattgtaagaattatggtagcaattgcttactatagtttgtttattccataagagtggctttcatttttttttaaaaaagagacctctcccttggattttcgttataatatgtttcacttgccacattttctgaatttttccatgtcttgaagcctttgtgatggtgtttcataatcaacctgcaggttgtcagaatcagtggagcatgccatttactgcttgtcttagatacactcaatgattctttctttcctgagtgcttcaagttttggctttaaagatcctcctttgttttaatagattttccattagtgtctgcttatgtaattttatctccatttctaattgtgaaatttgttgcatagatgtaaattttctttcagtattattcagagagaagataatggttgatacccaaaagaggaagctaaaaatgccttttaaaattcttactatattttggtgatttttaccaatgacattattgtatagttgtggtcattataccgttcattaaaaatatttatttgaaattactgcatgaatgccaatctctgaataacatctttgcaaatatagcatgttattttgtcagtccaaatgtgtgctaaatactaattcatgttgttaaatgtggatataaaaatagttaattctcttgctaaggatactcatttatcaaagtaaagtaacattttaatatttttcaagacaactatttttaaatatttattagagaaactgttctaggagaaaaattaagataaggtattatgtattttactctgttatggacacatacatatttggatatcagatagtttcatatcaaattacatatctttgtactcaataaatattagaaaaactgtttactcatctgtaaaatataaataatagcatcttctcattgagttactttgaaaataaataaaaataatacctatgtacaggacttaacctagtgtctaccataatgtaagcacataatgaatacttgatactgtgattgagtacatgctatgactataacccagaataagacaataggaacataaaaatagaaatgatcatcattttagataggggaaaacagaagggaaatacagagaaatgacatcattgtgtttgagaccatatggtatcagaattggaatagaaggaaactggagttgggggagggaactggaagagtgttgggggtttgggaatgaagaggtgatactaagttgtgtttgggaatatattggatttaaagtgatagaaagtaattgtagtgaagatggactgtagtcatctcatgaattggaccagaactttaacattgttcatttagttttccaagagatatttactgtgggccgatactatgtgctagatactgtgcattggtacagtaaccaaggtacagtaaaccaaggatggaaatacataaatttgtgagtcggttttctgagtgaaagttagaaataaggaacaatgtactaggcatgaagtgttggttagtgattacaaataggagaggagaaaagaaaagtccccaatgacacaagactagaggctgaagacatatcaagagagtgctgcacgaggggagaagacaactttaagacattgtgatttccagaagaatcacttttatataaattgaatgctttctagagcttaagatcattcttatatgtttcagtaacagaaaatgaagataaagatagattattcttggctttttacctatttacacatgaaaatgattacatacatctacttattctagtgtgatattattttcattaaaataaaggtattgaaggaattgttcaatgaacaaagaaaactgtacttttgactaaattgtaattaagtatgcttgaacatttttaaatgcttagttctgtaattttctgcacaacatgtagtaaaccagacatatttccaataaacactgcttaccttctttttgtttccatgtttaatagccaaggtctgtctgtctttctttctttctttctttctttctttctttctttctttctttctttctttctttctttctttctttctgtttttctttctttctctcagaaaagaaaaaacaagccttggattcttgtttcagtagctatgtgcaaacaaaatggaaaaaaaaaaaacagagaaaaatcctccacaataaatcgtaatggacatataatctgtataacacaaaacttagtcaccaaaggatacttgaaatgctgctagatcagttcaaatcagcaaatatgtattgacttcccattttttagcactatgttaggtgctacagaccacaagctcacagtcttcaaattaaggagacagttatataaatgatataaaggagaatctgtccatcacagtgagacatccaaatggctatgaagattccaaggagagacagagcatctggttgagagagagcaagaagaaattcctagagaaagtggaattagagaggaacggggagtaagaaatgagagtaatgccaggctccggatgaggaacaacatgggcaaagacatggagacaagcttggtgtgtggtgttcctaggaaattattgtcctgttgactgaagaaaaagggacataaaagtggaagactgataggagatttggatagagaggaatatgtcgggacatactgtgagtgctatcatgaggaaattcggattgattcaataggcaatgaagagccattaatggattttgagtaggggaataacattactggagcagcaatttagaagactgatttgacaccaatgcatagtatattctggaatgaagacaaatggcaattggagaaactggctgggaacttattgttatagtttagcagttaatgaaagtctgaaccagcatggaatgaaaatgaaagaatctatatatgggtcttccaagatgcagatattcaggaacattccatacatccaaagtttacatctgtatagtattttaaatttccatttgccctcagatatttggcacagatctgagagtaaccttattggcacaggtgattctcagctgcagagtaccacttttgtctgtattaatggtgtcttctcttctttacaaggccaccaaagtggatgcataattaaaatttgttgctgtttctactctacttgtcctggacgctcatgcagccaaatttcactggggacccaggaccacacaaaacagtatggtgttatgaactggttgccccaggagttttagaaagtcttcttaattactttaaaaaggcagcagctctcctcacccactgtaacttgaacgttgcatgtttggcctctaggatcagtcctcaaatgcatctctacctagtattccatcaggagcaattggtatatttgaaaatgtattgctttatttaattttcatgaagctcagtttcccacatagtaaagacaataatctctgagcaaaaataatttcagttattcttatcacattgtctattcatctattatatctttgcaatattaaaatgcatttaattataataaaacatttaacacaagtaactggaaaacaaaaatctttctcaactgattattcttagtcttgcttttatctcccttttacctaataaaagcaaatttagttttcttcatttatgaatccaataaacatcatagactcaacttcctgatatttatgctctatgagggtttctccaccacacaaatttatgtccactgagagcatcttatctctggctctgacacttttggcctggaactaatcactgccattgaccattgcatctgggatgcattagactctgtccctaggtgcttcaagattttattgtacaacaccatttaacaaattattttattaataacccaaaccctgtgaatcaaggtacattttaaagcctaataaaattatggtttgggaggccaaggtgggaggatcacttgaagccaggagtttgagaccaatctgagcagcacagtgagactccatctctgcaaaaataaaaaatagaaaacattagttgggcgtggtggtgaatgtctatagtcgtagctactcaagagattgaggcaagaggatagtttgagcccaggagcttgaggttatggtgaattatgattgcaccactgcactccagcctgaatggcagagcaagaccctgcctctaaaactaaaataaatggaaataaaataagatagaaaataaaattaaaatgatggcatgggagaccactcacatttcacaaatttgttttagcctctacacaaatactagtaattaaatcatattttttaaattgtaagatttagaaatgtggatatgattttccatatgtaagagaatcacaattttttctcatcctctataaaaattcatcccctgattaattcacccagttgacaaatagatactttttcaatgaaatatatttaagtattatagtgcactttctcagaccgcaagaggttatttattttacttctgaaggttttgaagtttgcctcatagactgtaagtgcctaaggaaagaaacagggtcttgttcacctgcagtggttcctgggagatgctcagaagtttactcagagttgcataatgtgccaagactataaaatttttttcctcaaactaaagcctttgtagatagaaatctatagcttatttgcaaatgatgctatgctatgttatagttacagcttttatatttgtcgaacttgtataattgttacaattttataagagaatttaatgcagcctataaagcaacattagtttatctttgatattcccaaatctacctattctcacttgttattcgtactttgtgacttctccaacctcacttttcttgggaaggtccacagaatctgatgcattgaggccacattaagatgtaaatgattaccagacttctgaaatatttgcatttttatccacaacttagattcaagtgagtcatagctatgttttgtattctgggcatctgcaggccaggaagtatgatgggcagcccaagaagttctcctgaaactcttgaaatccttcccttttgggcttagaacattgataaagattcagtctgaattccaaaatgtctgttttgagagaataaatgcccaggaagaccctttgaaaataaaatgggtttgttctacaaattagatatttatgtatgtcaagttaaatagttaattacttcatttttggtgatgtgtaaagaatttaattttatttattttttatttatttttttgagacggggtcttgctctgtcacccaggctggagtgcagtggcatggtcttggctcactgcaacctctgcctcccagattcaagcgattctcttgcctcagcctcccaagtagctgggattacaggcgcccaccaccatgcccagctaatttttatattttttgtagagatggggtttcatcatgttggccaggctggtcccaaactcctgacctcaagtgatccacctgcctcagcctcccaaagtgctgggattaaaggatatatatatatatatatattttttttttttttttttttgagacagggtcttgctctgtcagccaggctggagtgcagtggcacgatctcaccttactgcaacctccgtctctcgggctcaagcaattctcctgactcagcctcccaagtagctgggattataggcatgtgccaccatgcccggtaacttttgtatttttcgtagagacggggtttcaccatgttaaccaggctgatctcgaactcctgaactcaggtaatccacctgcctcagccttccaaagtgctgggattacaggcatgagccacctcgcccagcctacccaaatatatttcatgatacacatttcttagaatcatgaatttttttacagttgttcatggctttaaaaattaatgtgagatttctaagcatatttagaatccagacatttccaaagtgtgctatacatacagcttagcagttaggcggatattgtaaggattttttaaacgtctccattaatgggaaagattagtttacctacatttaagattgccttcttgcaactttccatctctcatttgagccttattctgcacaatataatttaatcaatagtaatccacttttaaatttccacccatatctctcctcttgtttatccaactgtcttattaatatttccaaggatggctatagacatttctgcctgaatatgcacaaagccaacttcctgtttgtcctcatcccctcattccaaacttgctcctgtataatcatcctcatctatgtatcttgccacacccaactccatttttctagccactcagacaaaaacaacccaacaaaaaggcaaacaaacaaccatctatcttagttcattcgtgctgtcataacaaaataccatagactggataatttataaataatacaaatttatttctcagatttctggaagctgggaagtccaagatcagaacaccagcaaatttggtgtctggtgagggctactctttgcttccaagatggtgccttgttacagcgtcctctgaagggaactaatgctgtgtcctcacgtggaagaaggaatggaagggcaaaaaagggattagggtgctcctttcaacctctttcataaggtcactgaatcttttcttgagggctttgccctcatgacttaattacctccaaaaggccttgccacttggtattatcacttaggagacggattgtcaatatataaatttggagggatacatttagaacataacatcccctcggtcccccataaaaagcaaaattttgaattatcttgtccatttttttcttttcgaaaatgccatgtccaattgataaaataatccttcatgatatctctatagctgttccacttctaaccaccttctccactttcatcttagtagtttctgcagtggctgcttacggagtttcctacttccgttcttgtcccttgtgggctgttttcaacactgaagccagggcaaaccttttaaaacctaagccaggtcatatatttcctctgttgaggatgtttatgcagtattactgaagtgttatgaatattattaataatagtataagctaatgtgtgttgatcacttactgtgtagcggagcctgtgctaaaatagtacaagccaattctcattttatccccaccacaacctcttattattcctattttacgcatgagaaactgagctatagaaagattgaacaatttctcaagatcacttaaattatgaggtggcagagctatctttgagcttaagctgtcagattctagagcgcggacatgaaaaaactaagctcaacgttctctcctttctttgtaactgtttaacctcttaacatggtatactcaaagtctgtctgataatccctttttatcaatgaaaaggccaacaataacatgtgccatattttgaaggacagctttgtaatgaagtttcttagcatcctgtttcttaagaagtagttagcagtacactgagtaaataccaaatatttctcttgacattgatggtcccagcagcatttcagtgtcccggagcaactcctactaagttttaaagtttatcttgcacttcactcctcattaaaattctactattgatgtcctattttgacttttaatcataatttgtccttttaaaatcgttgctcattcaggcaataagtgagtataagtaataaatgctgttttcagaaaattgcattaataaattctgttcttcatgagaactaacaggtactaaaatgaatgtaattgtagataaagaagaatttgttcagttgtgaagtggtactgtgttttatcagactagtaatgatggccggaaccaaagttattataacctaaatattggcatataataaaaagtactcttttaaaatttatagaggtctcgtgtgtaggtgacaaaatttttaaaatcatactttttttcataaagtttaaacaaatataaatttcatccactacccagttttaaaatatttattattttccaatatttcagatattcatgtctaaatcattttccaaaggaaactcattttatatatatatagatatttaaccctcttgtcgagaactgagccactaatgtgttatttaatacttattttcttagaaatgtaatattctatgtaattattatttatatgtaagttataataacacattgagaatttaccaaatggagtacaacataatattgacatgagtttctatcttaaagtatttctaaaactatctccatagtttttctttagtcctatcatgcaggcttatcagcttacttagcatgatgactgtttcacaattatacaattaataaaaagtgaatgccttccttgaggtacaggaggtactctagaaaaatatgttaacccaccatccataatattctccaattactgtaacataattgagaatacatagaagattttttttccccataggagtaagtttcttaccatatgttttccatttattcagcctgacttttttagtattgatgtaggcttggaaatgtttttactattgccctgcattttccatgacacacacccaatatgtatcactagagtgtagtgattagatgagatttagagacatgaagattggtatttaaaggctgcctgtgacttaactagtttcgttggcttgttatttggtcagtttatttaatctccctatgcttgttcttcatgggttcatatatgtaaagcatttagcatacaatggtgcataatggaccatttttctgcatttacagcatctcatcaatgggctagaataagcttctttaaatgaaaaactggactgtttccaaattatttatttatgtttagccatcacagcacccaatagagtgtcacattcaaaatgaacttatgtgatagaggtggcgcagtgctcatgctttcccatacaacccatcttttttcatgcagtgcttggttcatattttcttccttctcctaaacctctttttggcataatctttcttcttatttctttcctcatctgatgcataactgtttccctatttagaaagcaatctttattattacttcttttcctctcagcacatttatatcttaaaccttattttttggtgcagctgaggagaataaattctattgccatgtaagcacatttacttcagtcacaatttatccttaatatttttaatgatcaaaagtactagccatgaaaaataggtattttatgtcctaggaataagaggaaaaataaataaaattttgtactttccttgtatagtaaaatatctgtggcttgtttctttttaattctctctagccaatcagaaatgtggtgatgatatgataacataaataacttttgtctggaatgtttttattgaaaagcagatgtgaatcagctactagacagatatcattacaccatgcccatgagagacaaaaaagaaattaaaaattaaataatattcacaaatagctaaactaaagcaagtaaaacatcaaaaactcaggttaacttggaaataacttttttttttttacaatacctaagtaatatttttcttttccctttagaaaggctcctgacattgtttagcaaatacaatattgtggccaacttaagaactaaatcactgttcatctttttaggagattgctttgttgtgttactgttttgttttgtttaagctgccctaattattagtaagagaaaaacaaggctattttgagagctacaaatatgcatcatacaaatataatgatctagaataattgctgattaataaataaaccgcatttattgcttatactcactgatactactttctatgcatatcagtgagtgtatgttgctcttttaaaaaccttccaagataaaatattttaaaggtcttccagaaaactcattcctgatacaatagtatttgcttgagaattaaaataatcctgtttctcaagaacagaaaaccgaacactgcatgttctctcttgtaagtgggagtagaacaatgagaacacgtggacatagggaggggaacattacacaccggggactgtcagggggttgggggctagggaagggatagcattagtagaaatacctaatgtaggtgatgggtgcagcaaaccaccatggcacgggtatacctatgtaacaaacctgcacgttctgcacatgtatcccagaacttaaatataattttaaaaaatcgtgtttctaaggaggcctaaagtttcattttattaaggtctgtcaaggatgtaaagcattaaatactgcaattataattatatttggtaatcatatttggtattttgccccctacaaggttgactgagactaaactagtcttcctaagagtgagtacaccaaaaatttaggtaacaacctggttaccttaattgctgcttaaaattagttcttaggaagtcacacttctctaaaattaaatgaagttttttaaaaagtaatattcagattttggttataagtataaagctgtaagtcgagaataaatctgaaattggcataatttatgctatgtccaaaagatcccaaatacaagttcccaaaaaaggaaattaaagtttaggaacatgacctaagtatagtgctttcccattaaagtttggagcttttaaaatgcattcttcaattccaaaataagactctttcaaaggcacttctttttcaaattttatggtgtgaaacacaaaatatattctttaaaaaaaaaagtacttctagtgttctcaaccattctttatatgtgcgttgacagtgtgtcctccgctttaaatcttcaagtatattatctgtactcactttggctacctattttcagaccatccagtttcagattttgtttggaaatacttctctggaccatcaccctactccccagagtttctaattctaactcatgaccttgtttccttcctccctcttcaacctgttacaatttcctaaatactttgcacatttacctgtaaaagctactgacttcaaaaggactttaaacattattccaaagtgctagtggacatggaatacaggagtgaacagaaagtgttaggaggggatgtagataatgaatcctatgtgatagggaagtgcaagaaaggagtgagagttggagtctaaagttaatacaaaaaaggaaaagttcacacagttaaatttattcctgaaatctctcaaaacgtcgggttccttgacaaataacaaaatgtattctaacaacacagtttgtattaatgaaatataattttagtaaatattatttggaaatcaggccgggtgcggtggctcatccctgtaatcccagcacgttgggaggctgaggcaggcaggtcacttgaggtcaggagtttgaaaccagcctggccaacatggtaaagccctgtctctactagaaaaaacaaaaattaactgggtatggtggcacatgtctgaaatcccagctactcaggaggctgaggcaggagagtcccttgaacctgggaggcagagcttgcaatgagctgagatcgtacccactgcactccagcctgggcaacagagcaagactctgtctcaagaaaaacaaacaaacaaacaaacaaacaaacaaaaaacacaaaagctatataagagaagcagggaaaataaactgagctcatgaaatgacagtttgagaaagtaatatcatcaaatgactcgaggtaaggccatcactcaaaggaatttcattgggataatgtgagttaaataaatacaaaagaaataggacattattcaaaactgttactgtcatttttaccattaaatgtaattgtcattaatctcataaatctcccctattgaattcccgataacaaagtaattagctacatagacattttatcaactacgtaggcagactgtagtttacaagtacaaatatatttttgcgtaaaagcattgtttttgagaataaaataaagccttcaaaattatgtaactgcctgggtgtggtgtctcacgcctgtaatcccagcactttgggaggccacggtaggtgtatcacttgaggttcagagttggagaccagcctggccaacgtggtgaaaccctgtctctgctaaaaatacaaaaattagccaggcatggtggtgcacgcctgtagtcccagctactcagtagtctgaggcaagaaaatcacttgaacctgggagacagaggctgcagtgagccaagatcatgccacctccagcctggacgacagagtaataccctgtcaaaaaaaaaaaaaaaaaaatctcagttttaagactgtgagttgaggataaaacccatttgtgtaatatggcgttttaaaagtaagtaccagagtctaaatctattgtcatcatttaaatccacccaagatttgccaagaatttctgaaaagaaaatcaaaagcatcctggtaaacttctaactagttctgtatggattattcacgttatagattggccattacataagaaacaacttcccaaatcaggactcacatgggggcattagaagcacagtctctgcccaaagcaaccagactacttcctttctttccatataactatatttttcatggatagtctctgttttcaaatttccacttgtttaccctcgttggcacagatcataaagagttgccgcatgagggtgattatagggtgccagaagttatataacgcacactctgttgtctttgaggtaatagccttaggaggccacaccactgctatattatattacagggtggctatttcttaacctctttggaattgactcagaatctcttaatgaactacataggaattttagtcattatttggcttctggtcatgaataaaattaccccaaacctgttacccaccttactcactactcttggcttctcatgacctcatatttgtttccgtaatcagaataataggaaacaattctaaaccaggagttctataaacgggttcagctgtgggagtaaaataggagtaatttcatagcttctccgtataattgcactgtatctgtaagagtagaagacgtcaatcttaaaagatttgaggaggttatttccacacattaaaaggtaaagttaaatatcattcatttttcagaggtaaataatgataaataaagagagatatacatcacgatattaaaaaggactttaatgttataatttaaaaagtctctaaacttgtattcattttagtggtgtataaaaggaaaataacaactggaataaatttacatattgatttgtggagaagtcacatcttatcccaaaatcatgacattatcgattaatcaatatcactatcgtaaaactgaatgacttaaaaatgaaagagcatttaatatttttcgccaaatttaataggctaagtggtttactttaaactctgttttgaatcaatttagattcgtaagtttgaatctcatctgtgcctttaaaaaattatttaatttctttttaaatgacttaatgtattgaaattatacctaatggctaatttgtaatgaaattattcaaaatacttacaaaatttactctaaagtgatctgaaatacagatttatttattgaatgttaacatgaagttttgagaaatatgttaataatgtactaaagtaaaatgctagtattttattatgaacgtttacacttaaaaaccttgagagtgcattatcataaaattcacaataaagtgtaaagtccagtaagaaacttattaagtatattcatgatataatggtgaactaactcctagggttccaactaaatgtgcaattagtaggttatggtttccatcttttacaattacatgttccattgtttatagatatactacaataaacattcctaaaatactggtcatgataaattagcaaagaaatcaattgaacaacttttaaaagatgtgtgctactataactttagcaaatattcattaggaaataaatgaaatatttttttttttcaaagaagatgtgagaaacagcttctgataagaaatgtctggtgtctgctgctactctcctaccactctgtcctcacatctgttttcagttgcctttacaacaaatctttaggctagctcagctcaaaaattggatctcatcaagcaaggggagtggaatgggcttgatctattaaattaaggcagccaccaaagatgacttaagcctcacctctgtctctgctctagagttaggcaccattaagcctcctattgtacttgtgttgatcactcagattcgtatcccgacttcaccctgcattgccctatccaggggaattcaggcctttgcctttttttgttttgaaagctgacagttcaggaataagaaaattgaaaatcaccattagataaatattatagaaatagttattgatagcaagatctacccgtgggtattaaaataagtggataagagatgaaggagacataggatatttatattgtctcaaagtatttcacccaagatatttattaattacgaagaaaaagatagtcactttacagtgaaaaaatcaagcaggtaccagttgatgattcggttaatgtcaacagtaacaggatacatgtatatcaaatggttgaggttaatatcaacagtaataaaatatatccatattatgtttcctaatgtaatagtaatagggcatattgaaatgatgtatccctatatgatggtattcatgttaacaatgcataatcttaatctaatgagaaaatatcagatgagtgcaagctgagaaacattttacaaaataactgaccaataatcttcaaaaatttcaaggtcatgaaaggcaaggaaagaccaagagactatcacacactggaggagattaaggagatatgacgaacaattacaatgtgggatcttggtttggatcttggaacagaataaggactttattgaaaaaaccttgaaattcaaataaaatttgtagttagttaatactataataatattaattccttggttttgataaatgtactatgattatataagaagttgatattgggaaggctggggaaagtgtatagaaactctcctatacacgatagtacagggtgtacaatttttgcctctttttctataattcttaataagttcaaaattttaaaagttatttcttaaaaaaggaaagttgacagcccaaatcaatataattcaactgcattgactaaacataattactgagcatcaactctgtgttaagcattgcagaggatacaatgatgagaaaacggaatttctgccttcaaacaatttacagtttggtgagagcaatgaaataaattaaggtagctatatgagagttggcacaaagaggacagaaatgacctcctgttgggactctgtgtgtgtgtgtgtgttttgggtgaggtggtagatttagaaaagtttttttgtgagcataacatgaactagaacttgattactccaggtgtaaccagaacttggttactccaggtgattcattagtagatgtcttggtcaggtcaggctgccataacaaaattccatagactggatggcttaaacaatggaaacctcacagttctggaggctggaagtttcagatcttggtgctggctgatgtggttactggggaggccctctttctgggagctcatgtgctctctccccaccatgtgagaacatggcaagaaggcagccacctacaaaccagaaagagggcctcctcagtaaccacatcagccagcaccaagatctgaaacttccagccttcttagaaggacattagtcctattggattatggccaggccctaaagaccttctttaaccttaattaccttcatacaggccctgttttcaaatatacttattggggatatggacttcaatgtatgaattatggagggacacacacatttagtctgtgacattccacccctggccccccaaaatgtatgtccttttttagtgcaaaatgcattcattccatcctatcgccccaaaagtcttaatgcatcaagcatcaactctaaagtctaaattctaaaatctcatctaaatattatttaagtcagatggatgagactcaaggtatgattcatcatgaggcaaaattcctctccagctgtgaacctgtgaaacccgacaagctaatgggcttccaaaatacaatgatgagacagttataggatagacgttcccatcacaaaagggaaaaatcggaaggaatgaaggggtgatggatcccgaacaagtcaaacttagcaaggcaaatttccattcaatcttaaggttggagaataattgtctttggcttgaataatcctctttgccttgaataatcctcattgactttccaggcctggggttggcagcatcactgccacagctctgcagggtggccccaccttgtgggtctctgaggcagctccactctctgaaaccaagcaggaaagagccttacccacctgtcttcccctccccttgggcctgtggtgggagtggcagttctgatcatctctgaattgctttcagagtcattcttccctttctttgaagactagttcgtgttcatagacaaagagctctatggtctggtcctgtagaacccaagaagttcgacagccttctgttattccatcccattttctgtctcccctatttttcaaactggcagagtctctgctggtgtaatcctactcctggctgtgctgagatggctgattacattcatgaattgcacctatgctctctatcaagcagttgttcagccatacccttaatgcttagttgcttagtgttctcttcaaaacaaactttctttccttttttttttttttttggaatgtggatgggctgagaaatttccaaatctctcagttctggttcctttatacttaacagttccttcttccattcatctctttcctcttgaatttgactataagcagtgagaaccaaagctacacgtttaatactctgctgagtgtccagttttattgctcacaattcctgctttctacaaaacactaaaggacaattcaggcaaggtctttgccactttataacaaggatcaactttcctctaagttttaatcagctgttcctcatttccatctgggccctcatcagaatgacctttaacgtccatatttttgctaacattcagtttataattatgtatgtattcactaagaagatgaaagccttctctccagctctcctcttttctttgtgagctttcaccagtgttgcctttaatgttcatatttctacctatgctctcttaatggcaatcttagctttttctagcatgtacctccagctcttgcagcctctacccatcactgagttccaaaaccactttagaacttttagggtttttgttttttttgtttttaggtacttttttacagctttaccccacttcttaatcccaaaatctgtcataatcagttcaggctgccataataaaatgccatagtggtattaaacaacagaataagtaacttaaacgacatgaatttattttctcacagttctggatgctagaagtcccagagtgaggtgccagccagttcggttcttggctttcttcctggctgtagacagacaccttcttgctgtgtgctcctgtggtggagagagacagtatgagatctctcgtgtctcttcttataaggacatgaatcttataggatcagagcccaactcttacattcttgtttaaccttacttacctcaataggtaaggacataagacataaacaaggacataagagtggggttctgatcctataggtcagatcctgtagacccggtagggtcttcaaaggccctatctctaaatagttatattgggggttggatattcaatattcaaaacactagagcacaattcaggcaagttctttgccaccttataacaaggatcaccttttctccaagtttttataacctgctgctcatttccatctgggtcctcatccaaatgacctttaacgcccgtatttctaccaacattcagttcacgattgtttagtattcactaagaagatgaaagcgttctctcaggccttctcccttttcttttggagctctcagatttgagggattttgaggggatacaacattaagttaataagagtagacagcctttactttgggaaaactgaatgagtcacttgctcaggagaaaggaatagggatactgatgagtttcatggggagtctacagtgagggcttatagggctgtgtggaaggcgtagatgtgtttattgtcagaatagccagaaggatttctcatagttatgctactagcattttgataaagtctcagtaattgcaactactgaggttttcataaactttattccaaaccacatacctttgtggtttttacttgagtcttgttttctagagagacaagataatgacaatgaacacatttttattcatcactttaaacttgtgctgcctcttgggcttaaattttctaatattatttatttaagaaaaagcaccaattttatacagaatgtaatactttcatctttatacatgacaaagtattaggattatcaaaaatgtaaccatgacaacaggcttccttgcaacctagttcatgatagcagagtacatgggcatgcagattcttggcaggaaatattttttggtggtatatgtatacacatagatatacataaatatacacatatatatcaccagaaatttttttttttcttttttgagatggagtctcgctctgtcacccaggctggagtgcagtggcacgatctcggctcactgcgagctccacctcccaggttcacaccattctcctgcctcagcctcccaagtagccaggactacaggcacccgccaccacgcctggctaattttttgtatttttagtagagacagggtttcaccgtgttagccaggatggtctcaatcttctgacctcatgatccgcccgcctcggcctcccaaagtgctgggattacaggcatgagccacgacgcctggcctaattttttttttttttttgagacagagtctactctatcaccctggctggagtgcagtgacatgatctcagctcattgcaacctctgcctcccaagttcaaggtatcctcatgcctcagcctcccaagtccaggaccacgcctggctaatttttgtaatttttgtagagacggagtttcgccatgttgggcagacttgtctcaaactcctgacctcgagtgatccacgcatctctgcctcccaaagtgatgggattacaggggtgagccactgcgcccagccttcaccagaaaattttatatgtatataaacatagagtaagcattttttaatagaagaaagttaaaaagacacactaagatccactaagattatttcatagacataagtagacagcctagtgtttttaaaaataaaagtatataagttttggtgtcagaagtcctagtttccgatacagtctttggcactttctggctatatatgctttggaaagtgacaacctcctggggcttcaatttcctcatctgaggaaaatggaagctttatcccctgccgtacctaccttacaaaattgtcagaatcagaagacgtcatgcccaagaaaggactttgtaaagtattgatttcactcattatttcattactataatagtggtaattttctaatatttatcactttcatttcataactaaagatgataggaaaaatctagaagtatcagagttagcataaaaaatgataggaatgataaaaagcacttgtgaaaagatttgagtgatttgtagtgattatgcatgagaaagagaaggctagtaggtaatccaataattgtcttaaagcacttgaaaactactccagtgagctaatactgatgaccagactaggagagttcagcatgagttatttaggctaactaaaccaaataactttccagtagtgaggttactacaaagtagaattggcctctggggaggctgtggaatcccatttgtgacagctgtcccattgcctggggatagctaacctccagtcttgcctggagtcaaggactgttaactccatagactcagggctcccaccccttcagctttgtgctctgtgcctccgtatggatctagggtgttgggttagtgggcaagggaacttcttattttcctggtcataattgtttacttacagaagaagaagcaagcagttgaaagacacaccctaaatatataatgcatcaagtgtattttcttccttgaaatacactttacttttccttggaaagtaaaatgtccaatttttattttaaaatattggaaacaatattgtttactgagtatagtaaacaacagaacatacttctttccaaggttattttcatttaaagtgattgagatgtgaaagaagacaagaaaaaagaggtagactaggaagagaggggcaaagggaaggagtctggagtgtagggattcagacaggcaaaggcagtgacccatggggaggagtggaggaggcgaagaggtaaggcaaggaaggaggacgtggagtgggaatattttaggtttagtaaagggtacaccccactcttcctttggactgtggaaattggcattgttatcctttatcctctgctttcaaagagttagttagctggttaatcactatgttcacatcttcaactatctgatacctttactttggtccattacttgagagggtcaccagattggacaatagaagttattttctatgctttggtagcagtgacaaagccgttttattcagattaaattgaaccaaatgttctcaaactagaagttctccacttcaactgtatggagaggataacgtgaatcaacttttttatttctagaatttcaaccagtattagtataatacgttactctaaaagcattgcttcattatttgttatattataataaaaaattgtcttataagctacatttctagccttaaagacttaaaaattgagactgtaccgtgaatagtaagtgtcactgtggatcctttttggaaacaggagaagaaaatatctatctgtatgtctgcctatctgtctatctatctgtccatcatccaatgttttgatttttttttttggagaaattatttcccatttttccaaagccttggtaatacttagagttaaatttcttaactagattaattgcagaatggattcaagagatgctaaatggagatccttaagaaagtgggctatatattgtgtacagtgcacattgctcaggtgacaggtacaacaaaacctcagaaatcaccactaaagaacttactgtacccctaaaactgttgaaataaaaatttaaaattaaaaaaatatttttaagttaaaaaaaagagaccgggtatggcggctcacacgtgtaatcccagcactttgggaggccgaggcaggcagatcacttgagctcagggctcgtgaccagcctggccaacgtggtgaaaccccgtctctactaaaaatacaaaaattagccagttgctgtagcatgtgcctgtagccccagccactcgggaggctgaggcacgagaattgcttgaacctgggaggcagaggttgcagtgagctgagatcgcgtcactgcattccagcctgagtgacagggtgagatcctgtctctaaataaataaataaataaataaagtttaaaaacaaagaaagtgggagtaagtgtggcaaattatctttgatcatctaactaaggctttgctatcaactaattttgatcttccacttcagagaatagttctattttattattcagtgaataagtatgtgtgtgggcctaactgcatggatgctatagatctcttactttaagtaatgtagttattacataaagactgctttgtagaaagttatttgctaagttgcactttagatttttcattacgtaaggcactgtagttcagtctttaaaaaattcagtagttattttttgctttgctcaggtctttttgaggcaaacaaaaccaaccaaccataaaacaaacaaaaaaattttctctggttgtatttcccaaaagacttatatattggtacctggggaccactcagttttcaaaactgagtatccaaagctgtcttgaggacacataaggcttagtagtcatgaacatatttgttatcaagttaattatactttctatccaagggacttctaaggaactgcaaaattgtcatctattgtaaaggaaattttaattcccagggaaaattagagaaagaggtttaaattgttctaatttatcttggaattgaagtaatatttaaattaaaacattgtgcttctgaattctattgtggaaaaccagtctttgcctagggcccactgatttcaattttcagttctgcccctggtgtctgcccctactttgtcttgcagtcttgcatcttaccagacaaacaatctgagattaaccatcagtagttaagattgagtgactggacaatagcgataactgccagtgagataataactgaactttcttggcatgcttctcataccagctttctgaaggtatgtgtgacagttttccagaatgactcccagtgaaactttgtttttgtggaattcatggcccttatttcactctagattcttttaaactaagccttagggttttatattcctgtagccttataccattaatatttagaaggattttccagtgatttatgagatgggagcattggcttagaaaaattgatccattttagaattgagggagtaaatcactgaacattttaacctagtttactagacagtctctttcttttgtttttaaatatatccattctgaatcttatattgattttgaaactggttattgctcctatgtaactgtttaagtaaattcagagcactgtatctttggagatacaattattataggatttaatttcattaactcttgcaaagacctttggacttttgaggttacaaaagcagtgtttttggataatgggaggtaactaacctgacttgatctactgcacatcctatttcgtacttcatgaaaaagactgggtattctctactcttatcttgaacacaaagacacatcagcatgcacatcagcatgtgagctaggaatgggagaagtgtgtgggaatgtaatgtatctgaaagaatggaaaattttgtctttctctccctttttcttggattatttaaattttttatgtcacaaagcagcagaataaaatttccatcataaagtattttactctattataacctcaattttactgagtcagaatatgctcagggctgacacaggagggagaagatgtttccgttgtatggtaagtctgagaagaagcagattggtgtctctgttcccagtttttgaagtgaatttctggagtaagcatcctaaattgagaaagaacataaatatttctgtatggaaatgttagaaaacaagattctggtaattagtatgaaattttactattcatccctttagattgtcgtggttgcattaattgaccaacattgctttttaaaaatgctgtcacttctccttgtttatatctatttttgcttttttccatacatttgacattttctttaaaatctgggcatataaaatgctgattaaaaatatttttatgtggagttgaaatcaatgtgtcaagattcttcattgtattttccttcaaaaaaggctgctgtaacataggaccaaatgttaagggtgcttgctggcataactccaaagcagtgtttttggataacaggagtctttaattcttaggtataattgatatttttagttagtacttttttcagctttgtttttggtttgatttggggtatatgtatgtatgtatgtttctataacaagttttgaatttttttgaagacttatcttcttaggccaccaaagcaaattagttcagtaattatagtctcagtttaccttgtttccctctcagtgggtcaaccaaaaccgcatggcgtactactctctgaagcctctactaccctgctcctccgtgttgacatgtggtcaggcaagccaggacttactcacatcagctacatcagttactggggtaagaaactctgggcttttcagatactgtcctccagaaacaccagcaccagcctttgggtttaagatcacctggtgagattgattatctttagggaatggtgcagatgggatagtttctagacaatttgggaacctcagaaatgggagtacttatattagaatgacataaaataactttttgccccagggatcttgcagtaaagattatcatcacagttggccataccatgaacttttctaagttatttaaatttaccttgaaatgttatcagtgtctgctgtcacagagaataaatgtatctggtattaacattttactcatgcttgccttgcctttactaaatcttatcttgtaattgaagaacttgactatttttaattctgaatacaatatgcctcagaataaggttttaagctttaggtaaggtaaagtttaactttagtttgtatctgtgacacctaacacaatactaaggaattcaactgaatgagaaatttattctaggcatccaccatgttcaaaacatactaagtacctaggaattacttatagaatagatgtaactctattgaactataaatcaaatatcaacatacaaagttgagtgagcagacttgtttgcctcttttcattttttgttacactgatggataccacatgtcttaggtgattgggggtgcggtggctagtaattactgccattattgtctgtgatacagcagtgttcagatagcagctattctgcttataatcagatgaacaagatattatgtttggctttgtttatggaaaaaaagaaattttattaaattgtggttagaggcctgttagcataaaggatgaatggtttcttggaattacaacttgaatattttgagagaaacaaatgaaaagtatctcactgtagggctgaattggtttgtgaccttgcttctctagctgaaatctattgactctctcagaagtattgctaggagaagaaataatcctataaaaggacattaagcaatgctaagaaaaagatgatgataataataatgctttcagctcaccatgtgccaaacatcatattaaacactttaagtgcattattacattgaattctcacaaccctacaccatatcctcattttacagatggagaaaattgaagcctagaaagatcaagaaactttctccaggccataaatagaggaatcaggattcaaatcagatagaccccagggcttgttctcttcaacaccacattaccctacattattattcaattattaaataaaaccttgcattagtggcatttccaaatgcataacaaaaaaataaaaaaaagtaacactggtcatatgtatcgtattttttataaaaattacattattccatttgtttttctggaaatttttattgcattgagttgctagaataccataatataaaacttggcattttctcaataaatgtgtatgatgctgtagtaggtgtttaagatgtctttggaacaacatttaatttgtaagatcttttttattaatgtgctgaattaagtaattatttctttcccactttgggtatgttccatatttgattttctgctgctttcaagaagccatacaatagaattcttaatcccgttttgactcaacttctttccaaaaactaaaataaaaataaaagacatgaagcacttcttttatcttattagaaaagccaataaaatgaaagaatcttcaaagcaattttttcaaaatataaaattggcagagtattttgtttatgaaactatggaaaccaagttgagatttataaacaaggacttcaaaacttgttttgctaatgcagtgtcactcaagaattcactgaacctcacaaggtaaacttgcagagaatgtttgttttgggaaatgatgatgatgacaggcaagaattttctaggtagaaaattgaattttaattcagctaccatacaattcactcttttaaagtatgaaagtcagccatcccattacagggtatatacccaaaggactataaatcatgctgctataaagacacatgcacacgtatgtttattgcgacactattcacaatagcaaagacttggaaccaacccaaatgtccaacaaagatagactggattaagaaaatgtggcacatatacaccatggaatactatacagccataaaaaatgatgagttcatgtcctttgcatggacatggatgaaattggaaatcatcattctcagtaaagtatcgcaagaacaaaaaaccaaacaccgcatattctcactcataggtgggaattgaacaatgagaacacatggacacaggaaggggaacatcacactctggggactgttgtggggtggggggaggggagagggatagttttaggagatatacctaatgctaaatgatgagttaatgggtgcagcacaccagcatggcacatgtatacacatgtaactaacctgcacattgtacacatgcaccctaaaacttaaagtataataataataaaataaaaataataaagtatgaaagtcagccaggcatggtggctcacgtctgtaatccccactttgggaggctgaggtgggcagatcgccctaggtcaggagttcgagaccagcctgggcaacatgatgaaaccctgtctctactaaaattacaaaaattagctggatgtagtagtgcatgcctgcaatcccagctactcgggaggctgaggcaggagaatagcttgaacacaggagacagaggttgcagtgagccaagatcgtgccactgcactccagcctgggctgggtgacagagcaaggctccatctcaaaaataaaaaaaattttaaaaagtataaaattcagtgggttttaggatatccacagagctaaacaaccattatcactatgggattccgaaatatttttattattctaaaaaagaagcctccttgtccataagcagtactctccatcccctaccaccacccctttcctaggtaaccttctatccattttttatctctatgtatttgcctattctggacatttggtataaatggaatcatgtaatatgtggccctttgtgccttttctttcacttaatgttttcaaggtacattcatggtgtagcatgtatgaatatttcatttctttttactgctaaataatattcagttgtgtggatataccacagtttgtttatccaccaatcagttaatgtgtgtttggatcagcttattttgtttatactaaaattctgaagagtaggagcaggaataccatccatgctagtttccaactggagaatgataacactcttgccttctctctcaaattaaacaaaatcacagccaatgaaatgaagataccttcagaaagaaaaaccttgacttatttaggcaatagataaccatttttttactcgttaaaatgcttcagtaagttaattttgcttctcattactttgcctagcatttgctagtgtaaattcattgtctagaactccccccaaaatccacatttacaaaaatataagaggaaatatcccctttcaattaagtataaaaataaccaaggtagtgctatgaaactaaaagtataaattagcattatgtttcctcattggctttgttggattagtcctaaataacccaaaaggaaacataaatttcaatttgtagggagttttgtgatctgatacttttaagtgggtgtttagcaagtggcaacagaagaaagagcactagactgcaattacttactgcaaatcagaagctgctggaaacactgcttactaattgtataccaaagcacttgagtaaaaaagtgtggaagggctatgaaagccctgcttctcctgttacttacttctgtaaaccaggacacaagttgagtgagctgtgcatttattggagctctcttatagagcacgcagatcctgcatgtttggaagttacaacattgaggacgtgagaagaaagcaatgggggctttctgtgtatgtgagaataaagcaacgggggcttgctgtgtgatgatgctagtttgtaactactattatgataacaataacaatgatgataagagataataatagcttttattcattgagtaattattctctgttgggctctttgcatctacacgttacctcttagcatcacaaccctcctggataagttttattatctctattttacaggcaagagaagtatgccactgaagaatgaagtgacttttccttgtgtcagctagctaataagtaacagaactgaaattcaaacccagatccaaagtctctctctttgaactagtcaaggatggataattaatgtttgacattaaaaccatagatgcttcaaatccataatattgatgataatatgacttatgtggcccaaaagatgcagcctctgcatgcatgccctaagtaaacctgttttgccagcttttgttccggatcttgcgccttcacagttgcccctttaagcttatccccacagcttatcatcatcatgctgtgatcccaggacattcagaagatgtgatagagttttcatgggataaacctgtgaaccattccctttcaatatcttcagtgcccctttctgacttatagaatatggagtcagtctaaattatttaaattttcccttgaggattctctagccctatcctagatttgctcctgggttgccttggagaatcaaatgagttcttccctgagggggaactggaaaaatcctggagttccccaggacttgaggatttcctggagtgacctccttcttgtgagatccttcagatccatggtcccagctttcaagtatgtggagaaaagagcctcagtagagttatctctgtccaaagccacttcataaaatacttccttagatattttaatgcttggcagtcccatctgtaacattacagggattggacaattcctcacatggttatgttctttggccagcacagtattaaaaaaacaaaacaaaacaaaaaacgctctatattgtttttaggaacaaaatgcttgctctagttctccacggtcttctccaatatctattgtatcacaaccagccaacttccctgattaacactccctgcctgacccttaaaggtgtttgtttctgaaggtactggaagtgataatattctaaatttcttccagctctactatcctctgattctctccttattttcagtttacaaaaaggatttgtaccttttttttcctttggccccacacttatgtcttccttgcttcctttcattctgcttttctgaccttcccttcagtgctcagacatcaagtgcttcaacccactcttagctgtccaagttctctgccatggcctctttccctgtctcaggaatccagccctcaaagtactcctcttatacccctactttactcttaataaattttctatctctatgaagaatcatgaaagtaagctctttaaattgattcataatgaaaatagattattcctggtatcttctattttaccattaggaacaagggtgggactgggatggagaggtgcttaggagctccaatgagtctttaattggtcaaggccagggtggcgaggatgaaagggttgtggaagggaaagacctaatctgctgattttttcacacttaccaaagaaagaggagaaaggctcctccaggagcctctttacgtttttatgttgaaaagaggagctgatcgctgccccacttagaaatgtctcactaccttctctggagaggacagcttctttaaggatggctctgccctcagccatacgtgattttttaactcagtgtgtcttccttggcctggatgcagaggatggaagatggcgtccttactgcttcacctgttttaccacaattttgttaagtggagaaattatgggtaattaactcaagttcacacaaatgctaagtgttaaaactagttctcaagctaaagtgtgtctgaaccccaaagccaagcctttgctgtcagactttctgaggctctcagaatcccccattttcaggtacctgtggtcagaggagggagaaatcagcacacacattctcacttactcttggattctggtctttggtgggagcttgaagcaagtgcttgttagccacatatacttttttttttttttttttttttgagacagagtctcgctctgtcgcccaggctggagtgcagtggcgcaatctcggctcactgtaagctctgcctcccgggttcacgccattctcctgcctcagccttccgagtagctgggactacaggtatgtgccaccacacccggctaattttttgtatttttagaagagacggggtttcaccatgttagccaggatggtcttgatttcctgaactcatgatccacctgcctcggcctcccaaagggctgggattacaggcgtgagctactgcgcctggcccacatatactttttctcttgcccagctggtcttaattgtatatggtttagatgtctcttaggaatgcctgggtttgtatgtttggtgtggtaaaaaaaaaaaaatgccatttgtgtaactgcttaccaacttaccaagttatgatgaataaagtaattatgtcaaaatgtttaggtttacattgtctggagcttataattttataattgctgctaacagctagtttttcttttatgttttcacatcattttctgtcctcatggaaagtcttaacctgtgagaaagccatcggtatcttcattttagtaataatgaaactgagacttagcttaccaacccacatggtcaatatcaacacacaggtcttttgatttcaaaacctacaagaaaactctgttcatgtatgtataatcattacctattatgcacatggcatgatcacctggtctctataaagcaaaaacaaaaagcccgacatgattctcttagccttccaattccgaatgagtatgggttccaccatccatagtcaccaaggtccttattcattcaagatccttccttagtcagatcctgaggcttttgtgtgcactggcagcaatggcatcccacgcttccctgacactggaggatacctacagaaaagatcctagctgcttgccaattttaaggcacatccatgtagtagagtgagagcctacaccgacaaagtattgtggtttcttcccaagaaactatttcttaactattttgcctggaaatctccatccacagaggcagacagtaaaagtttccaaaaatctttcatcagtgtctttgagatagacttgcctctgccacctgggcattagtatcaggccttgatattgattattacacattgtatacatgtatcaaaatatcacactgtatctccaaaataggtacaatggtctgtcaatcaaaaattataatgcaagaaaaagtgttgttttcatgcacttggaatgggcctttgcatatgttatctgtgtaatgctatgcattgtcatttggaaagttttagttcactagttatgaaaaccttccaaatattgacatattaatttatgaaataacaaaatgttacatttgttaatatgaattaataatgctggcatatgataaagaatgtgtgtgtatgcatttgtgtctgtgtgtgtgtatgtgtgtatttctgtgtgtgtgtatgcgtgtgtgtctgtctgtgtatttctgaggcccctaggcattgctccatctctcctctatataattcttaagaaacattccactgggctgcatttcttggcctacaccattgtccctccctctatattgtttgtttgtacttcaggccaaaaacaaaacaagcacaaataagcacactgaacaagaaagagaaaagggcccttaaaatgagatgaagagagagggtgtagggctatgtgttgtgcagaatgattgaatgaatccaggcaaactctgatttggtttgtaagttctattttatctattttagtaacctgtattgaaagcctggacccaaagagctgaggtcctaattcaatggtttctgtctgtgatacaaaaagtttctggctactcactaagaggtttgcttagagtaaatccctcagtcaagagaaacatattgttttgaattgaagctcagtttttagttaacaaaactatatgcattccaacatacactggttttgttccttttcttttgagctggatatacatgcatataatacaaaatcaaaagatatatggtggttaacagtgagaattcttccatcccgttcctggccccctgacaaccaatttcttactccagagtcaactactatccttgcattttttatatccttcagagatgttgtatgcattatcactatggatgtaagtttttgtttttttcataaatgttatcatatcatacacactgtatattatgccttagcagtttatacaatactgccttactcattttcatagtatacagaattccatcaaatggatgtgaactaatttatttaactgccttcaattatttctaatattgtctatcatatttcaaggaaaatgcttatatgaatgtcattttacttgtatgttagtatatcaagaggataacttcctagaaatgtatcttgggctcctctaagaaaataccattgctgagtggcttaaacaatagacatttatttctcacagttctagagcaggaaagtcctagatcaagatgccaacagattcaattcttagtgagggtcctcttcttagcttgcagatagttgccacctagccgcgtgatcatgtgacctcttctttgtgcatgtttagagagagagctgtggtatctcttctttttcaaggatgttgacccccttatggggcttcatcttcatgacctcatcgaaacctgatttacctcccaaatgtctcacctcctaataatatcacattggggattagagcttcaacatatgaactttaatatgttgaaaattcagctcataacatgactgggtcaaactgtgtaaaattttggcagatttgctattgcttcacatagggtcctacccgtttccaatataagaaagagtaagactttgaaccttgccaacaaactgtattatcaaattttgtgatgttccctcgagctgataggtcaaaatgatagctcagtatagtttcaatttacatttcttttgttaatatatgaggctgatgaacatttcatatgttcatcatttagcactttagcactattagcactttatttttctaagaagtaggtattcacagtctacccacttttctgttggattgatgatccttttcttatgtgtatgtgaaaattgtcatttttctttgatataagctgtaaatacttttgccagtttgtcttgtgtcttgacttttgttaagggtgtttttatttttcataataactttttaaaaatttgtcttctattgcatctgtaagatgaaattataaattacttcactgcccatctttagtttgagaatctttatgggttgttttttttttttttttttttacttttaagtctttgatacatctgggactactgtggtacaggttatgagataagaatccaatatctttgtttgattttattgttttgttccttcttttaatgttactcaggtgttctgtatctgtttatttcttcagaaaaaaataggttaatctatcaaataagggaacatatctcaaaaagtcataaaagggctaaattatatgattctatatgattatctactgatttttgtcactgtaaacataatctggataattcagatttagaatgtgtgtgtgtaagtaaatatattttaggacagttcttaacttatcagttaattgtgtaactcttgtatttaatttacagaatctataaattacatttatatagtgaagatgagttaccttgagcagccagaagtagcatcaataccaagatcctccaaggctgtatatgaagcgttactgaatacttaagccaatattgattgctctctgctctgtttccactgacattgattgtctggaccatatatttgagtggaaaatcatctttcttaggatgttatgtctattgtatatgtcttatctaccttccccagaaaagctgtgaactccttagcagagagatcatgacctatacttctatttaatctgttcagcaaatattgagtgtctaccatgctccaaacactatcctgaggacaagagagacaaagagaaccgtaggccctgccttcaaggagcacatggctagtggaaacagacagtaagtcgacaatgacaatacatgtgaccatatttacagtgctccaagaagttcagaaaaaagccatctgatttggactgggaagaacattatggggatttaaggagataaaaagtgaaagcatacttgaagtgctaggcaaatgatggatgtaaagtaagtttaggaaagtcctgagtcacattttacttctgtttatattataagcattgtgtctcaaactgtagaatgatgtttcatttatttggctttttctaggaaaaagaaatgaaatatttttcctaagaagtgaaaagaacccataagagctccagtttgcaaaatgctagtctttttattgatccctttttttttttttttttgacatggagtgagtctctctctgtcgcccaggctggagtgcagtggcgtgatgtcggctcattgcaacctccgcctcccaggttcaagcgattcttctgcctcagcctcccaagtagctgggactacaggtgcgcatcaccatgcccagctaatttttgtatttttagtagagacggggtttcaccatattggccagggtggtctcaatttcttgaccttgtgatccacctgcctcggcctcccaatactgatcactttttaaagtgttctaaatgcatgttacattgctttcttaatctaactatactgagcagagtttacactttatactgagcagagtttacactttatttgaagtttcagaaatagcattcagaacatcttcttttgtacaacacagcaacttcaggggctcttcaagatttcccaggttactaggttcttaaggttcactcttttaagagagtttctttctttcccattgtctaagtctagactaagatccaagtttacttccagcatttctttatctttatccttcttcatttgcagcttcttcttgtttatgctttgggaaaccagatgaagaaactggtccaaattacagtatacctaaaaggagaatttacagggtctctgtggcagaatggagttcccgcttgtaaataaatataaaagttttagtgcaaaaagatatgcaatcaatttttactgtcatcatatctgttaaaattattgttgatttctctcagcaatgttcaatacagttgaggtttctggataagttatctaagtatatacggagtatggtcatacattaaaaaaatacaaaaggtttcagacagcatttaatgtcattcttcaaattcttattaaaattgcatcgtatttatctatagacaataattatccacctaacttgtttgaatgttctataataatgcaaaatgtctatgattgcaagaaaagtgagtttttaaaatttttggtcttttggtgtgtttttttctcattgtaactgaattgcccaaaaatataagcttggtaaaagcttattacctcaagaaatatttcatgtcaaaacagagcacatgttaaagtaaaaacaattctttagagtgagaaaaacattatagctataaaaataattaaagagttttgactattaaaaatgtaaccttaagtcattaaatgttcattactcattcaaagttcttgcagttgggaatttactgatggcctatttgcagttaattttgaggtttaaagtaaatgaacttaccagatataaccctttggagtcctggttagaaaacaaaaaccatgcagctactcccatagctctacaaacctgtggtgctttcaagcgtcaatggcggaacagaatgagtaagagcagagacaagggggcagtgactaagggactttaagtcatgagtctaattcccctgggacatagctagccttcacacagaaaaaacaaaacagaaaatctccaccaaaaagaagcattcttcgatctcaagcaacatccctaactcatccaaagtggtcatttgtccaagggggactagatgagacagcatcaacccagaaaaattaaggagcatctggcagatggggaatcccaaacggcagcctcgctaacagagtaaaacacatttgtgagagacccacaatggaacatttcagtccctttagaaagtttcagaggtggcagactttgtagtagctgagaatttgtgtttaactaaaaattggaagattatatatacttatacccacaaagtattaggcaaatggtaaaagttttaaaattattgatactgtggtaaaatttacatacctgaaatgcattacaattcagtgacattgcatgcagttttaaaataacttagctatatttagtttttctagttgaaaacaagcgtttttttttttttcaacctcagtgcaacaggaaagtgaaaaacaaaacaaaaacccatagtaagttgacagtaatctgattgggtaactgatttttcttctgtttcgagagttatttagttatttaagagttacttaaagagtacaagattgaatttgtaacttgaatttccagatttagctagagtggcttacaaaagcatgaaaatggccaggcgcggttgcttacgtctataattccagcactttgggagctgaggtgggtggatcacttgagaccaggagttggagaccagcctggctaacatggtgaaaccccgtctctactaaaaatataaaaattagctgggtatgatggcggatgctctagtcctagctactcaggaggctgaggcaagagaatcgcctgaacccagaagccagaggttgcagtgagccgtgatcccgtctccaaaaaaacaaaaaagaaaagaaaaagaaaacatgctgtttccacagaattaatttgttacaatcaaacatagttgctgtcctatgtttattaatataatttcatcatcatcatattttcaagttactcttcctaaattttttttacctgcttctgaatctctgttctttggttcccactcttctctttgcctcatctccctcactgaattgtgtgtttcatgaaaggaaagtttgtttcctatttagggttgtggacagaagattggtaaaatttcttgacacctactattgaatcaagtttacttaatgtaaaacattggtgttcccagttatttgtaaatctacaaaagatttacagtagaagaggcaaagcctgtgaagtgtcaacataaaggctgctgctgctgtcaacatctgttcccccaactgcatacagaactctaatggggcagcccatgcctcctgaaatctgttaccaagaaaaaaaaaaaaaagcctaatagtacaatactttttatttcttaagccacaacaatagtgaaactgtatgtgttcttttgcagttttttttccattcttcataggaaagatgctaaagtataatttcatttagaataccatatataaattatatatagatgtcctttaagaattataaaaataatgaaaattatatttatcctttatgtcttatgttttccttaatatttcctaaagaattgttatatatcagaaaacaattcaaaatattcagaattattagcctcttaaccactgtgtttattagcttaaactagtaatagagagcaaactggcttttcttcttagcataggtttttggaaacttgaactcaaaaatcagtaaattcaaaaggagttatagtttcagagtatttggcataatatatttgaaaagaatattcccttcacttatctttgtttgcattagacttgtgttaattatgtgattcctctccatagcctcaataataaagagatctcaagttggaatgtatagttctatttttcataagtatcatttaaaaaccgatttataaaccctatgacttatgaaatatttgtgaacaaaacacccaatgccactggaataattcaaatgaaagagggtcttacattgagcaatttgtcagtttaatacctgccctttacaattgctctgcggttgaccctttagtcgtattttgagttagcagatgaaaataaggtttcccttgaagtagtggttgctaagggcaactggtactgacgccgaagacgaatactctatctccttagtataatgcctactttgtgagctaaataaagagctaaattgtagagaagaaagttgtacaaatgtgaaatatcaagaaaggaatagaaacaggaatattagagatgggaaaataagaaaaagaattactataatcacttttttggtaactgcctggcattttggacagatgtccttatctcctgggcactctgcatttccacctttcatagctggaaaattaacattgttcactggggcaagactttcttttgtaatatgaattcatgtcattagttcttagtggattttgacaaaatggaggtgagactgtgatagaaatatttgtcaactttttaggcttggattttcaagcataaatattttgtgtcagtagaattgctttatgctatttggacaacttgtagtgtgcagggtcagttatctctaactccatgtcagtacagattgttttatgaacatgttggtttaatgagagagtcttcatatagaatgtgttataacagtgttcataatttcttcgaccaaattgcacttaatgtattcattgctgtgatttcagaaaggtttttaaaaacttcattgtatcctaggcaatgctgtttctaaagggtgagttcattactcctttatgagcatctgctcgatgccaggtgttttgcctgtctacaagaagcccacagactgggaagatggacataaaatcaagtaattacagatgagtacactgtaagctataatcaaggcataaatttgatgctataggagcacagagtgagaaacattcactgagtaagtcacatttagcttgcaggatggtttggagtttgcaggttgtgcgagaaacatctgcctgcagcagcattccttccatgattatcaaggttcatgcaactgatctgtttcattgcatgtatttgaatgtctctttccttcctctacacttctagaattaatttgttggttaaggaagataactcagctagaggaatcagtgggttttttaatatgagactctgcaaatacatttcttgtaagtgtgaacattttgaaattttctaaggtgatgaagaacaaaatgaaactctgtaggcacagctaggaatgggctctgcaggaaaagtgtcaactttatgttccagatttctcaggacagtctagactccaagtgagtccttttaccctggtagaagtttgcttatcagaccttatgtactgatgctcttgatcatagaaatatggtcaatgtagcaaagagacaaagtaatgaaggagggctagtgaggccctgctgtaatatggtgtaggatttatgagactggaaaagtatgtaaagacatactgtagaaggttttgtatgcaacaccaagaaatttggactttgtcctccaggcaaaggagccatcacatttttcaaaaaggaatgaggaggtggaattatttttataatttattttctgtaaattgttgggaaatggattattttttaaaaagaatatttctaatagcaatatagagaatggattgggcttaagttttcaggaaaaagactaactttgaagtatagatttatgtgttactaacttatagataataattaaagccataggaaatgggtgggagaacccaaaggaagcatgtggaataagaagacaagcaggaagaaggaaggaatcattaaaagcatatatgaatatgaaaaagaggagaaacgtgcacacgagacttggaaggagtgtttagagagttagaagataatcaggagagtgtgtttgggagcaagatgtggagagattttaagagagaagagttgataaggagtgccaaatcctgttagggctgtaggatgagacttgaaaaagtggatttggcaattaggccatttgaaccttagcgctggtaggttcacttcataaggtcttctttgttagaaaacaaaacataacaaagctgttagtgatgggattcaggattctttagcagggcaagggagtaaaagtttttctctggaggaaaaaaagggtaagattgcaggaaaatgaaataaatgttagggcccagtaaaggaagccctaatcatagaattgtaggactagctattactggttgtttaaattgtaccaccataggtcaaaactccacctaaaactattccggagaggtgaatattgtaattgcttatacagaatcctaattatgagctaataagaagaggcattaaaactagcaccccactgatttaatttggagagagacacttatattagctgtttctaagacttatcttttaattcttcccaaaaccagttatttcacagttggctcacagttttgaaagtagaactgctagagtaaagaaagaaatttacagcttcagatgtttagtttctgaaggtgtcagaatcccatatttctcttttatttatttttcactgaattttggagaacactgattaacttaaagttttagatttaattttttcctatgggccattacacatgaatgccagctgtcttctgtcaagtaaaaactaggacagtcccattccagcccaccctgttttaagctacagggtcactgagaatgtagtaagaaattatacattttttgatcatgtaaaatatggatccttttttttctagtaattactctcttccatatttcacaatttatcatttctgtgaggaatagcagcacaagaaatatacaacatctgtgacccttagaaggggccctcagagaggccttgcataaagttgtgcccccctgtggctgggcaggaagacttggtctgcagataaactagctagataatggatggtttctgttattttggtctgaaggcttgatatgtaagagatgcatccttactttgtgcctgtcctttcttctcatggattgagagatgcagaggggttatgtgacagagttaggagaaaaaacattggcctgggtaggagttctggcctctagtgttgacctgggcccatataaactctatagctgatggtgggcaagtcaatgaagctcactgagccagaatttcctcatctataagataaaggtggttgtgccaccctgactacttcatagaatggcagtgaggacccaaggtaagaatacctggacagactacctcaagaaatgtgttattgtcacgatactggaactacacctttttttaaaataatttcaacttttcttttagatgcaggacatacatatgtgactttgttacatgagtatattgcatgatgctgaagtttgggatgcaaataattccaccacccaggtactgagcatagtacccaacagttttaaaacctttccccgctctattagttccctatgactgttgatgccatctttatggccatcagtacccaatgtttagctcccacttataagtctcacggagagcttttgtggtattggttttttatttctgagttaattcacttaggataatggcctccagctgcatctatattgctgcaaaggatatggtttcattcatttttatggctgtgtagcattccatgatatatatacatataccacattttctttatccagtccaccaatgatgggcacctaggtcaattctatgtctttgctattacggttagtgctgcattgtacatatacctctctatatatattctaggacaactgccgtcaagatatttgtacacataaatgaccgttgttgtaaaacatagcattgtgtgtctatatttcatgacttcaatgctgtttcaaaaggaccttagtttttacctaaactcaataacatttttatttctattttttctttatgattttttaagcttactgaaaagtacagaaaacaataaatattcccgtactttcctcttatataaaatggttccaccatcttgtcacatttccttcaaattttcttacaacaaaacaaagcttacagaggttgctgaaaccccacctctccatcccattcacctcttttcctctctgaatgttattatctttaaatgttcacacaatgacaaaaatcatgtaacaacacttctcagaacatatacatgccatttagctatgcatgactgtgtttataatatataatattacgtatattggattataaatattatgtatgattttatataaatatatatgtgcaaacatacacatatacacacatacacttgttttgggaagatttaaacttgtacttaaattgtttcattcaaaaataaggttttcaagagctgggcgaggtggctcatgtatctaatcccagctattcaggaagctaagatgggaggatagcttgtgcccagaagctcaaggccagcctgggcaacatagcaagtctctgtctctaaaaaataaaaaataaagaaaaggtaacaatttttttaaaagtgagccaaaagtaatgttttgagagattcagccatattgatgcatgcagttttagtttattttaacatgagaagagaatgtggctattaaattgctggtaagaaggtacaaatatctagtagaccaatttggaaaaaacaagtaaatttgggagaatgtatatcctgtgacccagcaatttcacttctccgcatgagaaactcttacacatgtgcacaaagatatctaaaaggttgttcgcagcaatggttttaatcatgaaaacctggaagtaatttaagaggccctcattagtaacatgggcaaacagtggaatattatacagcagtgaaaatagcattttaataaaatgaattatggtaatcagaaaaattgtcaaactattaaccacatataaatctacaaacaatacttgataaaatacgggtgtgaaaaaatttttaatattaggcactttatgaagcaagatgttttctcctattcatcataatttttacacaatctgtttcctttttaaatgagtgtattaggcttgcatgagataattacagaagaataataagacattttcaaaaaagatgcaggttaataaatgggcaagatctattttgcaatttttctccaacatttttgtgtgatgctgagtggcaactctttatctcttagtgggccacaatcaaagaactccataaattagtgttatttataggttatctgctttaagaaaatcttgcatattaaaacatagacttaaaaatatatagtaagctggggatttttttaaatagaggcatacttggatttataattggaaacacctttgcataggaacactcccagtatcttaaatatggcttactatatgaaatttattttttcaaagcttcaagaatacatatcttgcataaagaagaaatatatatagtgatagtagtaattttagcactaaataatggttgacacttcagtgccacatattagtagctctagtgataaaactctatcaaagatgaagataatcagtttactgctaccccttacaaagtctgatatttatttgaggtcaatcgcggtatcattctttaatttcatatcttgtcatgttcatcaccgtgaagttgaggtaaaattcttttaactcattctgtaaaactgttaagctataaatcagatgttcattaaagtcaaatagagtttagttttgtgatttcattctcctcaagaatcattgagcgatcttttccctgtgaaacggtacttcagtgaggattgattttgtagctcagataggatggttgtttttactggtcattccccatgttcatttatcctaatcttaccaattatgcacttctgggtaccaattgaactgtggaaggagcaagtgggatgcaagggaagaggaaagggccatatagaagttataggacacaataactcatggtgggtcacaactttatttcaagcagcttcttctctgaaatctggtatgcaaattctagatttattcctagatttaaaccttaaattctagatttaaaccttaaactatatacagtgaaagcagctgatggtggtaaaacaaactgtaatccaagatgaatttcagaatgagaaaatttagaagaaattaggatataattccttaggtttctgtgaaaaataagcaaggcaggagtgatgaagaaatatttggtaatgaaagtcaagagaattacaataaaataaattacttaggacatgagtttagttactgcagttttatgtggatgtttacatttttaactatttcacctgttatattgttttattaaaagggttccttttttcagctttattgaggtgtaattggtaaatggatatgttaattagcttgattatggcgattatttcacaatgtatacatagatctaaatatcaatttatataccttaaacatatacaatttttactaaggaagttcttggttaaacaaaataccttttcaaagtgtatcaactggggacggtggctcatgcctgtaatcccagtactttgggaggctgaggtgggaggattacttgagtccactagttcaataccagcctgggcagcatagtgagaccctttctctacaaaaataaacaaataaataataaaagtgtgtccgttgatgtttgtaattgatttctactcaagtaatcaagtcagtagcttcagaataaagttattctttattttaaaacccaaataggtaaagcaccagtaaaaatgaatgtatttagacttttttttttctttttgagacagagtttcactcttgttgcccaggttggagtgcaatggcgtgatcttggctcaccggtaacctccgcctcccaggctcaagcgactctcctgcctcagcctcctgagtaggtgggattacaggcgtgtgccaccacgcctggctaattttgtgttttgagtagagatggggtttctccatattggtcaggctggtctcgaactcccaacctcagatgatccacctgcttcggcctcccaaaatgctgggattacaggtgtgagccaccgcacctggcttgttttgtttgtttgtttgaatgttgcaattatggggggattttctggtcattatatgaacatgttgaaaggtttttaaatagggaaaagagaataaatgttccatgataatttggaagtaaatctgtgtttttttcttcttcttcttttttttttttttttttttttggagagataagatatcactctgttgcccaggcagtagtgctggagtgcagtggcatgatcataactcactgcaacctgggctcaggcaatcctcctgtctcagcatcctgagtagctaggactgcaggcatgcacttccatgcctggctatttttttatttttattgttgtagagatggggtcttgctgtgttgcccaggctggtctcaaacttattgcctcaagctgtcatcctgccttggcgtccgacagtgctgggattacaggtgtaagtcaccatgcccagccgacttaagttttcttaaggatttattatactttaaaaggcagaatagagttaaccgtaacacagtctcgtaattagagattatattgatttcttgttggaagtgccagaaggtacccattctaacactgttttggctgaatcttatagataaggatggcactttggaaaaactaagggtaagatggtacatgaatggttaaaaatctgaatcagctattagagctgaaatcaggtgggaccttctaaattttagatccagattctcttttagggaatagcttttatggaaagggaagtgaaaatatttttctgtagtctgctttgtggtatgaaatactgttgatcagacgactgctcaggttcaaattaacagtgactaaagatgagatcagtggttaaatgctgacaaactgtcatttagagattcacaaattgctccaatgaccaaaaaggaatttaaatattttttatttgtatcagctgagtaagacctctcttggctcctctcttgacctccagaatgaattatttaagtctaatgttttttcttaccaggagagttacattatcctacttggctgcttatatcaagttaattagaagattgccaatttccccactctattagaagctatataaatatcacaattaaaggacaaatgatggctctgctaatctcaagaatttataatttgatgatctaaagatttatttaatataagaatactttaacaacataaatttttgttcttagccacttagtttagttcatgttgggatgaaacggctaatttgaactttggttaatttgaaaatgtagcataatacagttcagacttaagtactcttattttggagtactgttcattacttagactgttaaattaaacttctgtgagcaaaacagttaacatttattgaatctatgtttcgggcgtcaagctttccatgcaacacaccttacttttcacacataattaattgttccttattgttccttcttcatctgtaaaataaggataagaactagacccatttcaaaggcttgtttgaggattaaatgaaatgtatagaaagcacttaaaacattatagagtaagcactcaataaatgtaaaatattaaaatcagctgctttgaccatcaaaaaagttatatgttttgtcatgttattattatgtttaggcattattgttatcccaactcttaaatgggcaggaagctcacataactcataactaacaaagctgggatacaaattcggttctgtttggttttagggtccagtcttttatcttcattcaaagagataaatggccaatctatatatctatatctatctatctatctatctatctatctatctatctatctatctaatctatcttagtttaaggtattctgaattcttcaaacaatttctgccatgaataattccatccctaccatcactattctggctcaggcccattcaactttctcccattccttttttattttgttaagattgattaggttttggtggagtgtctactcttaaaacacaatatccagttctgtggttctaaaccacagtgaaaattgcttgaggtgccacaagtaacttttttcaaactagtaaaatagtacaataaaaatctaaagtttagaaatgactttttaaacctaaattctagcagatacaagattattcctaaaatagcaacccattcactccgccatgatcttatatgctttcttgagagggaaagcaatggtggagctgcaaccagttctccagcaaccttacacaaagcagagacctagcaccggcacattcccagcacagcctcttccattccatccatcatggaggccaggtgacaggcccagaatggctgagcaaacccatccctcagctaagcctctgtggaggttttctttctgccttaattgaccagataaaaaagaagtattaatattacctagaatcatcagataccctgtaattttaagagcaattcacatagttttcactcttctgacatgcgactacattgctgtttactaagttcattgtagacatgcaacagcaacaactgcaacaaaatttccagatgggactttaataccagagatatgaggggaaatttctagtagcttgaattactaaaatgatcctctgaaagattaataaattgtattttggtgtactttgtgtagaaggctatttgttaaataccagttcaaggtaaaaggatgtttaattaaagcttcatattcatgagaatttaacaaaacaatcagccaaattgttttactgtagttgtgcagcagttaactgaaacttacataacgtttaaggctttttaccccaacttcagaccctctgaaacaaactccacttggtttaacctcaaaaatactgctttagacaatttttttaacttctgaagagcaagaagcaaattttatgatatcggttttgcaaataaaatgttgtcaaagaatgaataacaaatttgttaattttataaatagatagtattacaaattctatagctaagagttattttgtaatccatgcatatggagaaaagaaatagagacttgtgggggcggttctttttttgatttttgttttgttttgttttgtttagagttgggggtctcattctgttgcccaggctgaagtgcagtggcaccatcataactcactgcctcaaactcctgagctcaagcaattctcccacctccaccaagcctggctaatttatttttatttttaattttttgagacagagtctcactctgtcaccgaggctggagtgcaatggtgcgatctcagctcactgcaacccccatctctggggctcaagtgatcctgccaagaagcttgatgtgcaccatgaagcctgcctaatttttgtattttctgtagagacagggttttgccatgttgcccaggctggtctccagctcctgggatcaagcaatctgccagcctcggcctcccaaagtgctggcattacaggtgtgagccaccatgcccagctaatattttttttaattttgtgggctgttttttgaggtatttaaataaactccatgttacatcttcatacatcattattagagagaatgctcaactaaattgttacattctttccacagcacaatagaattacagaataattcaaagcaaatacaaattattttcttagcccatcttcttaatttgtaatattgtcccagaatacccttccagaataaattaacatttacaaacaaatgagttttcaataaggatacattatgagtgtgaggttgagcaaagataaaatactaacatttgtgtagcaatgtgaagggctgctgagataacagtaggaaccaaatacacaatcaccaattcatgtggctcaagggaaataaatatgaacattcctgagttattggccaagattaaggaaatacaaggtttttttttcttaaggagtatgaaaaggtttaggaaacaggtaattttttgcaagtgataaaaaagtattaagtgcctggaatgttggaataaatagctatgatcgaagtagagaaagatgtgtttttaaggaacaaaagctccctttgttttgttccactctctgtggaaatgctttaagacttagccctgaggactgtgaagcatcagataagttgtgatgttctcccatgtcttcagcatgtgacccattcacacagaatattcagatacagatatgggttctaattgccaagtagtttacatttccctagacttcattgcaattgatttaaaaaaatggccactttacggtatgatttcacttcgtacaggtacacttttggcagattcagataaaaagaaatcattcatatttattatcattctgcatgttcagcctttttccttccttagaatcagtcttgattacttttaaagggactttactaatctttatcttcctctccatcctgccatcactgacctgcctcaatccctgttcaactctctcttattcagtctcctatgtggattgtcccactgccttctgtcctctgcgcagccacaaggcagtctatttaggatgcagatctgtttctgtcaccccactgctagacccccgcagtggctcctcacaaccagcctatagcagacaagcttttattagagcagactatactccttgtgtgcagaagtggtggttatttgtcatctactctgcccttgagattctcaactccactccagcaactctgaacttcttgcagcgtcctgcccttcccagcatcttatctttgcccatgctgctctttatgttcattctctttcctcttactctaacttctccttttagactcagctcccatatcacctcctccagacatttgttgaatgacctttgtcaatgagcccacgtcctggcatatctgaattactgcacttctatggctggtttgtttgttttgtttttgtttttgttttgtagttaagtgtctgtctcctccagtagtgttaatttctgagggattggaacaatgtcatagtaatccaacaaaatttgaaaggctgaaaatagttagttaaaccatttcttaaaaaatgttttatttggccagaaccaaggtacacagacataaattcctgtaaacaagcatttgcaaagaaccccagttcagtctataaagtagcaagtttaggtggtgtagacgtatgtcagtatttttaagtattccttcatatggtctgattttttaaaaaaacattttccatttatcgaattctatttgtgatatgtgcttcaattttgagctagattgcaagaatgtatatggccctgcaaagaaagtaattacctaggatgaagacatttgatatatttgctgttcctgtgaaatttgtaaaactactcattccaagagattttctcttaaaatgagatttttagaaagggaaaattcattaaatagtttacttgtggctgcttttaaatactaatattttgtgctatactttgtgtgccttaaaacatttggcaaaaccatacttttctacgaaaataaaaatgagtcctagcttagttctttcttaatactgacaactgcatttaacgtaggtgttaattttgttttggaatttttaacaacagtttctgttctagggttgaacttcagactttcagatatgattttattatcaaaaatcaggctttgggcaaggtcatttcctattttcctctcttttatgtgtgtaattataaatctttagagaaatattcctccctctgtttatggagtaacagtaaaatcatgttaaattcatttttgaaaattattttctaaaacctccaaaagcaagctgaaatatttgcaggtttattatttaaacctttaaataatacattcacaatgtgcatgctctctttgtctttattaattactctgggtttttttttcccaatttcttggaaattacctggtgagaaccctgcaggactgcatgcagaggtactcagtaagttaatttaggcaactgcagtaatggctgtctttgcttagcatgatatatgaaatattttgcaaaaaataaaatcacatgtagaatgacatatgcctatagaaattctataatttgatgggttctttcctaagaaaaaggggatattaattgttataaatgataaaaaaaaaagttacttccattcatgtaaatataaagtttcctctttgcttagaattaccttttaaaacatggaatgttactatctgatctttatgtatcttaatcctattgcaaatcttttgatttggtgatacagcaaacaacatgctatgtctttccctaccccactaagtttattacatttaaaagataattataatgctattgcattaaatgtataagttgtttacagagaaaatgttaactttgtaaattttgttatgcccccctcagttcagaaatgtggaggcacaccactgactacacaatagcttagcccacctttcaaattatttctaatatgattctttcatggtgtctttgctccgaataaactgaactagtcagtgtttctccaataatttttattcttttctgcctctctgcctttgctcaatctatttttccatctgatatgctttccttggtgttcagtgcaaatcccaaacacatcattccccttaaccacatagggaggtggtgacattctggatacttccaccatggggcgtactaaataactgcttattcacttcagtctatatagtctagttgtgagaactgatatcctggatcattagaattcactgcgtgtctgtcagttatcaataggttaaaccgcagaaaataaagctagaatatgtctttgtattgaattcatttattcttttttcaatgtttgacatgtatgaataatacagatatactttgccaagatatagatgttagaattgtctctatagagtgaaagaaatacaagttgcttctttgtgaaagcttcatgctttcttaaaacaggaaactttaagtaggtgcagattgacatgttgaagcattttgatgcaactattcttaaaaatgcctagaggttttactgtccaaattttttttttgttttttgttgttgtttttgtttttttttttgttgttgttgttttgctaaagcacagctaatacaataaatcaaaatttgtaaaatgtaatctcttcccctgtaggattttgtggtccctttaaaaaataaggtaggaaagaaaatttcaaagcaattatcagacctaatttttaacacaaaagagctgtcagattttatacccttattactttaatctgggaggtaatttgttgtattgttataatgttgacaggctcaaattccctgaaataaattatcagaataagaagtgtagtataagatagaaaaatttatttttttgggtattgcttcttaccaaaaagaaatgagatttgtgtgtgtgtgtgaacatttaaacgaaagaaaaaataacaaactattaaaatgtagtattatgtttgcataaattgattttgcaataaatattggacaaatctttgctgcagagctgattattttggaattttgattaaatgaggcagcaaaagtcagaaatattaagcactataaaaatgaaatttggttaaaatgtcactcaaggtatagttatgtcttttctttttatcatgaattattgaatggatcaaaacagaagcatcttatctaccactgtaaatctagccatcattatttcttattttattaaagcagaaacattaacatgctttgagtacaaattctgaagtggaaaggatgttttctgtgtaagatgaaggattctgataaatttaatattttatatttaatattttataaaatatcttgttacaattaaaatttaaaagatgccttgctttgcttatggccctgtggtgggtactaaagtatttcttatgtgaataatatgttcatatatatgcataattttataactgaataatctgagtccatatgtgaatgtatatatttacatatttttaatcagcttaagaatatcaatctggaactatttgtttcttattattcccatgcccaaatcacttctcgatattggcttaagtgaatgacaaaatattaactactttaagtgataggttctttaccttagtcagttcctaatacagcaacctaaactgatgtcatagaggccttccttgaaagcatcaaggtgccttctacatatctgaatgaaaacaaaagcataatttaaccgaaaaggagactgtgactactgcaaatgttcataaaaagaacaaaatagttttctatagtaatccacaccatctgtgattaaaaagtatcatctttactattccctcttgtcaaaagaacaatacttagaaccacatgtaataattttccatgctcattcatatatataaacatgaagacacatatagcaacataatcattctaccagtattatacttttaaggaaaattcattatcttaactgtttcttggtttttatatcagggacaaagatgtttagctaacatgatcatacaaactatgagtgtgtgtatatgtgtatacccatttaggcatgtgcaccagccaaggttttcaactggaaatgacaattagctacttcataaatgcttttggctatgcgtgcatattcacaaagccacctgctttttaaaagtattgaaaatttttattactaaatttcaaatctggattttacgaatgttgcctatcctactagagaccagtgttgattaatactcttttaaatatcaaggcagaaagcccaaattaatattagcataattaatataaatcagtactaatttgtattgataatagggatgttctgtatgtgatcattgtgtcctgtgtcctcacctgcaggcattatccttatatgtgtgtacatatatgtttatttcagaattttaaaaatgacgttgttatactttatatctggattcagtagggaatgaaacaaagtttatatttgttaattgaaatgcataatattgaaaactatccaaaaattgccttgagaaaaattatagccaagataaaatgcttaaatattcaatttatttcatgatccttgaatctcctggaacttaaattatatattaacctgataatagttaacttaggacagaatgtaaactagatcccacttataaattttatgtgcacatgtttaaccattcatcagacacagaacttcttttattttgagacagtcttactctgccacccaggctggagtgcagtggtgcaatcatagctccctgcaacctctaaatcttgggtttaagagaccctcctacatcagccttctgagtagctgggaccacatatggtgccaccacaactggctaatttttttattttgcaggctgatctcgaactcctggcttcaaacaatcctcccaccttggcttccaaagtgttgggtttacaggcatgagccactgcctcaagccagaatgtcttgatgaaatctgaattaaaaagattttgtttccaccagctatccagggcaaaacagagtaggaccacattaatccttgatagtagctctctttactcttcctagatttactcttagatctgtacttctgaatagtctttactttcttaatcatatgacctcctacaataaggtttttgttttatttgggttttcgccaatgtatttgttgatatttaaattttaattgcaacaaaatgacaaaatttcatgacttttatttttttcaaataatttttcacattaagacatattttacatgtattaagatatgaaatgaaaacagggtggagaaatatttggaaaaatttgattatatgtattaagatgtgaaatggaaaagagggtggggaaaatttatggaaaaaattttgaagtataaaagggaaacttcttttagacgttcttaaagacatgaaatcacttcgaattttactctattgcaaagagaagaaaaagctacatttgagcttattaagcaaatacatttttgggttgggtggcagcggggacagggtctcactctgttgcccaggctggagtgcagtgctgcaatccacagctcactacaacctctgcctcatgggctcaagcaaccctcccacctcagcctcctgagtagctgggactataagcccacaccaccctgcccagctaatttttgtattttttgtagagacggtgtctggccatgttgccccgcctggtctcctgagctcaagtgatccacctcccttcgccttctaaagtgctggaattataaaagtgagccactgcacccagcccacaaatacttttttttttcagacttttccctaggttgaaaaacaaatcaaaatggcaataggtgtaactactcttttggctcaagtacttttcaggaagtaatcaggttcctaccatgatatggtggaagagaaagatcacaattctctaaaactttgcaaatatgatatatatagtttttattaagttacttctactttttgacaaattccaaaataatctaaatataatgttgatcagttttgttgaactcctgtcctcaactgatccacccaccttggccccacaaaggtgctgggattacaggcatgaggcaccatgcccagtgatcagttttccttccttttaagattctctaaaaatgaaacatgcataggaaatatatctactttcttaataatacttggtttgaactagaagttattctcaaagtgtgcttttattgccttgtttttaggacatttatttcaatccatacaaaacatccaaataatttggtcttggaatcccattcattagtgaactaaaggaccatccaaaaaaataacagtctggggttacacttgatccttggagaggaaatatttctagaaatataaattctgtcattctcttttctcctgtaatttacataacactctgatggcggttttatggcccctaacagagatttggcccagaaaagagatgcttaaactgagggtatacccctgctaagtcaaaatgaattgtgaaatcactagaaatggctacaacttctcttcatgttctgcaaattgtttcaagatgttttctataaactttcactacttttgctttatttttatttcatttaacaaatatttactaagaacacaccatgtgctagccactagatcttaagtgccaagtcactggtgagcataacagacattcttcctgtactacagagattaccctctggtggagaaaacagtaagaatcaaataaccatgcaaataaatacacccattaatttattaaaaaaatgtatattgagcgctccctgtgttatgaatctgtactagatttgtggaatatagtacctgaacccatgaatcttacattctggtgcacaaattaaacagtaagcaaataaacaaataagtaaatattatcatggtgggtggtgatatgaagaaaaataaagctatataagggcacagaaaatttgaggggttgaaataacatgtttagagaggaatggagtgagtgagggaaagaatggtaacagataaggtcagtgagataggaaaaggcctggtcttctacatggcaaacagtgcttgttattacaaatggtgaaagtgcactgtaacaaatacaagatgttaaaagaatggacaactggaagcctacccaagggaatcaggggaagcttctgttaagaactgaattgtgtccccccaaaatacaaaatttatttaactctcaatgtagcaatcagaaatcaattaataagctggcattggtaagttcttaccattcagtaattactttgaatgtaaatggattaaattatccaatcaaaaggcatagagtggatgactggattaaaaaaatttaaaaagcaaaacaaaacaagacccaactgtatgctgcctacaagagactaatttcaccttaaaatacactcagactgaaagtgcaggaatgggataaattattacatgccaatggaaataaaaagagaagaggggtagctatacttatttcagacaaaatagactttgggtcaaaaactgtaaaaagagacaaagaaggctattatgtggtgataaaagcgtcagttcattaagaaaatgtagcaattgtaaatacatatgcacccaacattggagcatctaaatatgtaaagcagacatgaagagatttgaagggagacatagactgcaacaaaataatagtgggggacatcaatacccccacttttaacattggacatatcattcagacataaagtcaataaggaaacattggacttgaattatactttgggccaaatggacctaacagacatatacagaacattctacccaacagcaacaggatatacattcttctgaagtatacacagagcattctgcagaacagatactaggttaggccacaaaacaagatcaaaattaagatccaaatcatattgaatatcttttctgaccatagtagtaggaagctagaaatcaataagagaaaggatcatggaaaattagcaaatatgtggaaattaattccccatgtgactgtgtttggaaatagggactttaaagaagtaactaaggtaaaatgaggttgtaagagtggggccttaatccaataggactggtgtcctccttatcagaagaagagacattaagaataaatgtacacagagaaaagaccatgtgagtacacagcaagaagtagccatttacaaaccaagcagagaggcctcaggagaaaccaaccctgccaacaccatgatcttggactcccagccttcagaaatgtgagaaattaaatttctgttgtttaagctacccagtctgtgccattttgttatggcagcagtagcagactgataaaaaagagttaaccccttgaaaagaagcataaaggaacaacatgtgaaaagcacttggtgcatttgagaatctgaaagaaagccgaagctagagatgacacatgagagtggtgcctggggagatgagagaggtagagggaagccaaatcatacaaggtctggtggactctgcgaaggattttggcctttatcctaaagggctgacatgatttgatctgcatttttaaaatcatctgactgtggagaattggagtagggaaagtgtaggtgcagggagacctatccaaaggtcccaggtgataaattacgctagatttgggaaggtgacagtggagttggagagaagcggattgatctttaagaatgaatttgttgggacaaggatttcttctacatttctgggtttttcagatggaaggaagttggtgccattttagaagtggaaaacactggactcacaattttatccccaacttgacagttccattttggccatgctgaatttgagatgcttctgaaacatccaagtggagaatcagtcagtgaatgaatctggagctcagagaacagatggactggaaatataaacttggaggtcaaagcatatgtgtagtaatcaaaatatgctacagtttcagttctctgtggacagggattttatctgttttgttcactgatgtattcaaatgcatggaacagtgctggtatacaggaggtactgaatacatgtttgttttaggaatgaatgaatgaatgaagaatggatagattacctaggaaagagtttgacataaaatgagaaacagatctagaataaaaccctggggaacacctacatttataggcttggaagaagagaatgaacttacaaagaaatagcaaaggaattgtcacagacagaaattcatagagtccaaggtttaagaagccaggggaagaaggcgcttcaagaaggaaagagaatatacactctgaagtgagtagcatgcagcagcaagcctagcatatgaatgaacacttccgaatcctaaaagcaagaccagctttaaaatacttaaatctgtttgtcactgttgtcaatctttgaatctaataagatttaatttattttgtgtaagatttacctcagttaatagccgcttggaactacctttgaaagcacatctctgacacattctcagcctgggtggatatacgataacatcatcattctttgtattaaattatgaccataatgacagttggggaaaaatgtcagcaactaatagaacaccaataggttttcttgacaagctcacttggagtatcctctctggatgaaagctcaataattttttgctttactacctcctcctgttacttcactctgtactcccttatacttctgcataagaaaaactttattaacttcatgcataaccacataatttgagtcataattaagattcagatgagcagtaaaacaattttatatcaccacctgtatataccttctaaaaatagatgtttattagttacttagttttggtcagtcttcccttggaagataatctacgtggcaacaaaaactttctctctcctgtttgctgcattcccagacccaaaactgtgcctgatgtattttaggtgctcagtaatatgtacataataaataaatgaatacatgcttaaagtcgcacggcaggaggtagatataaaaatgctggttgggtttgcagcttagtcagagatgcaattcctaatatcaggttacacatttgaaatccaagcaaacatcttggcttgctaacatctctggctgacttttaagccccagccccatttcggatgtttccacatgaaagccaaacaggcattttgaactccaggcgtcccaaacgtgactctttccttttcttcctgcaccacccttccccagccgtcataagttcgcctctgaaaggcttttcctatctttgagagaagcatcaccatcccatcaacctgttcatctgagttacaaaaattttctaccttcatcagaagtccaaccaatcaccaaattctattaatttggcttctacaattttttttcatatccaccttccaaatcatcttggttcatagaatgatttgcgttttcccagcagttgcagtgatctcctaatagttctggtgcctctggcctctctcttctccagtcaatattccatattgtcagccaagatttgctaaaataagaaactgatacaaatcttcattaaccaacaagagaacatcagttaagttccttttatgcatctattctaggctaaaggaataagtgcttgaagcccacagagggttctttgtcttagagaggggcatggagactagacaggcttatgtcactgcccttctcaggcttctcctttacagtagagtaaaacttaaccacttaagatgatattcccagacctttaagtgcagactctcttgcctttctagcttcatcccgtatcatttccaaaatcctaaatacagtctacctggatcctgtgttgtgttgagagagttatgcacttccatccggagttatgcctttttcatctcatttccctaactggaatgagtttccctttcccctacgtgcaagataaaatgccattcattctttgaatctcaactcaaatgttagctcacctatgtgtccttacccattacacagacttcatttatttctctgtaagaacaattacaactgctgtggagcagattctgagcaacatagagacatatgttcctagtgagtccatttgttgttgaaggcctcttcttactaagtcttaatctctacctaattaactatcttaggtattaagttcatatcaactgctatgtttgtaagaatttcctagattccatactttatgctctctaaagcattgcccatcattgtgcaatgctgcaatacctgctttgttctttatttgtaaagttcttgtctctgatctgtagcaatggaggagcttgtcataacccttttggtagaaaggctcataccatctttggagttcaagatggaaatggatcctccactaaactgaaaaaaaaaagcctttataacacatcccatgcaatattgttaaatactctgcttttccttttctctctgatatggcttaggaacagttgcttatataattcatgcttaatattgtgtgggttacaaaaggacatgaaaatatctttttatcatgagtatggatagttaccttgggtattgtttgatagctaaagtgctttcactgatgaccatctgaccagtttaattgtcagctgatacatgtcagaactccttcatatactggctaatttctgtcagtttctaaatgataactgctaatgtcaaggcagttcaaaaatagcaaaaacttgatttcctcttaatatcttgaagatcatattcatgggcaccagcgagtctggaaaataaatctgatggatttttctcatcatatttagaataaacaaattaatgctagaaattgtttctaacaggagataataaaggaaatgggcaaacaaaaataaatatatagcttctgtgagccaattgttttttgtaaactggatgagatttttttaatgtaggcaagaattctaaaattatacagttaagctaaataacatagtatttgttcctgtcataaattgtctttcaattgggaccaaaattggtgtttaaatgttgtattataaagaagtgcatgcaaactatttattagtgaatatttatttaatttgacagaggtaagtgagagtgttatttatccatagcctggccaatttcaggcaagtaattgcaggatgaggagtaattccagtccctgtacctgctggtgagatcactgaagaactcactcagcgtttgtagcacacagaatggccacggttacatacctgagtgcattcacagtataaccaagcccaaatcctcggccaaatccctaagggaatctgggttttaccttgcaaactttggctgctaggcacagttacagagccttgttatgctttaggctctcaataaaaatgtttgccctgggttattacaaagactttcttggtacagaaattcagacaagatcacgaagcacagggtgaaaatacaggaatgagcagaaggagccaattctaaagttttctgaagtcagctcatgccttcataaatagtgagcctccttggtcgctcactgaaacaaaaaagatggacatgtaatttacctagaaatatggatgcctctaaattttaaaaaggaaaatcatttaaaacatgacacttataaagtatcttaagataatatttggttttatactatggtattttaatgataattagagaaattcaatgctatgaaattctaatgatattccgatactaactaggataattattttacaaaatctgaataatataatctccatttttcatcttttaagaaatatctacatataataattttcctttgttatgtatatcaaaattcaaatgtttgtgattgatacttatgttatactttttactgttgatcttaacaataatcactctaataagctttctacttatgccagtgataatattatagagttcctcttccacaatttgcctttgtaatcaagttatgaagccacataaaaattcctaatatgttatagttgcatcttgttcttaactcaaatgtcattgctcatcttgattatttatgttgtttatcataaggaattccaactgatttttcacagccccccaaaataaaatttgtcccttaagtttacttaaaagaataggacatacttctgaaaaaagtaaaaattgattctgaaatatttaaatggctgttcatgagaataaatgcataacttcacaaagtgactatttcatacaggaaagcaattatttggatgtgtaaggcatggtatgtgtggtcatactttttatctgcttccttataaatgaattaccatattagcatgaaaaaattcttagcatcaaggaggcttttgttttaattgctggttttaagttcatttgcttagctgaatattcatttggcttttgtaatacctaaagcagtgggtgaaacccggctctaggggcttcttcatggcctttaattgtttcaggagaagctttactttttatcaattaatcctgggtaccatattttgtacagaagattgaattttttctttttacacaggtaagactggtttagtgacatatggccatatatagtaggtgtttaattactatctattaagtggatgttggatgtcagacatgaactgtcatatttaggttttctgacatttgagagaagcattcaactttggtgagataagagagaagattgtgttttcacaaaagcaccctttagagaacagattgcagggatgtgtattcataaagtgacgtataaacttttttctcatctttaaccactttcctcaatgccatctcaaagcagcaacttaaattcagttatgcatttgatccacacaatgtttattaaacacctactccatgccaaagagtcttccagggatggggaaaacagagcttctatggagtttgcattctaatggagggagtgataataattctcaaagatgctgaaattcatttgtgagcatgtttctgattattgacaaaatgtgagtcataatccccatgtagtggaatctcactggcataatctgatgagcttcataaactgtgtcacagcaggaagtgccagttatttagtttgagcaaatctagacaatttgaatgtctaacacctagtcttctttcacccatgttgtaaatgacctgcttaaaaggaatggttgagccaatcaacagtaagttattgtatatctcaaaattgctagaagaagggaatttttatgttcccaccataaagaaatgataaattttaaggtgatggatatgctaattactctgatttgattattatacaacatatacttgtattgaaacatactgtatttcataaatatgtacaattattatgtgtcaaaaattttttaaatattttgaaaagagaaatgggtgaccactctagatttcacaggaattaattaccaaataacatatcatgagagaacattcttggatgttattttagaaaataacacatgtattgtcagtatgggaacacttatttttggtacagtctttaataaagcctttattcatttatgtagggccttggggctctcaatcttagcattaaccacgtatttaaggggtgataggcacaacataaattgaatcattagtttagaatcgctctccatgaggctgcctgtagatttttgttatcatccatctaagccacagaaataaaaatcgagtgaatacttttgtttatgtaccatgaatgcatttcccaaaagcaggaaaaatattcctagcactaaggaggtgtttgaaaaatttatttattaaggaccatttgtttagtagaatattcactcagcttttacggtacagtactaccaagagtagttggatttctgccttggagtcttccacggtatgacctcacacaactctttctcccaaacatcatatgccagtcattacctgcatatgtctaagagggcaaggatcccaccctctatggccaccccaaagcatacatgcctcatgcatgaggtttattatttacattcttacaaattgactttgggtgaagagtttaccctgtattgctaaaaatttgccttgagtgactttcctgagaaactgaggttcccttggcagtcagtatttactgattctaaattccattagaaatccatgatcttctaagaaagttcctctaagttgatcctaagaaggtatgaatagctaattatgttatgatgtatgcctctccctttgctggtctgcatgttctgcttgccagttttccacctgcagttggtggcattaagcagcagctgcattccttttatcttggttttcaattggagattgaggagctaagccaggtcttgagattcttcctttctgctcttttttttttttttttttttttttttgacagagtctcgctctgtcgccagactggagtgcagtagtgtgatctccacttactgcaacctccgcctcccaggttcaagtgattctcctgcctcagcctcccgagtagctgggactacaggtacgtgccaccatgcctggctaatttttatatttttagtagagacggggtttcaccatgttggccaggatggtctcaatctcttgacctcgtgatccgcccacctcagcctcccaaagtgctgggattagaggcgtgagccaccgcacccagcctctgctccatcttatggtcttatttgaaatactttcatgcatttggggtacctagacaaggagagactaaacaaatgatagtttctcctcagcttccattataggttccattttaagcctgctattgtatatcaattgctctttttttattgaaatgtaaagatagtttaattttgttttataaaaataactcctaagaaatagttcaaacatggatataaaatgctgtcaatggaaaaatggagagaggtagaggtatttatatttagcatttatttatttcttcattcaataactgtttactgagaatctcctatttgttgggatctgtggggcataaatagataagatataattctacttccttagaacctgcagtctaaatggaaaaattctaatcttgccctgaaccagcaggaatctgaattcccgttcagatatttagaccaacttttctgatggaaaagtattctgtcttcactgtgaggcatattttgaaagactgacaatgctcattgaggtggaagacagaggcagagatctctctgcattaggcatcccttgctgtttccattctacctgctgtttccaaagataactaggctcagaagcccctctctcatgggtttctctgagtacatcccaatgttcttaagtaatgatgaagtaacaggaaaaaaaattaaaaaccaaagttcagctatataccagcaatattccatttaattctcttaacaatgagatgatatagatatttggctaatgaaaaacctggatactaaatggccaagccaagccaggattcaaagccatgtctatgtgactccatagccttgcacttttaaagtcctaattttggggcctcttgcttagagatacttctctgtgaaggtggcacctattcttggcagtggtggcccagtgagccctttgtgggtagctcccataggttcctctcttgcctctctggtaactcctttgctttctcaaacaactcctcagggattggacagtgcagtgtcactctctcagcaccagctctagaaccctctaatgcaggcagttctctagaccactcctgaggcacttactcagggactgacaccccagacttggggcctcctgtcttgagaccacagagctggagtttatcaccagtgtctcaggtcatcgaataatttggcaaaatctcatatttcccttcatcctcatcctttctatgcctgatatgtacactaaactctggtggggactcagcaaacatttgagtcaatgttagacaggtgacccgccgccatatctgttaggcatgcatgcaaggcagtgctcatcatcatgccaccatgtggcctctggcagtgtcctttgtcccattctgaggaactgcaggcactgtgcttttgagtcacagtgtatcaactttttgtagttttagtatcatctccgttgctttttactgctataagtgcacagtccacttaaccttctggcaagttagctgcttttaacctgccatggaatggatactcaggtattacaatgcttttttacattatacttaaaaagacagatgacaaaactcccaggaaatgacttctctatgaattagtgcatttttttaagttttgaatctaccaaattaattgttgcctgttctaggggcatttttgcttcctccgtggttctcacttatatcatgttatttgtgttgctgagtctttggaaaaagtgattgcaaaggctgttttcttttcccttgttcccacagattctagatgggggtttgaccttgtgattttctgcagtttctttcctacttagccatttttcagccaaagaggtttctgctaacatgtagaattccttttatgaggaatccatgctatcatcagtgcggagtgatatgtgagtcataattactatattcataaaactcctagaaatgtagaatgataagatattttacagattagtttgtctcgtcttcttattttcagtctgagaaaatgcagaccatggagattaagggatttgttcaaggtcccagagatagtgggctccaaatcagaagaaaatctcaacttctagctctaagtccattgcttttccctctctcaatacctattgcttcttcttaaaaagaatcaggaatatctattaaatgattgtagattttatatttaagtttttgagtagttagtctcctgtaggtgagcattccttggaagacaaagcagcaaagtcaaaaatgtatgaatttagaagccagacagacaataaccaaatagaggttctatcatttcctacctatgtgataatggaaaagctattttccattatttccatattttatctacacctcagctttctgatctgtaaaaactgagattataacatcaacatgtagggttactgtgaggattttaaaaattaatattatatagtgtttagaacagtactcagcacatagtaagtattcagtcagtgagatgtgcagttcttggatgtcttcttcccctttatctgaaacaggtaactttttttttcctttatgcttaaaagagtgaattttgttgcagtgttattattttaggtttgtgataaatcttacaaacaaactagtgtgtaaacaagcttaaaatacacttttgatttgcacttttttttttaaagtcctgatctcattcccctcatagactggggaaagagtgaatgtagatttatgaagacatttacatgtcatagcccagcatttcccaaactgtggtcttggacttagaccacttgcatcagaatcatctgtggggattgtttaaagaagaagattcctggactccaccacagactcataaatactgtatcttcatcacagatccagtgatgaagaggcccaggaacctctgtgttataacaaacacaaaatgtgtttttatacactaatttttgagaaccactgttatagatgaattgccagtgaaactccagattacttgaccaaaaatattactttaatcatgctacttccctgttttctcacttgtcttcaattggccaaggagggctatcaggctgtgtgaaccttatggctgtcctaccttatggtacactgaaaatatgcccccaaagatgtccatgtgcttgtcctcagggtctgggaatagggtaccttatttggcaaaggaactttgcagatgtgcctaaattaaagatcttgagatgggaagattattctggattatacaggtgggccaagtgtcatcaaaagggacttcaaaagagaaggaaggagaatcagagttaatacatgatgacagaagcaagagactggagtgatacaaggaagggatcctgagctaaggaagttgaaaaaggaagggaaactgattctcctttcagagtcttcagaaggaaccagccctgctggtaccttgactttagcccagggaggctgattttggacttctgacctccagaactataagataatacaaggcatactgtccctttgctccactctgtccactacttctatgactttttcaaagttctgaataaaacctttctcttgcctaaaagccgtccttggcccttccagccaagagttatttccccttctctgaagttctaagtcaatcagaatctgtgcaattattgtgcatccagttatgaaaagctctgtctaggagtgtttatatgcaagatctttcaaatcagaacacccaggtttaaatcctgattctgccacaactaccttggagaagtttcttagactctccaaatctcattgtcttcatttgtataaatcgcatcagatggtgaagtttagagatgctccacctagaagtgaactgacatggtggctgaatcagagtcaggacttcacacatgtggcaatcatgggaggcattgttccttcggcatagctcggattattgtcataaacatgactattcagaccatgttgttgacattttattaatatgttcatgtttctgtttccctgttaatcccatgaaattaagcatgataataattataatgacaataataataataatagcaaagtagtatagtgaaaggagtattagggtttggttgactttttttttttttttttttgagacacgtctctttctgtcacccaggctggagtgtagtggcacgatcacagctcactgcatccttgacttcctgggttcaggtgatcctcccgcctcagcttcccaagcagctaggactacaggtgtgtgctactacacccagctaatttctgtatcttttgtagagatggggtttcaccttgctgcccaggctgagctcaagcaatcctccctgggctcaagcaatcctcccacctcaacctccccaagtgctgggattacaggcatgagccaccacgcccagcctgattttggtagtcttttatttcacttctagctttgcaatttactggaatgtggaaagaaaagaacatgatttatttatatttaaaatggaaataataatggtacttactcttaattatttcaggatgaagtaagatttcaggattaaagtcttagagtacctaacacatagtaaaaatttagtatgtgttaacttattaacggtaattggtatctaattttcttttttatttgtttctattctatactatgaatcttgatatacctgttactttatatatggcaataatatgagaaacaggaggaataatactggataaacatctaatatttaatgttatgctttgctatcatatgcgttataggatataaatctcacagacagggtttgctgttggagcaatgctcatgctatgaatgtatgcaagaaacacataaagcctgcctaggaacctctattctcccctcactttttttgcttctttcttttcctttttccttcctttctttctttcatcacaggtgatcatataaatagtttggtaccttaagtactttaaaatccattggattttggagcaatttttcaaaatttttcaaatttttcaaaattttggagcaagatttcaaaaaaaaaatctatgattcaatacattgccattcatcattaccttccctttacaacccttcatgctattttagtgcagatgagaactctcctattgtagctagtttgaattcatttttcaaatgagaattcatgagctactatgctaaaagtaaggtctgttacatcttctgcacttccattgtctgctaatgttgtaatatgatttttaagtaattgactttcttttgacacgctttcttatttagaaactcaggcttatttgtaaatctgttatctctatagatgtttatatattttatatagatgttttctctgtggtttgttccctaattattttagagagtcttggaattacttatttttatgtaagacatataaaatagctccatatgaccaaggaaatgtgatacaaaaatgctaggaaaacttggtagtaatactacttttgtggttaaaggcaaggaagggaaaatcaagccaattcctataagaagaaaaaagtatacttgaatatactaaatagatgctccttgtcatttaatatttttaaaggaaagaaaaattacctcttcttttttcttttgcttcttttatccaaagaaagacgtaattttataaataacttgcaggattaaatttacctgaaaggcaattgggagtttcccctctgacctgtggaatagtccgttctttctgtattcttcctagaacataaaaggggtaattgcagtggttgtaagctccccctagaaactttttctagtagcccagtgccttggaaattgtccatgaacttacacacacacaccacatgtgaatttaatatgagaaatggaggattcgtttgaaaaaactataaaacatgtgctctcttgagagatttatgccccttgtgtccctccttggccactgtgcatgagtgccatggctgagaagtaaaagtcagagctgaatgaagcccacattactttatagacttgacgacctgtggttttactcatgaataagcaacaactcatgcttgtacaaaatgcctgtttgtctgggtctctctcagttaaaaagaggtattttaagtcaaatagaaaatatattgtttaacttaccataggcttcagtgcagaaatacaagtcatatattacttcataacatggttgcatagagaagggaaaccatataaacaattcaacataattctaataatgtcttggttcacccaagataaaattaaccacctatcttaaagaatacactacgttaaaaatttatttcttatgtactaaagcgaggatgtatttattacttagaattttttctctgtttttccccaaaatgtggtttctataaaaaaaatcttaatagagaatttggtatcctttcaaatagactttttaatgcagtatgaaattatattataatctagttgatgacaaaattacattgggttatattaactattaatatatatattccccaaatctgtaaactcttaatttctttaatgaagatcaagtagtcatcattttttctatgcttgtacaagttttcccaaaaatgattaatcatattaattgttgttttggaattccacagattaatttaaaagtagtatatgtgggaggacatttcttgaagaagtgtagtagaaaaagagaatttctataagaattatttttaaaggttgaactcacagaagtagagagtagaatagtggttgccagaggctgagggagggagatggaaagggaaggaggagatgttgatcaaagagtacacaattttaattaggcaagaggaataagctttagtggtctgttgtgcagaatggtgactataataaaaatgcattgtatgtttcaaacttgctaaaggatgagattttaaatgttttcaccacaaaaaaaatggtcagtatgtgaggtggcagctttgttaattagcttgatgtaatcattccacagcgtaaaaatatatcaaaacttcacattttctcccataaatatatataattattacttgtcaattaaacatttttaaaatgattgtgtttaatcaccaaagatagtgtcttttattcttagtaacaacctccattttggattagaatatttgaattttatagtgaaaataatctacaaaatcagttatgcatttatcagatagtttataacaaaaatggatgcatcacagtcatagctttcttagcacagttttctgaaatgacttaatcccaaagtaatttacaggcagactaaatggatttattatgtataaacatcctcatctcacattatctaagaaaaaaattgatgtttggtaaaaaaaaaaattaattcacaataataacatgagcccttacacttatcagaaaaacccaggtatttacaaagtatagataaaaatctgttttttaaatttaaatttttttttttttttttttcgagatggagtctggctctgtcgcccaggctggagtgcagtggcgcgatctcggctcactgcaacctccacctcccgggttcaagaagttctcctgcctcagcctcctgagtagctgggactacaggtgcccaccaccatgcccggctaattccctgtattttttttagtagagatggggtttcactgtgttagccaggatggcctcgatctcctgacctcgtgatccgcccgcctcggcctcccaaagtgctaggattacaggcgtaagccaccacgcccagccaaaaatctgttttttaatattgccatattctcacaacaaacagcttcttttcataaattttaaagttcaaggtaaacagggcacctttaaaaaatcttgtgaaaggtgactgccagtgcaggcatggcaaatagggggagatgatcagatgattaaaaaagaatggagaacagattatgaatgttgttgaatacagaaaaaatttaatattctctttaattctgttctgtagttaaaggaaagaaagaacagtgaggaataaaatagagaggatacaaaaagcaggagcaaaaacagatgaaagccttaagttctaatgattttttaatttttttcaaattgttttagagatggggtctcactgtgtcacccaggttgcagcgcagtggcgtgatcaaagctcactgcagccttaacctcctaggctcaagcaatcttgaggcttacttattaaagataaaccactcagatcactcttagtcgtgacatgcagagaagtgatttttttgttgttgaaatataagtcagttggttaactactataatacttcagtaaggatttcagtccttaaatgtgaaaacactttcttgaaattgagtaaatgtaaccattaattttaaactgtgatgagccatataccccacatagcacagcagggtctcaatatgacctgccatgggggcaagagggacaaaaagtgagaaatgttctgagcagtaacttctcgcatagtcacttctagctcctgggctagagattcctaccttacaccttgatcaagatttatgaggaagttaaaaatgcagaaaatgtcaagcccatctctgaagtatgattcccagtttgtataagattgtcatcttataatatctaaacattattcttcatattaaaaatgttttcacatgaaaattcaatgatggcatttatgtactcagtgcccatccctctcaaagaatatccctgttgttttctgaggggcagctactttgatttcacaatttttctggattttttttttcacttttgtagacatatagcagtgatttacaatgattgcctctaaaataatttagaatcaatagctagcaactggtactccttcagtaatgcctcaggtttctggattggtgtgttagttagctgttgccacaataatactgcataatatattacctaaacctgaggggtattcaggaagtatttatttcttcctctcagtttgggtggggtcagctggggtttggctgatctaggctgccttcagctgggcttggcctcagttgcaggttgggtctaggtctactgcaccttgatttcattattcttgaaccaagagctctgtaaggcagagtcttcccatggccttaagttgcaggttgggtctatgtccactgcacctttatttcattcttcttgggccaggagctatatgaggcagggtcttctcatggcaaaaggcagagtaaatgcaccaaagcccaacctggcaataacattttaatcctctgctagtgtacttctgctaacatactacttgtcagcaaaagtcacatggccaagcctaataacagtgaggaaggaaaatatcctttgattccagtggtaggttatgcaaagtcatataacatatggtatagctatgggaaagagtattagaaacaataatgcaatataccatgttccaccttctagatcacaattattcgcatgccacccacacacaaaatagcttacttctgtctcattttgtatataaatataattttaggaaattcccatacttttaatcataagtatgaaatcaagttcaaattccaggatcttattatttatacctgttccagatgcagttcttcttgatctggaggcctgttaatttaaaaaaaaagttatctaatgccccccaacacacactcccaacatgtaatagtggagtactttggtctgtgtgcctctcattgtccactttttgaacagaatattcattgtgattatcctgtgaacaatccattcaaaaagggggacaatgagaggcacacagcagtcattgattggtccatagcaattctgaaaattgccaggtcttcctattctggaagaaggtaatgttctttgattaggtgttacttctgttccctggaaattagctagagagaaaaagagattgtatcaacacttgccttggtgaatgtattcagaagccatcagggtcttcaagacaagcaaagaaaaaaatttccttttatttttgacattttctgtacttcattaatatgacatctcctggtacataactacccaggtcttgagatttctaaagttctcagtgatatgatcttttctttctttatcttactaataaatacttatttaggtttttgcctaggtagcatattttaatgacccaagcatcaaaaagtatgcaaatgtataaagtgaacatgtatttcccaatatatttttatttttcttatctttttttacacacagaatagtagtatactataagtactgcgcaatgttctttttttcacttaatatatatcatagatttttccatatcagtgcattaagagtgccctcattttttagagctatgtattattccatttaatggacataccattatttattacaggacaaatgaggtgtttccagtgtttttccattacagataattgttgcaatgactaatcttgtacgtgtgtcttttcacacatgggttaatatatttgtaagaaaaaaattataaaagtggaaatgtaaagtcaaagggtttaggaggttttgttttgttttgtttttctgtcacccgggctggagtgcagtggcacaatctcagctcatggcaacctctgcctcctgggttcaagcgattctcctgcctcagcctcccaagtatctgggactacaggcgtgtgccaccacacctggctaatttttgcatttttagtagaaacagggtttcgccatgttggccaggctggtcaaactcctgacctcaggtgatcctccttgctgggattacaggcgtgagccaccatggctggcctggtttatgagtttttaattttaaaagaaactactgaattgccttcagtagaatttctaacagtacttactcccaccaataatataaagagggcttctttatctacaatcttgtcaacactgtgtgttaacaaacttttggaatttgctcaatgaagtgaaaatgaagttgcttttcctttttaagcatgagagagaacttatttcaggtattagagaagtttttgcatttttctaaacaaatttactttcttatactgggcctatattttactgggttgttggcttctactgccttcagtagatattagggctaggcacaatggctcacacttataatcccagcattttgggaggccgaggtgggaggaacctttgaggccaggagtttgagaccatcttgggccacatagtaaaatcccatctctagaattaaagagttagccatgcatggtgatgtgaacctgtactcctagctactcagaaggctgaggtggaacgatcacttgagctcagtacttcaaggctacagtgagctatgatcacaccactgcactgtagcctgggtgacagagcaagaccctgtcactatataaagaaagaaataataaataaataaaagataagtgaatattctgtaggacctgcatatatgccaaggaaattagtcctttttaggttaattgaattgtaaatattttttgtattattgactttacttatattttaaacaactatttagatttttttttgttttctttaatatggattaatttattagtttttctattatggcttttaaattttaggaaatagaaaggccttccaccactttgaggttataaaaagaattctcctgtacatttattctagtacttttgttattttattttgttacattactctctgatcctttcagaatttgttctggtgtaatgtaagatagggattcaacttttttctgtatggccacccagttgtcttagcaccatttattgtatagctcatcttttctatacacatatgaaatgccacttttatcatataccaaaatttcatttattttttgtgtctgtaactttatattttgcttcttaaatttacatctctattcatgcagtagcttcatatcattttaattactgaggctttatggtgttttatgtggtagagttactcattcttcattacacttttttcagaattttcctggctgctcttgtttgtttctttttccatataaactttagaatgagtttattttgttctgagaaaaaaaaaaagtattgacattcagggtgccattacatttacaaattagctgtgaaaggatgaatgtttttatggtacattttcttatccaagaacatagtacgcatttctatttatgtattttatgtcccttagaagcatcttaaaagctttcttcatatggttcttgcatatttctcattaagtgtttttctatttctgattctatttatggcttagcatatgtgatactaaaaaggaaggactccagctgttttaaccctggctctacctccaaattcccacagattagaagaaacagatagatgttataagtaagcagataaaagttttaagtgaaaatgagaggacaggtgggtagagatagcatattaggtgctaactagtttttgtcatcccatccaaggaaagccaccagatttgtctggcacacacaacatgggcaaagcacaatggagatagaaaggactcagaaggcagagcagttgtcatttagaagcagaaaagcagtggatccaagaatttttattaggcttggctccatataaaagctatcccaaataacagtgtctttcaacacaataaaggtttatttttctctcatgtaaatgagttatgggtataggcattccaacactgttatgggactaactaacgcatctgtgattcaggcttctttttttccctcattactatgtttagtgtgtgatctccatccccaagtttgcctcatggttcatgatggctgcttaagctctcaccaacatgcacatttcaggcatgaggacaaagaaaagaggagttaggaaaaatgtgtgtaccttcaagtgaagccggttctcttctaatactttccaagaagtcccactctgtcactcatctcctccttaagtgtacaagaggttgctcccaacaatatagagattctgttactaaggaacaaggagagaatggattttggggagacaacttccagtcctgccacgaggaacaaaccttcaaaaaattatatcctccaaacatgttgagaagtgagaaggaaaataccaagaagaaaataggaaagtgaataaaatgagtacagttcaattagttatcatgttttagaataatttaagacaaactagtgctcagaaaaacctgagctagatattgctgctttgattttgtagtttttgagcttgaaaatgtgttcaagagtaattgaatcacatgttcccttttttcctttggaattggaacctcagtaaggggttaaaatacaatccccaacaagtacagttggtacaggggtcacaaagatgattaagacatagtccctgccttgagtaatatgcaatctagtgtggaaggcaaatagatacagagatacttctagtgtggagtgaggagtgatctgacagaggtgagctcagggtaagagggactacatattacaggaacctgaggaagcctgagtaggggagtagcattaggaaggggaggggaggtggaaattgcactgagtcccaaaggatcagttgcaggggagggtgtggatgtatatgagggaaggggaggaggtggtgggaggatagaattagttagctaaagagaagagccaacgggcagagaacttgcccagcaagaacagagtgtgtgaagtctagcaagtgaaagagagtgcggtttattcaagggctttgcccactcttatgtctatcttcagttgggaatgactgaagagatgaaagtggagaggaagccactgggactagatcataaagggtctttgggacaaactacttgatttttccattatgcttgagtgcaggaatcactggaggacttgaagcagggatgtggtgtgctcagacttgcatttcagaaaaatgaatatagaggtacagtgagaatgggttggaggtcagcaagattcaaagaaaagagtactaaagaggcacattagacaagaaatgatgagagcttaaacaaagtaaagagtggcaagtgacttgcaagtccttaaggcgggagaaggggaaagaaactacagtatttggcatggactgaatcaggaagtggggaaaatgggggaaagaaaggaggaggatgctccagtgtctgtcctggacaactatgtgaaaagtattactcttcataaagaagtgaaaacaggaaggaaagtagattttgtagcaaaaataaggtgtgttcagttttctgtgaaatggggttaagatgctagttggacattcacatgggactagagaaggtttgaacttaggaaaagaactgggctgaagaaataagtttaagggtagccttaagccatgctgtgactaagccacggtgagtagggtagggtgaaaggaggacagaactatgaataatacaacatttaggaacaggaggatgagtgaataaaggagacagagaaggaaccaaaaacaaggagaagtgaaactaggcaatagtagcactgtagaagtaaagaaaaacacttcaaatactatagatgtcaagtaaagtaagagccaccatacttattggatttagccataaaaagatcattgaggaacaacgcaaggtagctttagcagaaagataaggatgaggagtgcatgagcaccaaggaagataaatgtaaaatactttcaagcagtgatgctcactgagttagggagaagttagactttatgtccatctttttaaaaatggaagagtcatgagcaagtttaaagccatacaaaggtgagagacagacagtataagaaagagaggagatgctgaagcaagtttctgagaagttagcagcaagaggaatttggagaatacgtgaaaggattaaccttgaacctccagtgtaagaggaagaaagaaaacctggataagtgtggctaagaggctcctaagtgctggggaggacagcaaggacagcaactgtacatcttaatggtttctaatgggtaattgaggaatgagttgcctaggagcagatcctgcatcagtcctgcagccccatgaggctgaagatttggaatttgtacttcctccagtccacgtggctatgtcattttctccattagtgctctactcagtaattcaggtataaggtagctgagaacagtttgatttacacagggttgaagttctcccaaataggtgtgaagggaggataagggacaaggaaggacaagagacttgttggtttgggcaataaagtggctacattggaaagagaatgaagacaaaagaccaacatggttaattgtgtgggatgggcttgagattagatcttgttgatatttaaaaattaattaaagtcaaagtgagaagcgagctgtaactttgattgcagaggagctttgtaatactgtgatttccttctcaagttcaagactgaaaaatgttatttaattgaatgttaaattgttattgcttgatccaaaatgacttaacacaaattttttaaacatgttcaataactagtttttgtttgtttgtttgtttgtttgtttgagacggagtcttgctctgtctcccaggctggagtgcagtggtatgatctcggctcactgcaagctccacctcccgggttcacgccattctcctgcctcagcctcccgagtagctgggactacaggcacccaccaccacacctggctaatttttgtatttttagtagagacggggtttcgactagtattttttttaaatgtagcattgaagttatagctgatttcatttgatgtttgagacttttatttgtgctgtggtttcaaatcccccttttgatacccagttaagattaatcctttttacttacaagctattattctacttcataggcatataaacttttattgcagtagagcccagaaaaactggtggatgatgttgcaatttatatatcacaaactacaataattttaggttctgtcatataattttagtaattttatttaaaatttaagattacccagtttaggccctgtagtaacagaataacttcttcagagatcaattttctcagctataaaatcaagagactagattgcttgttaactctacttctatgattctttattttaatctaattttcaatttcacttcaacttcatgataattctaatatcagtcaattaactgtgcacagttacaaattctgtaactcagtctctaagccttctacattggcacaagaggaaggccattggttagaagagaagtcaagtgactacttgtggatagtttagcaaatatctaacatactggaaaaaaattcaagatgcaaggcttgctgttggataacttggtgatcaaaaaaactcttttcttagactaaatatctaatgacaattgattattataacctatatttaagcttaaaactagcagtatctgtaggatggttctcctgaaagaattatacagttcaggacatgtatggacaaggctgcaccttcagaattaagtattttatttcagcagaatccaatatgaaaattaccatttctttcaagaaaagcattgaagacattatttgcattttagatgttttcaaatgacatattttgaagactaggttgaagccattgttataataaacagcttccaatgtttctcttaaaagagttatactttttgtatacaatagagtactactaatatttttaatgtcttaataatgcactaaatatagtgtctttaaactatcttcataaaaaatgactatgtatctttaaataaagaaaaatcttaatttttagaactatttttcatttttttcaaaacttaaagttttgaattagtgagtttcaagcacaacacaacttgtcattcctctagatttagaattcagattactattggtgactagtagttagaagggtcttctattaaacaaattggattgtttttatttttaagaattttataaatgtagtcattttagatgctttgaaaaatgaagaagctttcatctctcttctaatttgtataaaggctttgtttatataacaagtagaaatttaacatttttctagcattttaaaataaatttgaaaaactacttagacaatattatttttatctttttaagctaaaaacttaaaaacaaatttttatggcagaatgtgtatagctagtgtagcaatttcaaaactggatatttattttatttttgtttcttttttgttaatagtcttttttaagaaacatgaaactcacaatttaagattcatgcacatatgtgtgtacacatacacacacacacacacacacacacacggattccccaattcaaatttttaacataagatttgtgacactgacaatttttgtcagaacatatcaaaagctctaaaatatctcatccctttgacccttgaattctattcccaggagtataacccaagaaaacaagaaaaatggttctgtacaaataattttagcagtgttatgtatgatattaaaaagtggcagcaatctcaatgtccgataataaggggcataattgagtaaattatggttcaatagtagtagtgtggattacattgacaaaaaaagatgaatataaattgctaagaaaaaatatgataatctgcttatgaagtaatataaaatgagaaagtgtagaattaacataatataaattatgcttacatgtaaaaaaagatttctttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccaccacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgtaaaaaaagatttcaaaggaaaaaatttacgtaggcaatatgtaaaggtgaaagtattatcattttctttttaaaaatactttaaatttgatgtgacagtaaacatatttgtaatatagagcttttaaagaatgtcaactgtatgatgaatataaacaagatttctcttttttttgagatggagtctcactcactgcgtcgcccaggctggggaacagtggcgcgatctcagctcactgcaacctcctcctcccgggttcaagtgattctcctgcctcagcctcccaagtagctgggattacaggcatctgccatcacgcccggctaatttctatatttttagtagaggcgggatttcaccatgttggccaagctggtttgaactcccggcctcaagtgatctgcccaccttggccttccaaagttctgggattacaggtgttagccaccaagcccggtcaggcttcattttagtagtaacagtttgatcataactttcatcatatatattatttaatgttagtaaaatatttataatgaaagaagaaaaaatacgtaattgttatgatatgtctaatcagcaatcaaacaaagcttgcactgcctctggtgggacaacaatatacaaaggataaaggtgtgtgacttctatccagaaaacacaggtgatttttttttttctcttggaaagccaccagcctggtgcagttagaagcatttcctgagagtgtctgagagaaggcttgggtggacattggagggtggtgttctacctgcgaattttggctcattagtagggcttgatatcaatttagtggatagagaactacatattggtttttgtttgtttacttttgtatcatatattttggaaacttttccttttacatttaaatgctaatgaaatcacattccctattgactttcttatatttgtactttatcataatacttataggtaagtattgtttcatgaaacttgtctcagttttatctgcagggaaggtgcaaggtggagaggtagaaggacagaggagaggaaaggagagcaagaatataaaatttgttacttggggctgggcgcagtggctcacacctctaatcccagcactttgggaggccgaggtgggtggatcacaaggtcaggagatcaagaccatcctggctaacacggtgaaaccccatctctactaaaaatacaaaaaattagccgggcgtggtggcgggcgcctgtagttccaactactcaggaggctgaggcaggagaatggcgtgaacccacgaggtggagcctgcagtgagccgagagcatgccactgcactccagcctgggcgacaaagcaagactccatttcaaaaaaaaaaatttgttacttatggtttgggtgaaaaaactttgaaaagtaataccttacagggcaaaaataatctgttgacaagacaggactcaaaatgttgactttccacgtttctcagattcaaaacagcctcaggcccttgtgacctcattcaccagaagttcttgggctgctttcaattcccagagacttcattatagaatccagatattctggtgtgtaaaaaaaaattattctctaaattactataaatatattaaaatattatattacactttaggttctcaactttgtccatttactattttttagtatatctaaaacagtatgcgaataaactggtaagactttcagttcacagattcgttataatatcttatgtttctttatttctttctgctgttgtattgatttatgacgttattttccatggtcaattacaagaatttgcatggtagtatagaaaaaaaaatttaagaaattagggcaaccaagatgtccttcagtaggtgaatgggttaatgaactgtggcacattcagacaatggaatattattcagggcaaaaaaaataaggtatcacatcgtgaaaagacatggaggaacgttcaatgcatattactaagtgaaagaagccaatctgaaaaggctatatgctgtatgattccaactatatgacattctggaaacagcaaaactatagggatagttaaaacatcagtggttgccaggggttagggagaaggagggatgatgaggcagaacccggaggatttttagggcaatgaaactactccatgtgatactattattatgtgaatatgttatacatttgtcaaaacccatataatgtacaacaccaagattgaaccctaatgtaaaccatggactttgggtgataatgatgggtcagtgtaggttcgttgattgtaaccaatgttccagtttggtgggggatctcaatagtggagaaagctgtaccttgtgtggagccaccgggtatatgggagcgctatacttttgctcaattttgctgtggacctaaaagtgctcttgaaaatgaagtttattttaaataaaagaaaggaattatgaattaatatgagaattgcaaaaaggatataattgtgggggaattatagaaatcagctacgtaattccatggagtagctctgctgaaagtctaacgatatgctatgtccaaaggactgaagcaactatctggggtatgctatgggggccaacacagaagacatggaaaaaaatcttaaattttaccacatcctgttctatcaatgacctttccaccaactgcttattttggttttactctgcttcatctctattgcttctgaacttccttttcatttcataacagaaactctgagcctttgccgcctcactaaatttcattttaaaacctattctttcttagaaatgataatacagaaaccactttttacaaatacaacatttaaagaaaatcacagtcacctaaataatctgtttctgtatcagagaaggcagtggacctacagacggtctgttcagtcagctgaggatttaggactgaggaactgttaattcccacagcagctctactgactattcgatagtcccaggacctgaagtctttcagagtctgcttcatgcactataaatatataaaatgagaaaataaaattaattattgtgttttaagaatatttatagcactgtaagtttaggctattatattaattatctatctctgggtaacaagataccataaacttgctgcctcagaggcacataaatttattatctcacagattctcgaggtcaggactgtaggcaagacttacttggattatctgctcagggtctcacttggttgaaatcaaggtgttggccactaacaaactgaggtaccagagaaattgtttttccaagtgtttattacagtaatcccctaggcttctcaataagtttcagtgtcttccctggatagtgacattgcagagagctactgtcattttttcaactatcttcagttcaaaaatatttactaagtacttcttatttgccagtttaaagcattggaagtaagagacaaatcagaggacctgttctcagggaacatatgatctactagcaaagcaaactgggggaatgatgtgaagggagaccaagtctgagtcattttgagaagagaacggaaactcagagtggctgtccggttcagtttgtcttgagagaaacatccctgctagtgagtaactaaaattctctgcagatgttacatttgccatgagtacctgttacatttggagactgaagcagtctgcagaggttatccaaattgaaagctaaaatgagattctcaaagaaagattaagtccaaatagcaattttatggcagggtttgtggaggatctggggagagatcacaggcaatggatatagttgagcaatatagttgtattcacccagcccataagggagatgaaattctgacaagggtatcatagggtgaatgaagacttctccaagcagagttatgcagatggatgaaaagattctaggaagttggattgtgtgctgaaagtgtcagcaagctgctggtgccattttgtgccctgaaccctataggtagatccctaaggatttcagctgctaagcccttaagtcctgttagcccttgtctccttctccagtctcctttacctgccctctaattacgactttattgatgctgattgagcatcttttgggagggagacctaggaattgttctgagttgttcactgtgtttgcagtgtaatgacccttggtgccaaagtaacaccattagagggctctttcctggtgaaaaacttaaaagtgtcaggatgacattggtcacctataaattagggaagagagtgcagatgagaattcaggtgaagtcaatgatgtcttgcccttttcctgagggcgaaatacaggagttgggatgtttagaaaagctgaataggcaacgagttgaactttgattggcatgagcttgaatgtcagattgcccagtgaaaatgttctgaaaagaagctccatggttaaggtgtcaaagtgtcacatcagtgaatacaatgtttccttttctgtggcttttctaataataatgaatagccaggaagattttgtggtttacttgcagagatggcaccccatgactttctgtcacctttgggagccagcctgtaagagagtcccaaaggtgaagagactttctctcacctgggagagtaggggtcccaatgtctcgtagggcagtgtttctcaaacttacatgagcatatgaatcacctgggactcttactaagatgcagggtctgatgtagtaggttagagagttggaggaggtgaaaagaaaaatttgcatttcaaacaagtttccaagttattcaggtgcttctggtccataatcttcattttaagtaacaaaactttggagcattagaataggaaagacataccttagatgatgttattgtggccttgatatactataaagccacaaaatgagaggaaacatagcttaccccattagctgatgtatgaattaagaaaagaacgattcaggatcacttacagatctatgagaaaaaaacaaaacccaggcaaacaaatatgcttcctggtggtagtttctgtcttttcttaagaatatgttataaaagaacaggaaacctggcagttgctagaaaagcagacaaacctaactccattgtcccctaagtctgaaggacataatcttctgttttaagttttaggggtcacttaataccagatggttaagtaacttggtcatgctactaccaacaacctatccgcttcatgctctgccattgagcctatatctcccactggctgtcaactgccttcatacagtaatactggaagcaactgaaggtttattcgcttggggatgaattctatacttagttatcaagtattctagagtgacttgtggtcgggggaagggttaagaatctctctaggagtggactcacagtggagccctggttagaagatagcttcagtattctttattgtaaataggtcatttgaatttttaatgccatgcaattcaaggatcgccacataatttgtatttctcttaaacttaatgcagtgaaactttccttgtgtaatagatgcttttgtaatgcaatcttggaaatagttttcaaagttcataagggttgcaaaagttctacttgatctgctcacatatacaattgttcctttccctgctcctctttctactgctatttatatcagctgtcctccaggagatcagttttcttctcagcatctgatataaataaccacagttctctaagcatggtctgttcaaaatttccaggtagttcatggactgatatctggttaactgttttcatgatgtggcagtgacatgcatttgttactaatatctattaatactctttatataaaatgcaataacggttgcacctgacctcaatgatatatttattaaaaaccctgctatttttaatggacaggtaagatgagtttggatactgcagggtcgttcagaaacaagcagcagtgatattcctttaggccatgcccttgagttgaaattttccctgagagtcaactccaaatgcagaaatgaacataatgtacccaatagaatgcagctgtctgatttgccccaagcctattcaatatctttcagactgaaggagtgtgggcttccgcttattttcatgttccttatactgtaactaaaagaaaccggaaatattcttgcttctttgaaaatattacagataataaaaactggaatacaaaactctctttttaggggtgaatattgtttttagtttaaaattgtccatgtgaaaggctagtcagtctagcttctgcaaaaaattcttcaaaaacctttgatcattttaaccattttaggtgtattttgagctaaaatgcactcttgacttcaggtaatgtagcagcagccattaaatacttagaagatttaaaggtcaaactatggaacagaagtagaagttttaactatataaataacagcattaataaataggctttagtttttcttcactggtgctgaatcaaaatattattaaatataattaatgaaatattttataatatacattatgtattttaaatatttttcattttagtcatcaaaacaatttaatgattttaatagaattttaatagatttaagctaacattaccaagcaacttcgtaatttaaatttcaaaatgaatttgtagtaaacacaaacccattttatttttattttatattatacaatataatggatgacaacagaatgtaatgacaatttttcaaatccaatttattaatgtccctagtagtgaccataccaagattatgctgcagtaaacccttttaaaatctaaatcctctccttactattaggtccatgcttatattcactttgtatctattacaaacaacttataaggaaagaatgctggaactggattcaacctctggtttgtattcttaccaggtctgctgacactgagtctcagctttctctttgacgaactgcggactctaatctgtaccttgcctgttttttggagtagtattaactgaggtgaaaataaagtattagatgtgacatgaatttttttattgtatctttcatggtagactgagtaggttttgctgcagtaacataagaaaaacaaagccccaactctcagtgaatataatcttagcccataggcagaagttcatttctccctcatgcttcatgtctacaggagctcagcttatgatccctttgagacccagcctaacggaaaccccatgttagcatgtgttttcataatcaccaggtcagggaaaagatactggtaaatcatgcactggcacttaaaacattcttccagaaatgatacctctgctcacactctgttggccaaagtaagtcacatggccacacaggtaagctcagagtaggtggggaagtgcatttctatcgtgagcctagagggagaggggaacaggcatatctacgatgagatctaatgactatcacaggtatttaaatttaaaactgcaatctatttatcctgtggtgaatttagtggagaaattatttttgccttgcaatggtaaggaggactgttatgtaactttctactatgaattatagatgtgtactgccatctacttctcatctattgagaaggggagatgttctgatctgaaataaataaacatcagaatacttttttcacaatatatgtactatgatgtttctatcagtaggaatagacagctatacaaaagtgaaatagaaaaagtggtaagagggccaggcacggtggctcatgcctgtaatcccagtactttgggaggccaaggtgggcggatcacctgaggtcaggagttcgagaccagcctggccgacatggtgaaaccttgtctctactaaaaatacaaaaattaactgggtgtggtggtgggagcctgtagtcccagctgcttgggaggctgaggcaggagaatcacttgaacccgggaggcagaggttgcagtgagccaagatcgttccactgcactccagactggtgacagagcgagactccgtctaaaaaaaaaaagaaaaagaaaaagaaaaaatggtaagaaaggcaacagaggtacaacagatttgctgagaaatcctatagttagaatggggaaggttttttgggaaacatgagttaaggactggatattgaagcctggaatggatatggatttatggacagggaaggatgatctataatacagagaagtataattcaacacagaaattctgatttctaggctattactggaatacactatttcaaggctattaatgactacatttatgttatttttcctaaaatatcaggaccttttaatctaatgactcagctcttctgtgtctctgtttttcttgcactttgtcttattgctttgccatttaaaaatccagccatgaaaggaattttggaaattgtgttcttttccatgtatgtaattgctccttaaaactgaaaagatcaattaggaaattattggctccttcgtacttcttttaccacctctatttattaattgattgaattgggttcgccaggtttagctctttaatatcagatcaataaaagattaaatgtttaaattaagtgagcacacatgtaactttcacactccttgcaatttctaggagccacatccaatcattcaggattgtcagtaacggcagcaatcaaggctagaatcagagtacttgcaacttttcattctttttcctaaacttcagcctacatttatgggaataataatgcagccatactttcctcaaactcagtttatatttttgtttgaaattaaagcagctttttgagacaagaattaagattgttgccctgatgctagtcatagtgaatttctaacccttctaacccttcttaaaaggagatggtcgtatttgtttcctttggatgccgtatcaaattaccacaagctgagtggttcaaaagaacagaaatgtactctctcacagtacttgatgccagaagtttgaagtcaaggtgtgtctgaaggtcatattctttctgaaggctccagggaagaagccttccttgcctcttcctaacatctagtggttcctagcaatccttgacctgtgttggcgtgtagccgcctcactccggtctctgcctctgtcatcacatggctttttgccctctgtctcccctgtatctctaactccaaatttctctctccttataaggacatcagtggttgaaattagggtccactgtaatccagtgtgatcacatcttaattatatccgcaaagactctatttgcaaaaaaaaaaaaaaaaaaaaaaaaaaaaaaaaaaaaaaaagggtcacattcacaaataccagagtttaggacttcaacatttctttataggagacacaaatcaactcacaacaatggcattattgaaacttttttgtaattttttagcattctattctgtgggatacttcccctcccagcccagaaatttatgccagttactaatttcatcaagattattccccttgctaccgattgccaccttatttaaaagtctgcattattgttgacctgccccaagacctggtttcttgatacccagtcttctctttctcatgattttctccgtgcaacttgttaaacttttactttctttcagaaagcactgggaggcagttcagatgtaccagggtagacaggctagtgatcaagggtgagtcagggatttgctgacaggtactaatgggagtagtcattgaactaaacctgaagcaacagtgaaacaaaacaaggtttgcatcacttctaaagaagatacttagaattgttttcttcctcttgcttcaacaactacattggatatatttagctgaatgctttattttgactctaagcaaaatctcatagcaacatcttttctttcaaagtaccattaatgtaattttgagtacaggaataaggaaaaaagttagaaaatttcattgaggataataaattgagaccaaacactaccagataatacatcaagaacattaacattaacaacatccttttatgttatgctacattcttgtgttaaactaatgtataccatacattatagatactaatgtagtagttgcggaaaataatgacgctctttgattctatctagcagaactgcaaactcttaattataataacaaaagattatgtgttacactctaagtcttgcctagaatgatacaagatatggattttgagttattttaaggattataatccttatatttatgttctagttcaggggttgatgataacctaaggtccagaatttggataggaaaaaaaatgtatttgtttttcctaactctaactgatatttgatatctccttcaattattaatgtaagccacaaacctcaggggttatggcatcaatagaaatcctagattaattttaaattatatcacaggtattgaatatatctcaaatataatttatacttagcacttcttcagaattatgttagctacttagacctgctgtgataccttatttaatgcattaataaagaattcttttaatattttgataactatttctatatactcatttttccttggaatatttttattttatgcattttaaaacaattctgttgaaaatagttcctcgggcttcatgggactgccaaagtggcccatgacacaaaatcggataaaaatttctctgctagttttagtaccttctgtttcatgatggcaaattaaaaggcaggttcaaatgtcagcattatatactacaattttctttctttctcagtcagacaattcattaatcatctgatattttttataatactatacctaacatggggataaatgactgaaaaaacagggttgtaaaaatagaagcatagcatacattcctgtcctcaatgatattcagtctagttagttacatagcatatgaattgccattgtccatatcatatcttaaaataattcttatactgtatttttataatgcttaaaaaatgtactcaaaatgctgtcctctgtaagaactcattgaacaccttcaacagggttgttaaattggtaaagcaagatcctactaggtttataaataaagaaaaggctttcccttaagtagtgagagatgaagcaagaaaacactcagctctcccaaactgtagttcagtgggactttcatttcacatcatttccttagaaaaatcctacgtcagaaaatcttcagtctttttcgttgtataatctatacatctccgaaaagtgtaagatggcttgttaagaataaagtgtggtttggttgtgtaagaccaaccagaaaggggaaagggaagaggaatgatgttgagattgggagagtagttgctgtctgtgatcttttatacagttgatgtgtgatagttgtttgtttgtttgtttgtttttttaattccaacctgttcttaaatgcaaatacaaaaactagagaaagagatggaatcaagctaaggttaaactcaaaagtgacttcagtatcaacttgttggttgtatgtagcctttctgtcacagaactgtgccctgggttctttttactcaaaaagtattccataaaacaaccgcctattggtgcattacttcacagcctgttatgaatgagaatcttgagtcccaccccagacttaatgaatcagaatctgcatgttaacaaaattctcaagtgatttgaatatacagcaaaatttgagaaccacagatgactttcaattcacccataataactgagaaaagactgtaaattcctacaccttgttcttccataatttaaggagtttcttgctttgtttctaccttcattaagggatatgaggcccatgctaagaaaaatgcgtttaataactactttgagtgaaaaatctcactaaatcaggcagttgttcctaaagagaatttaaacagattttcatcatagacagcatggtatctgagacaaacctgcccctgttggtgctgtaccaggcaaactcagtgaatgtaagtgggaaatgttttgggagaacaagaaagcccaagtattgcatttaggcaaatcataagtgcatagtgtgccagagaaaacaaatgtttttcctgcactggctctgacacgttcacacatgaatgtgtttcattcagaaaaagtaaaggctctagaatggcacagtctggttttatgagaaacagatgtgccatggttcacccactccctgaccacctgtggtttgcccatgactcaactttcttgaatgaggggagttaactcttggattctgaacaaactctaaattacatatttattttcttcctcctcatacttcttttcaccactcattgccatgatagaaccttacaattctgagaagtttgaattctcaacaccccaaaacattttcatttaaagttgaatccttgctaaaggtgaatccttgctctgatatttagattgagattctgttaaaagttcaaatagaataccaatttatccagctagttagagtgatttttggtttatattttaaagccacctggttatgaggtatctttacttactgcctattttgttggttgaggataggaattattaccagtcagaaatatgcttttgatgtcattggttagtcacttaattttcagctacctctgtttattggaataatgtggaaaaattaaaaaaaaatttctcagactttaattcaggtaatacctgctgttaaatgttactgtgaactacttcctccaactgctcacaagtagccaaagggaaggatttgaacttcattacattttatctctcctgccatgctctgccttccactctacagaaaagggacagggaaatagtccaatcataggtaggtggatggaaaaatacaaggcacaaatagcccacatagggaataatcataccttaaatagtcactgacaacatttaaaaaaatatatttttatttccatttatgtaatcaacttagggttgttattgacctgccactgaggcatttggtttttcttttcataggacctttttcatttatttcttcagaagcattatctaattaaaaacaaacatttaaattaacatggcctgtcaaggaagtacaaaccagtcttgagttaagctataattacaatgacaacaatgtcaaaaagaaaaagcaaaaaccttttttaaaacctgtaattacttcattgtttataatttttaattggaatgcaagtaacagggaattcaaatttcataaaaccgtggtctgtatatcttgttatcaaaatgctatccaaataacacatggcaaaatgtaatttttttatgtaaatggggagacttatgagacaaagaagcaaataatctggccacaatgtgagtctttggcaaaccttggaaaggaactcccaagtgcatttcctaaaagagtactttgtgtgttcaaatgtactaactctatccagagtgaaagaatgcctaggaatgaataatctgcacaatctgatagaattaagtgttaattatttagaagtaaaatttactagaaatcaatttcagtatcattttcagatttggttttcagaaaaggaaataccctgttttaataggtttggaaatgcaggactacttaaagtttacttgggtaagataacccttaataaattatcaaggtacttttggatttattaattttataaacaataaaactagctgttgctagatgtcggttatagactgagctgtagaaaattaatgatcttttaaaaagacagttgatttttcacatggccactgtatgatgctttttaagttcacttgattaaaaaggtgacaatactaacatttcaaaatttaagtcattctatatgatcaaatatggttctatttgatacattaaaatatcttaatttgaagttaaaaatgctttgaataattaaatagatatataataaaaatgttgaattcatgtgtcatgcatactgattttgtacctcataagcaaagctacaatggtactaacagggtgtaatttgttcaaaataaatttttataccagatgatagtgaccttaaaaaggatttttattgctcaagccttccacttccattcctttgacatacttaatgagtttcatcaatttatgtcattaaaaaagatacatcttctgaatatgccagttgaccaaatctattattttggatgtttgctcagatagagctggtactgggatgaaaaaaaaatggctaagatatggttcctaccattaagaagcctatgatttggctaaagagaaaaatctatccaaaactaggtttaatacaagaagggttatccagagtgctggtagggagggagacacataggagagtaagaagtagcatttgaattggattttaggggataggcaatttttttattgaaatactgaaaggcaatttcaggaaaagggtacagtgtgagccaaggcatggactcaagaaagtacaggatgaatttaggtaatgaatcatctgtgtgatttggactcaaaatgaaaaaaaaaaaatataagaaaataagagatgaaaacataagtcgaagccagatttgagaaagcttaaatgatgtactacagcactgagatgagtctttagatcacgagggaccaagaaaaaaacataattttttgtcattaggtaaaactcatgttcattattaaaaaggagaaatgtaaagtaaatatacacatttacaatacaaaaatcatcaaatactttgaaccacttgaaactgccattttcaaaagtcaacagcagtcaaatatcatcactttaatatagctcatcttaataattgattctggaatcagaaatgtgcattttaccattgactttttttatgaaaataaattattaaaaagcagcataattaggattaatataggcatcactcttatttagtacaaaaagcaatgtatcaattctataattttgaccacctactgtgttctgagcatactgtaaggcgcattacctacctttattcattcattattactcgaatcactttaatgataaatgatggtcagaaaatatttatatagattttcccaaatcatctgtaagtaagtgatttttaaagataggaaagtgatgctcaagatatttatataaatttcaccaagtagttagcaagtaaatggtggtgataggattcaaatgtacatcttttgccttttgtttgtttggggtttggatttggtttttgctatactaccatacattgcttcacgttgggggtaagctatctccatagcatgacccagcaatcccccagtgaaaagtcaaacatttgttgagcatctgtcttgaaggagaccccaaatcaggtgctgggtgtaagggcggacagcatgaaagacgttgtcctttttcatatggagcttatatttgagttgggagacaggtgcaaaacgttagttacaaactaatttcttcactaaagtcatgctatgtgcaaggagataaagtacagatgagttgatgttgtataagaggaggaagttaatctccaaagcaggaaaaacaacctcagacatttaagctaatacctgaaggtaagtagaaattaatgagttaatggaaatgagagaagtttaggcaaagaaaacagcctaggtacagatttctgctttctttaggtaacaactatatctcaaggtaaacaagcttggaatgaaaagcagggtcctaaagaacatagtttcactctggctctgccccacccattgatatgagcaatcaatcatcttcaattatttctgtgagtctccaagttgtattcatacatgttcacaaccacagtccattaaacaatttggatcttcacagtctcctgaattgcctaaattccaaagtgtgtacagtttaggctaacaaacgagaacagccaatccatgtaaaataggggactagactaagttattttgaagctgtatttctgtcctaataacctatcatattgtgtttctgattttctacaagtattaatactataaaattaaatgtttggttttattagaaacagggcatagtggatatgtacagtaacaaaggacaggaagtgaagaatgaattgatcgaggttcttctagatagactctaaaagaatacttccaagagacaggaaatattgtatacccattgtcaatgtttgaatattattaatgaattaataattaaaatgtaaggcaagtttttacttgctaagaagacctgtgcattcatgtaacaaacaccatgatgaagctatagaatgcttccataacccccaaaatttctccatttctcttcccttggtactagtttctgacagtcactgatctgatttctggctctatagtttggccttttccagaatgtcacataacaggaatcatacagtatgtagctttttatgattggctttttttcacttggcataatgcttttaagatgaatccattttgttatgtgtatcattcccttatttcttatatttttgagttggatcccattttacaggtataccataaaaggataatttgtttattctttcattaattgttggatatttggtttggtgattatgaatgaaatttctataaacagtctcagataggtctttgtgtagggactttacttggataaatatataggagaaggagtccttgattgtatagtaagtgtatattcaactttataagaaaatgccaaatgttttccaaagttgctgtaccattttacattctcttcagtaatgcgtgagtttcagttcaacatctaaaccaacacttgctggtgattgtttataaattttagccattctacttggcatctaatagtatcttatagttttaatctaatttgcatttttgtaataatgatggtgaacatcttttcacatgatgtttgccactcatagctcaagtgatgcaccttttaaaatattttgaccaattctaaaagaaaaatgggttgtttgcttttcattattgaattgtaagagctctttatgaattcaggatggaagttatatttaatgagatgggtgttttacatatattttctctaagtctatgacttgccttttaattttgttagtatgtagtactttttaaacttgtgtagattctttgagattttctacatagacaatcatgtggtctccaaataaaagacagtcttatttattcctttctaatatgtataattttgatttcttttttgtactttattatgttggttagaaccttcattatgatgttaaataggaataatgagagcattcttgccatattcctggtcttaggtaaaaacactcattctttcaccattaagtgtgatgttacttataggttaacttaaggtgccttttttcaggttgaggaagttcctttctattccaagtttgctgagggtttttatcattaatggatgctaaattttgtcaaatgctatttttatatctattgacatgttgatttttatttgtgtaatagttgttgttaatatgctgaatattgacccaaacttgcatttctgggataagctcacttggtcatgatgtatcatcttttttgtgtttcattagatttgatttactaaagttttgttgtggtttgagagcatattttatatcagcgcttctcaactagggacagttttgctccccaaacgacattgggaagtgtctggagaaatatttagttgccacatttgagggaagagagaggattttctacgggcatctagcagacagggaccaaggatgctgccaaatatcctaaattgcataggaaagcaccacacaacaaagaattatcaggccccaatgttgatagtgcaagttcaagaaatgttgctgtatgggatctcaaaaattttaaatttgttcagatttattattttatgacccagaatatgactatctcggtgaatgttcaatgtacacatgaaaacaatgtttatccttttaatatagggaagaatgttgtataaatgtcaattaggtcaagttggttgacagtgttgttcaaattttgtatatctttactgaattttatacctacttattctatagattactggaagaaaagtgttgaaatgtccaactataattgtgagtttgtcactttttttttagttctctcagttttttactttttattacattttattttattcatgtctgttagttttttgcttcttgtattatgaagttctgttgttaaatatattcaggtttttacatattattaaagaattgacctctttattattatgtaatgtctctctattcctggtaatatttcttgttctgaagtctactttttctgatagtaatacagtcactccagctttcttttgattagcatttgtgtggtatattttttcatcctttaatttttaacctatgcctttatatttaaagtgtgtttatttataacacatataaagtgcatttatttatagagttgggacttcctttaatttaatttgacaatttctgtctattgatattttagagcatttacatttaatgtgattatcaatatggtaaacttaagtttaccatattgctagttgtttactattgatgtaatatgttctttgttccttttccttcttttcctacctgtggattaactaaatatttttatgattccatttttatctacattactgatctataagttgttcctcttttcaaatatttttagtagttgtgctggtatttacagtaaatatctttaagctatcacagtctatcttcaagtaatttatatcatttcacctgtagtatcaggacctcacagcacatattccatttactcctttccattctttgtgttattgtcatacattttacttctacttataagcctcacaatacattgtaactatgcttgatttagacggtcaattatctttaaaggtgattaaaaataatttttaaaaatatcctttatatgtacctttatttctatcattttcagtgctatttatttctttacatagcccacaatttccatctggtaccatatgcattctgtcttaaggacttcctttaacttttcttatagcataggtctgctggcttcatgcctgtcctccagcagcaggcagtcacctcctgcatgcctctgccacagcagggacctctctctcgtttcctgctcccagtctttctcataagcacctcacgcaggcctgtggaaaagtttataaataagtgtgggcttccctgtgggtggagttcctagatatttcaaactaataatagttcatacttgtcttttagaaatttgtgaaacttttagctaattttttcctactcacatttgtagggaggccacctatttttcccatgctttgccaaagattaaatactttgtatgtccctcttgaggggcatatcactctttgaacttaatttacttggctgccttgaacctcagctctctaatgggctcaaggaaagtagtaattttgtacatcttctggcttttggtcattgttagcaggaacaacgttctcttgtatctctctacaacatttaccaaagtggaactcctcttttcagcatcttaaacaaattttggatttgaaatggctcaaagcatttgggaactctattttacatacattttaaaatgaagcttctatagttctgtggtatcttatatgatcttaattgttaattagttggaaggatatgtgtcatctattagtaagttgtagagtttttgtttttagacattatttgtcataaccccaaagggtctatttctacataagtattgaaatcatttttcaaaaagcagcaacagaaaaagctgctataaatttcatggctaaagattgggagatatttgggggtgatggtatctgctgatattaaccttgtgatcagcctaaatttctatttattacatttttacttgtttttattcctataaatattatatataagattaatagtcaacttatggaacatttgtcactggaacatatttgtcattccctatttatatatatacaaatgaaatacacatacttgatcgaagtaaatgcattaaaaacaatcatctttaattcctttgaatctgtactacatacaaacgacatagttttaggattctctacaaattcttaagtataattaaatcagaattaaggtgatcatctacatattgaaagctgccttccaaatgaatgaaatgtaatataacatttcaaatataaaaggaaatgttgatgcccacgaaataatttcatcttcatttatctaggatcaaatattgtgaagaaatttaacattatctatggattaatataaagacaaatgcgatgggctgtaattgagcattcaaattaagtttttcatatagtgtgctcatatgttagacctttaagaaatgtgaatcagatctaatcatagcagcagtgagtgataatgcagtttgccagctaaggcaaggcaccccaggaaaatgctattcatataacattgcctaatcagtgtatatctaaggcatctttaaaggaaaatgtatacagatgctcctccatttatgatggggttatgtccagataaagtcattgtaagttgaaaatatcattaatcaaaaatgaatttaaaacgcttaacttcccaaacatcatagcttagcctagcctaccttaaaagtgctcagacacttaacattaacctacagttgggcaaaattatctaacacaaagcctattttacaataaaatgttaaatatctcatggaatttattgaatgccgtactgaaagtgaaaagcagaatggccgtatgggtacttgaagtatggtttctactgtgtgcttattattttcatggtgtcataaagtcaaaaaatcatagcgtaaccctggttaagtcagggaccatctctatgtccttcatatacaagattttattattttacttttcagaatttctcgctgtgatgaaattaatgtagttgggaaaatagtactggatttaaattcatttctaagaacagaagaaaattaaagatattaattatgaagttacaaaacatatcaatgagctctttttggaatttgagtttagtatttgagtcagagtgatgtgagagatatttatttgccaagcatgaagcagagacttcagtggctgcagtagcatagtatctgctcccaagtggtttccagtctggtaaagggatatacagagcctcagtctaagtgctgcaggaggcatggacaggattcagaatgcccagaggtcccccaggcagccagggaaggggaacactgaagatggagatcattggaggaggacggcattgcaagcagaagataagaaagaatcccttcttctcatccacatgacacatatcataagatcatatggcctcaaaatcatagctcttcttattttccttaagaacatggagtttcacatgcaattaacttaaatcttcccagccctccattctcccttcaataattacctttctattttgctgttcatctaatgcgctttaacactatgctatgttagaactattttttctattctgtttattttcaggcttttaagaaatttttattagacgattttagtaattcatgtgaaaaagcataaatttaccaatctgtagcagcagataatccaagggagagttcatgctagaagtgggggatcaggagtaaatattctcctaactaagagcttaggtcaaactagagtccaagagagtagagaggtaaagcctgtgctaagagccagaatatagcaagaagcttttgatactctcagctgccaactaggaaacgggtgagaacaggcacacaaatgagcaaaggggtagaaatgagatttacagcaattgtaatatatttattcagtgcctataatcatctttgaatacactcatttatttagactgtgcattctgtgttgcatatttgttgattaacattttcattagtttaccattgtagaaacaaaaatagtaagttatgtgtctgtaagaaagagacatgacctgctaggtcctgtccagaggtcttactaacttggctgacttaaagatatgattaaaggaataaagccatattaggaagaagtggttattaacatcacccagaatggccagaaatttcagcataaatatttatgagagagtccactgaaactacacatttagtaaagggaaacaagatctttggtttttgagaactttctactggacaaaaaaccttgaagtcaaaagctagtcaaaggtaccacgtgatacttcttgtttcaggtgaagctgcctgtctatcacagagcaaccactgcacaacatccagagttggcattaaatccaaaagctttggagatgaatgacttcgttaagattcctctctgggaatgtgaagagatgggatctaaactcaaagactctgatccataaatttttggagctgtaagtctgaggtcaaaagacatgaatcttaggaaacaaatttccttttctccagggcttcctgtctctttcctcatccagttataagggaaaaaaaatattacagtagaagaaaaaatggtcagtgcaagctgatcttggctaaggttaaaggagggccatacaataatggtctgcctcttcccatttttatttagcttcccaatagaataatgatcatgctgtggcatgttttggaataattatatctggcagaggcatcactcaggttttgcctgtatgtaaatggaggactgtttccttgtgagtagatgaccatgcctcccaatttacctggcactgtctcaggttgtgcccctttcttctcaaaataccatgatttggatgaaaatataaattgccaccctgttaatgagccactgttttagagatggctccctcccagaaggaaagctacctaaaataccctcagatggtattagacattaacgaaaaataaactttaaatattttctagtcacattaaaatagctaaagtaaaaaaagtgcaaatatcagtaaagggataatgcttcacatacacatgcatgcacacacacacattcacacacacgctctggcctatttttcaaatggaagtgcctgtgaggcttaaaagtatgataagaagaaaaggaagaaaatagataagatgtgcaaatgagacaacccttactaaaagggtgaagggacaaggagaagtgcagccaatcctgagcagaatgtactgaaacattcagcatttcttccccaggatggcacgctcctctgaagaaatgattccatacgaaggagaagggtcccctttccagatgacaggctttgtcttcaaagcaagggtatgcaactactggactttgtctatacttggtaacttttataaataaatcaagtctggtaattcatgctgtaccaagaaaggctctagttagaagagcagcattagcattttagattttggtctaacagacagtgtagcaaggtctcctgggtaaagttttaagagcaattagagctaataaaaagacaggcttgtcagcacctgaacaatgtggaaaaggagagccagtggcttggcttttgattttgaactggacccaagttaaagctaatagaattgtttttttcaggagtacgtgtgtgtgtgtgtgtgtgtgtgtgtgtgtgtgcacgtgtgcacttgtttgtgcgtagcctgtgcatggggtgagggggttcatgaacatagatacagttcagctttggaataaaagtgaaaggcatttttagttgctttcaaaacctctaaaaatagccataagtctctgccaaagctaatatagacaggattcccatggaaaccctctgggctagaaggggcgggtattattttttcactggttattggttaaaagacttctacccattttctataatgtaggagtgtgtttactgtcaaaactgatgaatcaaatcttaaaggcacctgcttatctgttctacttatctgaaggagagaaagtacagtagtgtctgtacttaataaaaaattttcgcaaggaatgcgttagttaagaaaaaaaagtaccaccttctttcacattctgtgcttatatgttctgtagctagtttttaaattcctactttgagtccatggtcacagccagatttcatgatatttttacccatatatttatctgtgataacagtcatctgtttttacattttctcattttgggtggtgtcttatttggatgtatgtgtcaattccgaggcaccaagaattaaaggatgtatgatcagcctagaatttgacattgtgaagttaacccttaggaattttcattttcttcactttcagctggaagattaaaatttcaaaaaatattaagagctaagaatgatgaacttatttcttttcttttgaattataacacctttggggaaagtattttaacaaaataattagctgtttatcagtttacaaatacagagataagaagaacttaaatctttttaaagattacaaaaagcaagaatacaatagaattctaaaggtattttccatatatttcagtagattcagattatgactagttaaatgattaattgatagttattttaaaaactttgattgctttattctttgattttattctttttcttctttctaataatgcgttttctaaaccatattataagtaataattaacatatgtacatggttcttaataacctactaaacacttccatgtaaatcatatttaatcatcataaatataaacataaaggtttataaagtcaccatttttataattattctataattatgaaataatataaatattctttatatgtcattttgttttatttcttcatgtggttaatgtcatttaacttatagttctagaagatgtttttgcagtaactacaatatgcatatttttttgcttagtattttacatctttaagtaaagattgaggaggaaacgtaatgccctaaaatattacagctcaccaaacacatcatggagtcatattttaggatattcttagtcccagatagcaggagtagtggctagaaacaaacctttgatacgtagaagtcccccagattcctagatagtatctggaagcatccagggcctggtgctgaaaggatctggttttcttctcctgttgtagtggctaagaggcctgtgtagaaaaagctgtgggtctcacagacagcgatcttatcgctagagctgggttaggggtatatccaggagacattttccttctctgagccccacttgcaagagacattcgctatacccagagggaactccagtagaagtgccaggtaaatctgaaatatgtgctaccattccatataggaaaaattcaaaaaatcacgtcaaatatctggggggaaggaaaggaaagggtatcacagtcaggaaataacatttttgtggttaactttacagattttaaattgttggttttagttttgtgagactaaagggaggtgaaaagggaggagggaggtcccagtgtaaaaagcgtaggtttgggaattactcaggcctgggttttaaacacagctttgccatccaactagccaatgactttagaatacttaaaaaaaaaaatagaatacgttttaagtttagatcttacacactttttgatcgaagacagcagagttaattatatgaggtggatcgtgtatcattttaaccaggcatcagctttcacaatggttaaacaatgcttgacactgaaggattttgaaaacatcaggacgaaaaggtggtgtagtatggccaaaaatgtgatactgttgtaatctgccagaaagctgatttagcttgggcagtgtttcctaggtactagaataaacacagcctattgtccagatgagaagaggatgatagtgtgttgtgattaaatgagtaagtaatacttatatattgtttgctgctgtttgaataactaacatttactgctgtatctcatgaattatttaagtatattacaatcatcaattttagttagattttctctttatttactaaattggcctatcattgtcacttatatcttatttaaatatttagtcttatcttcccaagatataatagtaattgggcagcactgagccattttagtaatgcttgtagtaagcacacacatgcacactgaaacctatacaattatattgataagctattatccagaatcggatgttttcataaataaaaatttgttccataaatggtagattttagtttacctaggggtaaactgtgaatcatataatgcatcacttatttattacaaacataaaaattcactttcatataaagatatatctttatatttatttttctgaaaaaatgctagcactctgggtcctgggtgtgtcacttccatagcatattgaatggtattaacaagccttacattaattattttttaaacaggcttaatagccccacaggcaggatgtgttggccttaaagggctgagttattataaacactatctgtgtagacatttaaaagaaacagtgtgggagttaaaattacaggttcaagaacctatttttcgtctttctcccacacatagactcatctcctgtcatattatttcccaaaagtttgcaaatttccagtgtttctccataaatccttcttttacataagtgtataaaatgtcaattacaagtcatgcttggtgccctttattgtcttaagattcttaatatctgaatgcttagaatgtaaattcttacaattctaataccttagtatttgaaaatgttatgttatgagtacaaaggtgttcatttcaagactgaggcttctattgtaatttctgtcctaaaggaggcctccagccagggctttctctgaattccataatattctagttaagggtttggcaagtaaggaaagggaaagcctaaagaggaagacacatgaaagaacaaagtaatgttttccaagtagtcccttgaggggtaaacatgagctgttgtggaaagaaacaggacttctcggggagaaaaaacctgggttgaattctgattccaccattttgttgtcctgtatccttgagaaagtatgtaatcccttttcacttttgtctccatttcaatatagaacactaatgaaaacaactttttttgatcagatccagtactctcttttgtaaaatgattcagtacctctaagttactgtgcaagtataaggtcttataatcattattttgataatagctaccaagaataaggaaagaaaatctacatagccaagtcactagaaaggctgcatttgccaaggtcatacttagaacactgggaaatgttcatatgtgacatctaataatgaaaaaaaacactctgttagtttaattgtaaaattaggctcgattctaaattgtactcatttggaacaacaaaaacaaaaataaaaaccaaccaaccaacaaacaaactgtatgagactttatcaaaatatattcccctaacccactaggtagaaattggtgacaaaagaatataaactatttggtgtgacaaataaatattaagtatctgctatgtgctggctactatgggaagtgctaggaatactgttttgaacaaggaaagcacaatccctgatcccttttttatttttcttctatttttaatttttgtgggtaagtagtatgtgtatatatttacggggtacatgagatgtttgatacaggcatgcaatgtgaaataagcacgtcacgaagaatgggacatccatcccctcaagcatttatccattgggttgcaaacaatccagttatactctttaaaaagttattttaaaatgtacagttgttattatttactatagtcatccttttgtgctatcaaatagtaggtcttattcattctctctattttttgtacccattaaccattcctacttccccctgcccccagcaccccactacccttgcaagcctcttagtaaccatccttctagtctccatgtccatgagttcaattattttgatttttagatcccaaacaagtgagtgagaacatgcaatgtttgtctttctgtgcctggcttatttcacttcacataatgatctccagttccatccatgttattgcaaatgactggatctcattcatttttatggctgaataatactgtattgtgtatatgtaccgcattttctttattcattcatctgttgatgaacacttaggttgcttccaaatcttagctgttgtaaacagtgctgcaacaacataggaatgcagatatctcttcaatatattgatttcatttcatttgggtatacacctagcagtgggatttctggatcatatggtagctcaatttttagttttttgagaatccttcgaattgttttccatagtggttgtactaatttacattcccaccaacagtgtacaagtgttcccttttctgtacattcttgccagcatgatcccttgagtttatattctggttgtgggggaacagtgggcagggtggagggagaagaaatacaagcaataatcaataaataagaatctcagatcaagataaggaccatgcagaaagctaaaacagagcaatgagtcaaaatgaccaacgtctactttacactgggtggtcaggaaagtccatggtgatatttaagcagaagtcttaatgatcaaaaataagccaacactttgaagactgaaataagagtgttctgtgaagagggaccagatattatcaaaaaaggtcctaagacagaaatgatgtagagggtcttgaggatcagtatggctgaaacataccaataaggcagacgtgtggattcatgtactgagaaataggcaggaggcagctgatatcaaccttcctatatcacaggtaagctgtttagattatattataagcctgatgagttaccactgtggctttttaggcagaagaatgacttgatctgatttgtatgtatataaaacataatgctctatggtgattagactgtaggtaggaaacaagagtggaaactgggagacctgctaggagattattacagaagagacctagtggcttcaactaggatgacagtaacaaagacattaattcattcatctgtttatgccttcaacaaatattaactaatgatctactgtgtgccaagtcctctctagatatcaggcatgcaccaagggtcaaaagcaaagaaactgcctttatgtggcttatattcagtagaggatatagacaatcaaggggaattaagagtgatgggtctaattttagataggatggtcagggaagacttctgctcatacctaaatgaagagagggagcaagcattgcagttgtctgggacaaaagggactcagacagagagatagcaagaagaccctaggatgggagtgtgcttgaggagttgggataacagcactatggctggagcacagttcggtaggagacaaatggcaagagtttagatctggaggccagctaaaagctaaatcatgcaaggctgggtagaccataacacggcctttgaattttgttctaaattcactggaagtcatcggaaggctttgaaaaaggaagtgacttgatctgatctgtattttaaaataatcactccagctactgtgggaaaaaaagataatggatatggcggtactagaaaggaagcagaagaacctatttggagactattggactaaaccaggcaaaagatgatggtggattggcctaggttggtagcagtggaagtagtaagaattgttcattttccagatacaatctgaaggtagagcctgcaggatttgctaacactttctatgttggatatgagagtaaagagccaagaaaattccaaggcttttgtcctgaacaattgagcaaatggtggcaccatttgctggagatgagagggaaaaatatggtatgttgggggcaataagggaaggttggggatcaaatgtttgcatttgggcatgttaagttagagatgcctattgtggagtttgctagtagaaagttgtatatataaagctagagtttagagtagaagatgaacttagagatatatatgtgtgtcatcacagcataaagatggtatttaagctatgtaactaaatgaaatcacctagaaaatgaaggtaggtagaaaagaggagatgaggagaatgaatttaaaatgtgctttgaagatagagataagagaacttgctgatgggtcagggtaaggaacaatcatagctaaatttgttttcaacaaccgagtggataggtataattcactgagttgggagagactggagaaggagcaacaataagtttgtaggaaaggaatgaagagttgtcttttggtatgttaaatttaatgtacctgttagaaatgcaaatgaacttgttaatgcataatagacatttaaaatcaagagtgaaatcagttaatggtgttagggtaactggatagccacatgaaaaagaatgaaattggacccttacctcacattatacacaaaaattaagtcaaaatggatcaagacctaaatgtaagagctgaaactgtaaagctcttagaagaaaacacaggagtaaatcattataatcttggttttgagaaagaattattaaatatgacaccaaaaacccagcaatagaagaaaaaattagataaatttgatttcatcaaagttaaaaaatttttgtgcttcaaaagacaccataaagaaagtgaaaagagaacccacagaatgggagaaaatatttgcaaattgcatatccgataagattataataaccagaatatattagaaagtcttacaactcaatagtataaagacatttcattttaacaaatgagtgaaggatctaagtagatgtttctccaaaaaagatacgcagatggcaagtaatacatgaaaagatgtttgatactgttagccatcagtgaaatgcaaaacaaaagcacaatgagataccacttcaccccaattaggatggctatagtaaaaaaggcagataatgatatgtggaggaagatatggaaatactggaaccctcatacatgctggtaggaatgtaaaatggtgcagtaattttggaaaacagtcaaacagactggcagcttctcaaaggcttaaatttaatgttaccatatgacccagcaattccactaatagacatatatccaagagaaatgaaaacatatgtccacacaaaaacttgaacattaatgttcatagaagcattgttcataatagcctaaaagtagaaatgcccctaaatgtccatgaactaatgaatgggtaaataaaatgtggtgtgagaggcagggatgtgtcagagatagttaagaggaattgggcagtgactactaaaaggtacaggatttcttttagagggaaccgtcagctgaaacctaaaaagaggctgaatacaaggagaccagatgactgactattgagtttggtggcctggaaacaattggtggagagccttcttggtggagttgaggagggaagtcgaactggaatggatggaggagagaaaaggtgaggaagggaagataacttctgatagcttcttcaagaaattttgctttgaagacaaacagaatatgggataggaaatgggttaaagttgacttttgttatttattttctttgttttagagcagttttgctttttgatgtgactgttttagtatagaaagagaaattgatggtacaaatgggagatagaggataattattgaagtctctgagagagaatgagtccacatggaaaacggatgaaacttagatagagatggggcccttcattcaacgtaattggaggaaagtggaagactgagtaggtaaaaataagtggccccagttatcatatcacaatctacttcatgagaattaatgggcttctttatagttaccttatttttaaaaccactgtgtgtgtgtgtgcgtgtgcattaatgtattaaatttattttcattgtaaaaaaatttattttcattgtaaaacccaatttttgtttccctttcatcgtgtcccaatctgggatcatccaacatggtttacatttaaaaatatttcactgcccacttcacaattggagctatctgtaaggctttagccaacaattcttgcagtggaggagagggaagcatttcatcatatggaaaaatagccactctgcaaatagtgagtctcccaatctttggccctagcccggaagtcctcaagtagtactctcctttcctcagatactttgcttttcctatttccacgtatgcaatgatcagaaaaggataagcctccagaagagaacagagttaaataattttgactctaaaacagaaatatcatgccataccaatacatgaatagagaacaaatgcatatatattgttttgttcaccttttcaaaaggaattttgaatttttgaaagtaatgtgatataatgtttaatgctgtatgcttaataaaaatacatacttttaaggtaacagctatgtttggattgtttgatagaataaagtatcaaaataaatctaagcatgatcaaatacaaaatcatagatacatcataaaatatgagggctatctgtatttttcaatccttagaatcatctggtggagtttctaaaataaaatatcgatgtctaagctccaccccagatcaattaaatcagaatatctggaggggtacctgagcagagattttttttttttaaagctctgtagctgattccatgtgcagccagggttgagaaactttgggctgattattgacaatttcctgtagaaatgcacagaactgcctcataagcttgagttctggacattgcagactgcctgctactgacatacagaaggaaaaacaaacccactaaaatgcaattctacaccttctgaaacttcttatttcatagctttgtctgaaaacaaagctttgtataaaggacaagaagttaaaatgttgggcttttctcttggtttgtttcaagatggggaagtagaataaaaagttcatcaggctttggagatgcaaagaactcaacagctgttaatttgatagaagtgggaagtcagccagactaagaactatttttaggcagtgtattgacaggtgttttaccttctctcacaccctcctggacagggcttgcctagagtagatctgagttttaaaactttcaataaaagaaacagaagcctgtaaaaacagagtccacagcaagtaagccatctctacaccatctcaagcaacaggttgagaaagcttaaatgggagatatggttttaaaatggattttaatggctcatttgactgaaatttattttagggagaaatggattctagaaaatgttggcagttatatcaggtgaaattattttgttgtcaataatccaaaaatgagagcaatgggaagagaggaaagagacaaaggccaagtaggtctagctcttgagatgatggacatggtacctcagtaagcattgggaaacatctcacatattctgcttttgtgttaaagatgataaagcattggtagatgatggtgaaatgtttcagtgatggcttgacaagtaaatttatttcaggggtttgacaagaataaaatataatgaaacaaaatattataatctttgaaagatataaaatacaatgacggtaaatattataatctgcagaacaatcagttttgtttttaaaaacagaatctgtaagatgacctgaatcacacatttataaatcaaaaatatttagtatgaaatcaataattatttcgagaaagaaaacattattcatatatgtgtaccgattttattttccatacttttagagtgctgtattgcctgtggactttaaatatttaaattcctagtctgttattaatactaatttagtatttgcatgcgaatatcattttagttttatcattttcagttgtagctgaaaagctaaaactacttaaggattccattgtgtatacaatcataaattagtaatattagcccctaaaagttttatcaaagtaaatataccactgcagaaaagattccttcatttatttattcatccacaaattttactgctcactaatgtgtcaagctctctattggctttcacatttagagagaaatatgaaattctctcagccctcaagggaccctcgatctagaagggggaagggggcggggaattataaccaaagaatgccagtaaatttggtgcactgaaagaagttgttgcacatatagtgaaggagcagataaaggagtgggcagccttctggagcgtgagtggggatgaaagtgagagaaacaggtttgctgtgtgcatgcagatttaactgtggccaggcagaggggaatgggtgggtgtggggcagacagtgacaacagcaggtctcaaaaagtaagtaggcatttagggctcagacaagatggaagggtatccatttattccaacttatgaaaataacaataaatatatcttgacttaaattaaacttaattttttgaataaaggacttgaagaatgggaggatgttcaacctattaggcaaccaaagtatttttcagcaatttaaaagccaatagtgtacaaggattcccttttctccacaccaacacttgttatttcttgtctttttgataatagccatcccagcagatatgaagttatagttcattgtggttttgctttgcatttccctgctgattagtgatgtagagcaccttttcatatttaggtgctcttcccacacacacaataaagggtaactatgtgagatgatggatatgttaagacatttgaatatagtaaccatttcactgtgtgtgtgtgtgtgtgtgtgtgtgtgtgtgtataacatcatgttctataccttaaatatatgcaataaaaatggcttctgatggtaatgttatttctaagtaggaactttttttcaggcctcattaaaacaagacttctgtgattttgataagagatttatgtagtagctcttgtgagttgaaaagctagggagatagatacaaggaactagaggatgcaatctatggttgggttatttacgtatagggaacaaggacctcgtgaagccctagactattatatgcaaaaagcatgcttttgtttatttctctggggagatagtctatggttttcagcaaattctaacatgattcataaccctaaaaagttgattttttgccttaagaacttactttatatattttatgataccgacttttcactgagtgtctttattattttgagtttatgaaaaatattgcactatgaaatttagccctaaattagcaaattctctatcttgacttacattttctctagtgcagttacaattttaaggctattacatatcttttaaaatacttacacagagaatacatcgatgcaaaagatcacatacaaaatttcaatgtagacctgaacttataatcaaccattgcaatagcctctaatagcctattttatgacaaagtgccatgaggaaactctcaaagctaattgttgaaaagaatgataatgaacaagttttagagagtggacagcaggttataatatttatatataactcattataaattgtcaagtggctttatacactaagaagagaaatttattttctattctggtaaaataaatagcttcagagaagtgaaaataaaaacaggtattttgacaacattaacacgtgttaaccttgtgaaatggccatcctttaccagcctccatctggggttgttctaatgagagaatgtagggaaagtgctatgcatctaacatgtcagccgaagctagctcaaaattcactaaatcccacaagatgtattgaagggctgtgcagcattcctacttgctcaacctgtcaattgttgcttgttggataagaaaacaacattacttttaaaaaatgtcactgaactgcaatgttcagaaaaaataacagcaccaccctttctcacttgcaaacattgagaaatgttcaactacagctttctcctaagaactctgaagctaccaaagagcttttattgaaaggataatgtctgcacacctaccacacctgaattgcaatagttctttatagatctctaacaggaaattttaaaattaaactatattgttaaggacagcttttgtttgcatgtcacggataatctagattttagcttatcagtgttgccccttgtaaaacgctatattgaatatatcaataaacaaaaggatctagaactagaaataccatttgacccagcaatcccattactgggtcaaattactgggtgtatacccaaaggattataaatcattctactacaaagacacatgcacacatatgtttattgcagcactatttacaatagcaaagacatggaaccaacccaaatgcccatcagtgatagactggataaagaaaatgtggcacatatacaccatggaatactacgcagccataaaaaaggatgagttcatgtcctgtgcagggacatggatgaagctggaaaccatcattctcagcaaacttgttctcactcatatgtgggagttgagcgatgagaacacatggacacagggaggggaatatcacacaccagggcctgtcagggggtgggaagctaggggagggatagcattaggagaaatacctaatgtagatgatgggttgatggatgcagcaaaccaccatggcatgtgtatacctgtgtaagaaacctacacgttctgcacatgtatcccagaacttaaagcacaattaaaaaataaataaacaaaggtaatattatatagatgctattcacttgtctaaatgtttttaaaagttaaatttatatttagtttgaagcattcttttcatacctgaaaacatatatttttttaaatggaaatctttttttcacttccctaacaattaaaatatttggcaaaatcaatatcaaactttctaaagtgtgtatggaaatgtaaaggacagctaatgtcttcagatggatttatattacaaaatataagacctattatagaactgtagcatttaagatagtgtagtattggtgagaggttagatagcagtaaatcaatggaacagaatagagattccagaagcagacccatgcttactggtcatcttatttatgacaaagatgacactgtggtgcagtgggaaaataattttttcccccagcaagaactgcaaggtcaattggatagccttatggaaaaaaaaatgaatcttgactctttcatcacaacatacatgaaaatcaattctagatgaattgcaaatctaggtgtaaaggttaaaaacaaaatcttctaaaataggggttggcaaacttttcttgaagtgcccaatattaaatatttcaggctttgcatatcctacaatctctgttgcaattattcaactctcttccatggtagcacaaaataagtcataaacaatatataagcagattagcctgtctgaactccaataaaactttatttataaaaacaggtgacaggctgggtttggattgcaggctatagttttccaatcccttttctagaacatctttttgaagctcaagtaagcaaagatttcttaaactaaaacaaagggtagaaaccaaaaaataagatgtgctatattagattacattaacatttaaaaatgtgtttatcaaaagacactgttaagattatgaaaaggcaatccacacggtgaaagaagatattcaaaatacatatattcaacaaagaatttatatccagtatataaacacacacacacacacacacaccctacagattaataagaacaaagacaatccaacagcaaaaaacaataggaaattatgaaagtttcacaaaagataatatcaaatggccaataaacatgaaaaggttctcggcttaattagttatcagtaaaataaaaaataaaatgtcaatgacatacttctgtgtatccacagatgaaaaagattggcaattccaaatgttgtcaaggatgcagaacaaatgggacttgtaccctgctggtgactgtgtcagtgggtacaactcctttggaaaactgcattatctacttgaggtgatcataggtgtcctttgatctaacaatttcattctttggtagcaacacaaatgtgtccatatgttcatgaaaagacatatacctgaatgtccatagtggcactatccatattgtcacaacctgggaactatccaatgcacagcaacagaaggaaacataaatacatgtgttatattcacactaggaatagcatacagcagtgggaatgacctacaactatacatatggaaagacactgtgatatatttacataatatgcattcatactacacagcaataagaataatctaaagctatatgcaacaacatggatgaatgtcaccttacctccacctcccccaaaaaatattgagtgaaagaagccagaagcaaatgaacacactttgtccctttccctgctttatgtttattttgttctccttttatttctatttaatgtaaatttggtgtttcaaaaataacccacaattcataagcctatactgatacaaataagtgattgaataaattaatcagtgaaggagaagagacacatttgccatgcagaaagctccaaataatttatgtagataacccccatggagctggaacatacctctgccttttaagggcaggctgcacataatgacttccacaatatggacaggaggggagaaaaataactttacagtggagaaggctggcaaacgttacctcagccaggtgattgcggtcgacatcatcactcataagtcatttgacaatatgcagccttggcatgatgtgatgagaatggcactttacatctgtggtcttcctccccaaaacccataaccccagtcccatcatggtaacatcagacatgcccacattgagggacattccacaaaatagctcatctgtactcctcaaaactgtcaaggtcatccaaaacaaggaaagcctgagaacttgtcagagccaagaatatcctaggagacacgaaatctaaatgtagtgcagtatcctggatgggatcctagaacagaaaaaatgatatgaggtaaaaactaaggaaatctgaataaagtatggactttaataatgtatcaatattggttcattaattatgacacaggtaccctactaatgtaatatgttagcaataggggaacttagtacaggatgtactagaactttctgtactatctttgcaagttttctgtaaatctaaaattattccaaaattaaaagtgtatttaaaataataaacaattcatagagtaggcactgtgttacaccgcaactgggaagcgtgctctccaacatcaagttattaacaataacagaatatataggtagaaaacaaggaatagttgcataacccaatagccatttataatgtaggaattattctttgttttttctacaaatttaaatagatttctagtcattaaactttatgaatgtgaattacttctgtttactccaacacattaaggtaggagctttatgaacaattacttagagatattttaagttcaactctttatatatcaaacttcatgcagaagagatgagtgatgaaatagggaatttttttgttagtaattatggactattaaaaattaactttcactccattacactctttcaacaaatataatacaagcatcatagaatgttggaactgaaagggacatttaagagattagttcagctccttaacttcacatgaaataactgagtgccagagaatttgagacttgcccaaggtcataataaatttgtgggagagctggaattcacttattcagttgagtgagcatttacagagtatttattatgtttcaagcactgtgataggtgcaagagatataaaaattagtgagaatttatccttcaggtggaggaggcagggacagggagaggcagaaaaataaatagatgaatacagtacagcgtagaaacaagccagcagacatgaggccagggtgccatgaaatgaaggaacaggttcatttgatacaactcaggcatcacctgagcctttggaagatgggtgggatttacactgatgaggaggccggaacagacattccaagcaaaacagatcacataagccagaggtaaaagagggaaagggaaataatgtgttgtgaagagctccatccagcttccaggaactgcagaatagtgtaagcagggagctgagatggatgaaaccaacaatgctagatcctggagaggattttgtgccatttaatgagctaagtctttatcatgtaagaaatagaaagttattgcaaggttttgaattttagtttggccactcagatggcttagtggaagttagattcgagaaggacaagacattactgggaaccctatcaaagaggttactatagcactcaaaggacggatggtaaacagttggtttagaaaagtggtgataaatatgcagcaggggaggtggagtcaataaatatttaagaaaaatgatttgcgattagttggatgggggtggggtaagtggagtgggtggttgaaggtgttggccgaggagtcttgagctagactcctagtctataccacagatctttggaacttcaaatcacaagaagcacacattagccccgagctacgtttacacatttttccacctccaccctaggaagcagctctgaatatcagcaagtgaaacagttttcgataagcatttaaacaacaacaacaaaactcatatccttttggtcttatcctaggtcaaaaggtaccttcttgccctacacacatataatcaagaggaaccacagaggtgattctttgaagagccaagataatttgcttccaaggcttttgtctttactcctaggctacagagcctgccctaaatttcaggtataccccatagaggccatcatcttgaatctctgccccgacacaccctccattaggccttgactgtgggtgattgtgctgcctataaaagagaatgtatgaagaggatcaagagaaaatataatcagttcaccgttaaaaaagctaaacttcaaatgcctgtagaatattcagttagagaaaatcagttggcagtaggataatcaactctgaaactcaaggaaggcatgcaatttgaaagtcaaaggtcacggtaagagaaaaacatgaacgtggatgccatttttcaaggagagtctctagcataagtggaaaagtgggaagaatgtcaggccaaagatgaaggtcacagggtcaccagcacttgaagtacagctctctagtagaaaattcaatgaagaatttataggttttagaaatctattgcataatatgatgactacagtaacataagcatgtactgtatacaggccaggcgcagtggctcacgcctctaatcccagtactttgggaagtggagacaggcagatcacttgagctcaggagtttgagacctgcctgggtaacctgacaaaaccccatctctaccaaaaaatataaaaattagccgggcatggtggcacttacctgtggttccagctactcgggaagctgaggtggtgggggtcgcttgacccccagaggaggggactgcaatgagcagagatcacgccactgcactccagcctgggagacacagcaagaccctgtcacagaaaaaaaaaaaagaatatactgtatacttgaaaactgctaaaagaatagattttaaatattcccaccacaaaaaaaaaggtaactatgtgagatgatagatatgttaattagcttgattgtggtaataatttcacaatgtgtatgtatacgaaaacatcatgttgtgcagtgtaaataaatacaatttatatttgtcaattcaacctcaataaaactggagaaaaaaattttaaaaaaatcaacagcacagtcagaaatgtatcagagaaactagaagagagttgtatcccagagcacagaagttcaaatagttttcaaaacaaagtgatcaattgtattgaatatagaagaggtgccactataaatagcttttgtaaagatattcattaaatttggtaatgaagaggacaaaggtaactttagtgaagtgatttcactgtagtgcttgtctttagttgcagtaaggtggattgaggagtatgtgagtgaagaagttgagactgcttttccacactgttctttgaaagtgtggatgaaattggaaggagaaaggcaagaaaaagtttaggagcagagccgtgggagactcttgatcttgtctgtttgatttgggatgagatgcttagtatatttgtaggctacagggaaggatgcccccctagaaagctggtgttgacaagagagggcattatgaggcagagtcctggaggaagaaggagaggcccaggccagggtcataggcacacagaatgggggctggcattcaacagtcaaaggatgatagggatatttctttttcaggcccagaaaggaaggaagcaagccatcataaatgaatatgtagacaagtttgtgagaatgtgtgtatgtctctcagagagagtggtgggacagaagggagttgaaagagttcatacttgactgttatttatttacttattcatttttttttcctagtaagaggtaaggtaatctgctgagaataaggttaggtggagttctaggagagcagtgagtatttggatgaagactgaggagagtaggcaaaggaattaccgaggaaaaaaataagaagattaaactaagcgggagggttcttttggcattttgttttttgttttcagacgaggtgtgattctgttacccaggctggagtgcagtggcacaagaatggctcactacagcttggacctcccaggctcaagggatactaccacctcagcttccctagtagctgggaccacaggcacgagtcaccatgcccagctaatttaattttctgtgtgtgtgtgtgtgtgtgtgtgtgtgtgtgtgtgtgtgtgtgtgtgtgtgtgtgtgtgtaaagatggggtctccctctattgcccaggctggtctcaaactcctagtttcaagctgtcctcccagctgggcatcccaaagtgctgggattacaggcatgagccaccatgctgagccatgagtgggagattcttaattgggatcagcaacaatctatagtcttgcataatttttcagttgtactcaactaccactatttagttaaaggcatttattaagtattctttactatgttcttggcattatgcattgcaaacattaccacaaaccacagtaggtaggtacatttattaccccaatttacaggttaagtaacttctccaagtttgcacagctggtaaaaaggcagaacagaggcctgtccgactccaagccatatgttattttccatatgttatacttcctcccaaggagttggagctttaagaattgataagacattttgcttagcctgagaaaactcctaatgcacaagagaagatatgccaataaataatcacaagcaaatgtgaggtattgatatgctccaagagcagagaacaggagcccatcattctgatgaaagcttcagggaagcctcagggggctggcatctgagcactgactaggtctgagtttatattcaccaggtggacaaggagtctggagcatcccagacttggggactgtatgagcaaggacaaggaggtgtgagaaggcaacccagttttgctcaatgcatctgggacatagagtgactgttgggtgaggagtggaagacttggggggagatatgagatcagataataaggggtattttatctactgagaactttatctggtaatcaactggataacatgtaaggttttaaataatgatattagatttgagttttgcaaacatgatcatgttggtaacaggcagggtggaatatagaatagggagatcaataattataataattataagctgtcacttactctggatcaggcactatgtaagtgattttcttagattcagcaatttaatcatagaaaagaaagaatgagccccaggtttctagctctgaggccagtgttctttccactgttttcttatttttcatagttttcttgtttatatctaaacataaatcttctgacactaataatcattcaaatagtgtccctacccaaattcatgtctatgcagaatctcggaatgtgatcttatttggaaatagagtctttgtggatgtaattagttgttaaagtgaggttgctaagagagtgggccctaaatcccatgactggtatccttgtgagaagaggggacacacagaaaggaacatgaaggccaagacagagattgggatgatgcagccacaagccagagaatgccaaggattgccaggacccaccagaagctaggaaggggctaggaagaatttgtccctagagtcttcatagggagcatggctttggtgacaccttaatttggggcttttagcttccataattgtgagagaatagatttgttgtcttaagccaccaactttgtggtagttatggcagccctaggaaactaatacacctttcttgttatatttccagctagggatatattcttatatgtttataactgtgtggattttgagggagaaatcactcatagttgatgatctcatgggcctgccatctttgtctttattgcatttcactgtcatttgcctgatagattaatctcatttggattccctggggcaaatcttgttttatcttcatgttgatgttgctgcccatactcaagtattttgggttacaaaagcagaattatcttttaaccctagcctggcagtaacatgaagacctactttataaccaaaacaatttctatgcttgaaaaaaagtattatataaaagtactcaagcctgctttcaacttgacttttgtactgacctaggggttgacagagtctgcttttattcaagactggaaatatcaggagatgtttgcaaagtacatgataagccagttaagcagttgaacacaaagagagtctttttatatcttatttgaaacccctgagttttgacaacatagaactgtgaaattttagagctagccaaatagaattgacatgcaatgaataggagttaaaatcattttaattttgaccaaaacaatagtattgactttaaccctacatcatttttcacttttgctgccaaccattttcttttgacatgtcacttacatttgttacctacttcacaaatgctcctgggattggttctccttacaattcatttttcataaaggaaagctggacataaatgcatttgaggttttctagggttacctattcagactcttcagtcacagagacaatcttatgcaccctctctctctctctctctctctcccacaagagctttcaggtacatcctgatgataaagagaaagacatgatgacttgagcagttctatgcagagcatcttctccacaccctataccgtggtcccacacagcgcagttcatttcatgcttccccatgaatgagagtattgtaagttctatgtgcatgaagaaataaatgattatcccattctccagaaacacaaatgccgtatcacaaagcatgcaccattttccttttaaaattccttcctgaaaagtgtttgtggttgttgttttgatgaattaatcatattaggacacagaacgcagatcataagctcagtgatgaagaaactcgtaacattcaagtttcaatggaaatgtttcctgctcagaaagtccccttgtccctttgtgtctcctaacctccattttattttatcataacaccaggttatgataaaaccataatacctggttttttatcataacaccaggttatgataaaaccataatacctggttttcttatttattaatgtattcattgtcctcttgtctgtctagactcgtaggctcttacgtgccttatcactgcattatctacagagcctagaatggttcctgttgctaatcaaatgtttttcaatgaatgaatcaatgactacagctagatatcccaggaattataaggagtaagaattcagagaaagaaggagtagtggaagctgtaggtaactgaagacaggttttttagtagagcagtagaagcagggactctggtaggggacctagagagaaaatctttggtaatgtcgggaaggagttagcttcaagtcttcagagacaaaggaaagaggcattcagaggttgggcacaaaacagttatgagtgggagaggatgaatgggcatttcctagagttgtgtccttcaggcagctgtagagagagatggtggagggggttatgtaagctgaacactctcaaagctgacctataaaatatactaagtaaattggactctcagtaaaggaaattgcccaattcctaagcaccattttcagaggcttcacaataagagtattcattctgaaatcctacatttgcgtgtatatacataactccatggaaaatgaccttataatatagtaatgatgtgcaatacagtaacatgctggaaaaaaaatagtgtagactttgaaatgaagtaactaaatcacaatatgcaagacatattcaagcaaatattcagataaagttacctgtcagtgggatgtgtctttgcctgttctctctacctgtgattccacatggctttatataggaaacaagagaggcttatttcacccaaaatatcctaggtatttttttatcctcgatattgccagataaagaaattatagaaagaaggcagagcatatcattgtgttgaaagaaaagtaaggaactctagttatatcaacattacccaatgtcacctggttacattaaaaagttctgaataaacagcttgaggggaaaaagacattttctttttctgagttaatatgtctctgtgctgtagtctgggcatcttttcaactttcctttgttgacttggctgtttttggattggaggcttctttttcttatctgtgtggaggaatgcttttctaactagagcctgatgattttgctgagatgacaaggcttgtgtgggtttaccacagaacacaaaaggccgtgtagcccaaaaagaactgaaatatgttctctaatacccaagggcttaccaaatgtggaggtaacattcacattccaacatgaggagctgccacaccacctctcctggctctattacctctggtggcaatctcatccctcctcgaatcgtcaacccttctggccaagggtcgggtacacattcagccaagtgctgtgatggacactctttcctttggagagagcatgatcaagatgtgaaggagctgcatgtgttactgactgtgcttccaaaccaccactgctgttcagggcattgcatttctcctatatgtaaaaccttccctagattccaaacttgatgagtcaagacctgatagagagaagagaagagaagagagagagcagagagaaccagataagtggatgaaagatgtaagagaagcacagtcattgggagatttctgctgtggaggggagaagacttttattataataatattataaacaatagttactctatgaggtaatgtattcactgcaggtaatagaaaattagactaacattggcttaatgaggtcaggatttattttccccacacaatataaaatctaaaggaagtcaggcctccacagggtcttgcaggactggggctctgtctggcctacttttctcaatgtgtcatcctcatgttcgtcctctcatggtcacaagatgattgctgcacctccaacctgcattccagtcaagtggcaaagtgaccaagaggctactagcaaggcttttcctttttatgggaaaagatcttcttcgaggaattcctacccatatccctttggccagaactgagtcatgtggtaatccttatgtgcaggagagactcagagcttgggaattcactattctagcctccgtggtagagattaccccagaagagagaaagtgatggtaatggattctggattaaccattatgagtcaagcccaaattatcacataatcaaaggaaaataatacatctaagcaccaaactacaaaaagctaaacagcagtttaaaaatgatcaaagattatgcagccagaggcagcaacatcagccaataaaggtaacaccaaccaaaagcgattgaccaacactaaagtgctttagacttgcttggctttcatttagcatctcatgaagtatttcttctcttatatcgttgaagacaaacagaaaaaaaatattttagaattaacacagagtattttttctcctgggatgttagaggaacacatgcctgcctgagtctccctggcactgtgactatgctcctttggtctggggcaaagcttctagtagcaaaggttgaagacaccatggagctgggattgtaactggaaaacatgacaaggatagggagttagtcaagaacaggagcaggggtcaggcacagtggctcatacctgtaatcccagcactttgggaggccgaggcgggtggatcgcctgaggtcaggagtttgagaccagcctgtccaacatagtgataccccatctctactaaaaatgcaaaaaattagctggacatgatggtgggcgcctgtaatcccagatactcgggaggctgagtcaggagaatcccttaaacctgggaggtggaggttgcagtgagccaagatcgcaccattgcactccagcctgggcaacaagagcaaaactccatctcaaaaaaaaaaaacaaaaacaaacaaacacaaaacaaaacaaacaaacagaaaagaacagtagcaggcagaatttgtgtatttttctcatttttccttcctctctggcacctgattaacatttagccttcaagttgaagctaaatcatcaccgcttgcttggagtctattgtacctcctgggtgcacacatcacagagttacatccattcccgcaataaacaattacttagaagccaccatgttccaaattctgccataaaccctgggtttaggacagttcaacctctgctgtctagagtagcactacccaagagacatataataggagccccataggtaatttaaagttttctgttatttacatttaaaaataaacaggtaaaattaattttaataatagatttgatttaaaccagtatatgcaaaatattactattttgacacaattgttatgacatataaaaattattagtgagatatgttatactctttttttcatactgcctccaaaatccagtgtgtattttaacatagcacacctcaatttgaaccaaccacatttcaagtagtcagtagccacatgggtgagtggctgctatgtcagacgatgttgctctagagcttacagactataaataatgatttattataaaacgtgcttaaattctttgtagattctggatgttagccctttgtcagaaggatagattgcaaaaatttgtaacaaaacttcatgttctacacatgcaccccagaacttaaagtaaaataaataagtaaataaataaataaataaacatgctaactatgcctaataaatgtctaatttatgcagctcacatcatttgggaatggggaagcagtctcattgaggaaaggtagtggcttctctagtcagttctccatatgaagtcatttgtctcagtgatttctccattacccagagtctagatctcagccacacgggtttagaaaaacttgatttattcaaagtcctaaagtttatttacttcgcaatactggcctctcacaacagaaatctgagagaccggtgtattagaaatgagaatcctgggccgggcgcggtggctcacgcctgtaatccctgcactttgggaggcagaggcgggcggatcacgaggtcaggagattgagaccatcctggctaacacagtgaaaccccatctctactaaaaatacaaaaaattagccgggcgtggtggcgggcacctgtagtcccagctactcgggaggctgaggcaggagaatggcctgaacccaggaggcgagcttgcagtgagccgagattgtgccactgtactccagcctgggcgacacagcaagactctgtctcaaaaaaaaaaaaaaaaaaaaaaaaagaaatgagaatcctggttcatttgtgatgaaacatgtctgtgcatttgtattatctccacagaccagggtttggctaccctgacctgtgagacaaatgcagccccccacctgtttttgtacagccacaaattcacagtggtttttgcatttttacatttaaaatgaaagaagtcaaaagaagaataaaattttttgatgaaaattgtacaaaattcaaatgtcattgtctataaataaagttttactggaacacagccatactcattcatttaagtattatctataactgcttttgtgctgcaatagcaaagttgaatagttacaacagagaccatatggcccacaaagcctaaaatatttactatcttgcccattacagaaaatgtttgccaaacccatgttatgtatgtgaatcacttgaggagctttagagatgtacaactattcagcactactctcaagtaattcagatttaattagtctctggtgaggcctaagtatcagtatttaaaaaaaaaaaaaattgaatgctgtagccaatctatgtaggaagccaaagtaaccagaaggttgtgtggaaatcatggatgcagaacaaagagaatcaagaaagtaacttgagtacccgtcctcccagtccatgcctgtcagcatacaggccacttgagtcagcatgccaaggcacattcttctgagtcagcactcatccctgttcctattcacctctgtgaccttgatgttcctacatttccaaacttaatcagctcctctattgattggcacattcttcctgtgcattcaccagttaatcctgccttatcagcctgagggccaatctgtctctctaacatgattttgtttatgtctgttctgagtcactatgtgctgctttaataggtttcttaagaccaatctgatttttctgttttgttgttttccaaaatgtttcctggttgcctcagtgcccgtgccttagacaacttacattccaattgctgcttttcttgggtatctgcatttccagcctgacatcaactagtcacttaagtgtttggtggatgggctcattggtagctgaataagtgaacggatgaatgagtggggaagaaaagtggggaaaaaaatacaggaggaattttgtagactatgtattgtgagtatagtgaattttaatgctctagagcttacagactataaataatgatttattataaaatgtgctaacaaaccagaatgtccagattcaaatcctgactctgctactttccctggaaagccccatgggaagatccctttgcctgtattaacaagactttggatatctgtaagatgggaagagttacacatacttcacagaatagtatgcggatgacttatcaaatacagtagcacctactccaatgcctgactcataacagcttctaaatagaaagtttcattcttcttccttctgtttagctaaggcatcctttcacacttaaaagggcctgaattgtttatagttaaaaatagtttgctgtcttatttattatactatacagcagatagcagtattattaaagagaacttggtaaaaatattttattgtttgaacaaatagtttataacaatttttcaaataattctggattctataattctatattaaccttatagtttgatgccatggtactaataatggaatttttacaataacagtatcatatacctattcatttgtagtccatgtctttttttgtataagatgaaattttattttttcttcaaaggctttttaagttttaaggtaggatattacttaatttgaacccatgtcttatattttatatccttaggaaaaacataggccatcctaaaaaccttgtcctttcttatttgttggtttctcaatagctgtaggtattgaaggattaaaagttttcgaccctagcttcacattagaaatcccagaggagatacttttaacctttaaataccaatgccaagccccagtccaaaccatactttctgatggtggagccaaaggcattatctgttttcagtcttccagatgataccaatgtgtagccaaagttgggagctactaatctaaacccaccctccatggtttttgttcatgtgtatgtgtgtgtgtgtgtgtgtgtgttgagacagtcttgctctgtcgcctaggatggagggcagtggcataaacttggctcactgcaacctccgcctctaggttcaagggattcttgtgcctcagcctcctgagtagctgagatcacaggagcccgccaccacacctggctaatccaccctctatgtttaacatatgagatgaaatgaagtacagaggtgaaacgattggctcaaagcccttcagcttaactgaaactgaaactcaggtgttttacctcagaccagtgtttcaggctaatcctaaaccaagaattttaggacatacagttttcttgatacatacaaaaacttcactgtaaggaatatttttcagttaatttaaatataacttatatagagaaaggaaatataacttgttatagaaagagtatcagtgatagaagaattaagtatacttcatgtgttagatgtggtgacttattcatcattaggtatgttttgtgaggtagacattatcatttataaatttcatatattttaaatgaggaaactgatacacaaagagatcaatagacttgtattaggtcacacagctggtgagtggcaaagtcaggaaaggaactcaaaacataggacacttagtcccacctttcttttcccttcctaaaaatagaaccctatatttgtaaaatataatttttgttttgttttccttttggaggccgagtggaaaggacctcttggataggagtggtgaacaaaatgcacttacgtttcacaaaggaccattttataattaacttggatggggcccagtgcgagagaacagaagaatagtattgagatgaggggatcctgcagcgtccaaatagaattagaactagacgccacttgtcaagataaatgtttgacaaaacgggcatgtctctccagaattcattaaaatgttgttttaaatattaacaatttcttaaagcaatgctgttgatgcttaagaagttatactaacaagtttttctttattcttccttggtccagctcttttgtgctctatagaatgactgtaatcacaaaataagctcccaaagtagtgaaagttcctcaatataaatgataaggccactaaagcccagagaagccatatccaacatcacttgagctagaatgcaatgaagatgaatttagtagctaattcaatttgacatcaagttgagctacagattaaatatagaaaaatagccaggcacagaaagacaaacttcgcatgttctcacttatttgtagggactaaaaagtaaaacaattgtactcatggagatagagaataaaaggatagttaccagaggctggaaagggtagtgatgggtgcggttcttcacagagaagtggggatggttaatgggtacaaaaaaatcactagaaataatgaataagacctagtgtttgttagtgcaacagggtgactatggtaaaaaataattttattgtacatttaaaaataactaaaataacatgatcagattgtttgtaacacaaagaataaatgcttaaggggatggatatcccctaaataaataaatgtaggaaaaacttggataaatgtttctattagggaaaaataaagtcatttagaacattaaggacattaaaagaataaagtacacggtattaaacttgaagataaaaaaacagagtttttaggtccaaagaattatattcagtgtttgtttattcaacaaagggtttttgtttgtttgttgttttgttttgttttgtttgtttttagtatgtgccagaaatggtcctgggtctggaggtaacaatggcacacatggggggaaatcatcaataaacagtcaataagtcaataaacaagatcatcgcatctttgtaagtgctctgaagaaaataaacaggatgtggtcttggaaagtggatgagaatggcttcttccgtagagaagctgcgaggcctctcgggagaagcagcatttgaggtaagatctgaaagctgagaaagagccagccacaggaggagctaaatgcctgagacagcagctatgcatatgagagcaatagaaaagaggccaaagtgtgctgtaatgtatgtccatgtactcacacatgcatatccacacgtgtgtgcatgtgcgcactgaatgatgacaaaatgtgaacatcagctagactagtatccagaaatcaggataggtaaattcccttgacatcatattttgaagtgttctaactcccttttctcctacccaatgccctccccctcaccccaagcacacacatggaacttgggaaaacattaaaaatattgacttccagaaaggtacattacatctttatctctagttcaggatgtcatatcaaatgactcctgcctatgcctggttggtggattacttttgtaaattcaactatttggaaaccactagttttcaaaagactaatgtgcagcaaaagaaaatgtctaagcctgttttgtgctgctgtcacagaatacttgagactgggtgacgtatagagaacagaaatttattgtttcacagttgtgaaagctgtgaagcccaagattgaaggaccatgtctagtgagggctttctttctctgtcataatatgttggaaggcatcacgtaccaagagagcccgcaggagagatggaaggggccaaactcatccttcataaggatgccacttctctgataacagcattaatccatgtgagggcagagcccctatgacttaatcaactcctaaggtgctgctgtcaacactattgcattggagattaagttttcaacacatgaactttgggggacacaatcaagccatagcagccagccactatattttcatggaaagaaaacatattgagactcccacaaagtaaacttctttggatgccatgagtgtaaaatcttgatttgagcttcatttcatagccatggtggcaaatcaaattgttaaatatatttgtgagtctataattatggagaaagtcattgtctcataatatattccaaaaatgtttaaatatttgtttgtcctcttcttttttcagtgtctcatagtctttctcttttaccatgcccatttatttcttgacatcaccattcatgaaccttcccaacatggttttaagttcaagcttcttgttttttctgctttggtaggatcttgctataccattctcttgcccttcgaagcacaataaagccaataatagagacatcttcttgtatcagcattttggaatcaatattttcataggtcttttacagttaaatcagctcttggataaagtggaactttaagaaagtctggactttaaaatgactatattctggtaatcacaaagtcataaaacagagcatttcagtgacgatgggtcatgttttttcagtcttaatttagaatttttttcaactgactttgagttgctgttacaattcaacctgcctctggtgttttatatgccttaaaatttgtggctactgtataataaccaggaaagcgtagctacagggttccaattactttggcaaaggagccttattacattgtctccaactaagcacataattaatgtctctatttcaaggctatttcagcaaattcaaaacccagaatctatccatacatatttagggatgcatgggaacacttgtgatgtcttcattgcagcagacagtaataccagaggaatttttggaagaatatggaatactttatcatgggttgcaaatattttaaagatgtggtttgaaattaaacatgttgttctaaaaagtctccatgggaatagaatgtaatagaattacccacctcctgggagagtttttttatgggtgagacattttcagattgttacaacgtctgagcaggcattatatggcaagagagcacataggagatacatatctgtctacagtgcgtagggcatttgcaccttgagtatcctgctggacagttatgtaggtaaaaagcctgtttgtaatcatctgaacttaagcttatctccattttgcaaataaacacaaagtatttttgcacaatcttaatactcactgaattttgcagaaatgcagctaccatatacatgaagagaatattgtggttagttttgttcggaactttaccaagaattggtcaccatttcaaaaaaaaatcacaccattgatggcagcacagcttgtggcatttgagttgccaataaaacatgcccatattattatacatttgcagcagttgcagttgcgaggattctgcatttaggtgccaccatccaacaatttaattatattttgtaatcaagcagatcatgcccaaacatttacctatagaaatacatttttgtcatgaattcctcttcttatttttccccttatattatgggggagttggcattttgtatttaggcaaattattttattcattaatttcttttcagaatactagagggacatttaattatattatcaaaggagagttaggtgagataagatcaagaacaattctgaaatatatcactcctccaagaaaaagggggatgtggtgcctgcgcacacatgtgcccttcaatgcgaagaaagaagcaggaaacggagatgggagaattggccttgatttcagctcttattgagtgtcaggccctgtgcccagcctttcaaatgcatgatctcattttttgtgcatagtgctgagaaatgccatgtgtgctttgaatcctgtagccccagagtgccacactgggagctgactgcttgacattcggagatcagagaatgagaggaaatgagtatatgaatattcttgacattgctggagtgttagaattatttaaaagttctgttaaataagtgacagtctcagagcctgatgtatggtagttaatgaaattttcacaaagaagtattatcataaaattcgaagaaaatcatagtagctgcgcacacaaattcacatgcatatgaatgtcagtgcacgttggtgcattcatgcttcctatttatagctttcgggacacatccgaaagtgataaatgaacattgaaatgctacacatatgtttatatccacttttagctatggggttgtctcaaaatgtggtatctccactgagccaaatcccaggcatttagaaagtacgaaaaatttaaaactttaaagtgaaccaaagaggagagagaaaaaaaaaaaaatcctaaaactgagagatatggcaatcataaacctggcaccaaattactttttaaagtacagtatgaaaaatgaaatgtgtcagaattggttactaatacttctttgttggctaattgtcatttttcaagtgttggctaattgtcatttttaaagactgataaaagaggacctttccgatacacagatatcatggcatttttaagccttgaggttaattttactatatataacatttcaggggtgcaaatgtaaacattataatttcagataagggacagattgctttcttttaaaaatgcccaggtaaagctaaaggttagcacttaatgaggggtgtatgtctgttcatctctttttttattgacccgaatattgctgtaagaagaaataaaacaaagcaagagaccaagttcagaggagagagtacctgtgctgaaaagatggcgttttgcaaccactgcaataaaatgaaaatgactagaattttgaaaacctttttcttaagtttcatttggttgcaagttacagaaacccaaataaaactgatttaagcaaaaaacaaaatgttaggtcacctgactaagaagtccaagggtattgcttgcttcaggcatagctagatacaaggaattgaattttgttaagttgtctatctctcttgccatctcttgactctgctctgtctcatctgaattgacttctgtctaggtagatgcttccgacatgttggtggacagaagcataatatctaaattattctaatccgagcaaaacaaaactttctttttccaaaaattaaaaaaaggggggagtgcgtgtcttattgaaccaacttgggtcacatgccaatgaagcaaatactgtgggctggggcatgaattatgctgattgccaggccaaggttatgtgtctctaagataggagcagagaggtgtcagccccatcagaacctgaaccaaatgcactgataccacaggagatgagattctataccctccaattgctagtggcccaacccaagagggagcagtcagatattgcaaaaatttgtattgcatatattatagtaacataaattttaattttgtacatatccctcttgagatgcaagaatgcatagttagagaataactgaatttcaaaactgaaaaagatcttgtaagttatgtagttgaacattatcaatttaaatatcttttgagaattcactcatctttaaattgagtcttgctaattgcaaaaactggttattgtatagcagtgcaaaatactaggtgggagtaatataacatatgaatcagaattgtattaaaagcatttgttgtatatcccaaagatattttaggagtcactcactgatgtgaactacagggattattaccaaaagtttacacaaaaattgttttaatctgattttccccatcccagctatgttatcacttctaaagtctctattattatcatgactttttactcagtttaaaacgttcattgaaaagtaattctaacttctttttgtatatatatatatatgttcctctgctcactatttctcctaattattacagacaaggacaactggtgtgccctgtttactaggaaaaaacaatcacttcataaatatacacctttcagaaaatgtacacctttaaaagaaatccaaagtgaaccccaaatgtacagtcacacactcaaatccaaattccaatagctcacactaaatagagaagtatttataatagaaatgtatttgtgtttctaataaccaatgagtatatgaatattcatatttgcctattataggcaagtcattattaaatataatttatggaagcagttacaaaatattaaatatattttgaagtaattgccaagtcctttgtacaaaggaagagaaatttgacccaaactaataatctcccattatttgagattttgtcattgtcagtttgagtttacatttgaaaattatgtgactgcctggaatcccactcccaagcctggacaatgatgtaggtgttgtatttcaaaactagccaggaccacagagagctaaaggagctcttttttgcctgcaactggttacctcaattcattagagctgataatgaggccaaggccaaggccagggctatgacctctgtgaatgtcctaagctccctggatatgaggccacagaccatagcactgtccctgtccttaaggagaataagattcgaaggatatggacagagtaatgcaaaacactctccaacattataaggccctctacatagcatgctatccagtgctagtggccagactcttcattccagagttattcacatcataaatgggaattataaaatgataggaatctttgctgacccatgaaagctgatttaaggtttcaacataattagctgtatttgtgatattaagacagtaatattaaattttgcaagaaatactgatacaaaaaattccaaaggtcaaaattgaaatacaaatagatactataatgggattaaagggcaagaacatctaatggtgaatctgttcaatgaatataatgagattattctcaggcagatgagtccctagcttaaacaagaaaatgaactatgcagagcagagatataatattgcaacttctatgaactcactgcctttacgttttgtcaacacacattaattctgatttcttttaggacaatcgaattactatgacaagtatcagcaaagcttcatgaacataaataaatttttatttaatcctaaatttatctgaactagctaatttattcactattcccgttagaacagcatatcaaataaaaactcacaatgcccatgaactataaaattctttaatttatcaaaatattaagtataggccaggtgtgatggctcatgcctgtagtcccagcactttgggaggctgaggtaggcagactgcttgagcccagcctgggaacatggcaaaaacccatctctacaaaacatatgaaaaaattagctgggaatgttggcacgcacctgtcatcccagctattcaggaggctgaggtgggagaaccacctgagcccaggaggtcaaggttgcagtgagcagtgatcactccactgcaccccagcctgggcaacagaataagaccctgccaaaaaaaaaaaaaaaagtgtttagtataaatactgcttgttatagttacattgacaaatacccctaacatgctatcagagctcagccattaagttaatgttatatttaataggttattatagtgatactgtttagccaattgaggttttaattgtgtaagtaggatacattacaaattaagaaactttattggatttttatagaatagtggcttagtgcatgagttataacatagacttatgatgtgaataaacaacaaaataagatcaaattttggccagtattttgagcaggaaaaaatcaacatattaaatcattgggatattatttataattattaaaaactcatgaattcttaactagaattataccttctatattcattattagttatgaattaattcttaaatggctcaaatatgaatatcaccatgtgtaagatgctaaaccagtcactgaggaaaaacaaataaatgtgaaaattgttgacctttttaaggaatttatggcctagaatgtatgcaagatataaaatactaaacaagaagcaatttaaagcactctgtgatacccatgagtgaactggggtgtaaatcctctaatacttaaaaaacagaacacagtcactatgagattgtagctaggtcttcagagattaatatacttcatattagtaacatgtgcttgaaagttcatgagtatgtccagatacttcttatctcaatatttccttggatgtaattactctacttctttgaaatatcttttaagctggtattatggtttgaaggtatcctgcaaagtttatgtgttggaaagttaatccccaacgcaacaatgttgggagggagggcctaatatgaggtgattcagtcatgaaggctctgctcttaaatggtttaaagttgttatgacagaagtgagttagtcatcagaagagtgggtttgttattcaaacgagtttggttctctcacttgcatgtgctctcctcctcttctgccttctgccatgggacaatgcagcaagaaagcactcacaaaacacaggccccttggacttcccagcctccagaactgtaaaaactacatctccattttttataaatcacccagtctcaggtattctgttacagaagcacaaaacagactaagctgttatttccatttcaagcattaggtttcacttagtgtaatacataattcataaatgtgaatattctcagttaggtgcacagaatgggattgatcaagcccccagttcatggtacacagacattaatagtcctgagattggcttcctttttatataatacttcattttaaaaattgtatttgtctaccctatctcctattttcaatcccattttccctatttgtgtatatttaatgtaggactgttcacttaatttttaaatttttatgaatgcatatatatgtatatttatatacatatataagacatataattatgtgtgggatatgtttttaaatttacaaacatttagttatataaatggcaaagagtggtgtatcagccagggttctccagagaaacaaccagtaagatattttatttatatagagagacagagagagaagagagacagagagacagattgctttcaaggaatttgcttgcttacacaactgtggggactgggaagtctgaaatctgtaggcaggccagcagaccggaaactcaggcaggagctgatgctgtagtcctgctgccgaatttctaaaggaactcttggttttgctctttagtccttttggccaattgaatgaggcccatccaccctgtcaaggtaatctcctttgcttaaagtcaactgattgtagatgttaaccacatctacaaaatgccttcactgcaacagctctattattatttgattactgggtactaccatttagccaaactgacacataaaacttgtcctcatacatggcttctggtttcctgttctgcttaagatttcccccacttcttcaagtaactttattttaatttataactatacacctagcttcaacaacagaatacacttgtggacttaggttgtataccatttcaactcaagaaaaagaatctgtattttctacagtccagtctagtaacatttctttgagatcaaacacggaggttccagagtttgaatgtgaaatgaatacgatggaggcactgaaactggttcttggcatcatagtccttaactgtgggactgcctgcagtcctgttcttgaatgagaattataaccagccttccttgagcacattctgcatgccataccttgggccaagagctttttatgcactttaattatttctcacagcaacctcataaaactcttccaaatagtgtaacagagaattaaatgtgtagccctccagatgatactgaagaagcatcaagctactttgaaaaaaatatattttaaattttatttattatatcatatgttctatttactatattttaaggccatttagaataattcagacagaggaaaaaaatttactttgattactagtaccttattgtgtactttaaatctgactcttgataaccagactaataattataagagaaagcctacctttattcccactcctatatcagactgtctgagttacaatttgaatttcaaaggtaatgccacacactttttattgataggaatagtttcagaaggaatggtaccagttcctccttgtacctctggtagaattcggctgtgaatccatctggtcctagactctttttggttggtaagctattattgccacaatttcagagcctgttattggtctattcagagattcaatttcttcctggtttagtcttgggagggtgtatgtgtcgaggaatttatccatttcttctagattttctagtttatttgcgtagaggtgtttgtagtattctctgatggtagtttgtatttctgtgggatcggtggtgatatcccctttatcagtttttattgcatctatttgattcttctctcttttcttctttattagtcttgctagcggtctatcaattttgttgatcctttcaaaaaaccagctcctggattcattaattttttgaagggttttctgtgtctctatttccttcagttctgctctgattttagttattccttgcctcctgctagcttttgaatgtgtttgctcttgcttttctagttcttttaattgtgatgttagggtgtcaattttggatctttcctgatttctcttgtgggcatttagtgctataaatttccctctaaacactgctttgaatgtgtcccagagattctggtatgttgtatctttgttctcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagagctttacttccaactatgtggtcaattttgggataggtgtggtgtggtgctgaaaaaaatgtatattctgttgatttggggtggagagttctggagatgtctattaggtccgcttggtgcagagctgagttcaattcctgggtatccttgttaactttctgtctcgttgatctgtctaatgttgacagtggggtgttaaagtctcccattattattgtgtgggagtctaagtctctttgtaggtcactcagcacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgacgttagctggttattttgctcgttagttgatgcagtttcttcctagcctcgatggtctttacaatttggcatggttttgcagtggctggtaccggttgttcctttctatgtttagtgcttccttcaggagctcttttagggcaggcctggtggtgacaaaatctctcagcatttgcttgtctgtaaagtattttatttctccttcacttatgaagcttagtttggctggatatgaaattctgggttggaaattcttttctttaagaatgttgaatattggtccccactctcttctggcttgtagggtttctgccgagagatccgctgttagtctgatgggcttccctttgagggtaacccgacctttctctctggctgtccttaacattttttccttcatttcaactttggtgaatctgacaattatgtgtcttggagttgctcttctcaaggagtatctttgtggcgttctctgtatttcctgaatctgaatgttggcctgccttgctagattggggaagttctcctggataatatcctgcagagtgttttccaacttggttccattctccgcatcactttcaggtacaccaatcagacgtagatttggtcttttcacatagtcccatatttcttggaggctttgttcgtttctttttattcttttttctctaaacttcccttctcacttcatttcattcatttcatcttccatcactgacctctcattctttatgcagcaaaacaatgggagcaattttaggtccctcaaacatttttacaacaaaataaacaatcctctttttacttaatctgcagataaagttaaccattgactcagctttgtccctcatgtgggcaaagcaaaacccaacctcatatcgttactttaacttagaaagaattctgtttgtgttagttatagtctcattttggtaacatagatcgtaagacataattctgaagatgagctttttgcacatttctgaatcaaagtagttggtttagaaagagccctgtagtctgcatagaggaatcctcttaaggtccaagaactcatgtctcaccaccagttgaaaatagagcagaggcctgaattcagagcccccggccctgaccccaactgcagccgagacaattacactgcattctggtcttactagagctcagcctcatagaacttgttcttgtaaactctgtgctcatataaacatgcacctctgcattgaacttaaggaattataacgtcatcattgtattgccgtgactgcccctatttccttatgattcttccacagccctatcaactcctaggctgcatcactgttaaagtttcctgagataatcaggaagattttctaagagattgcaccaggacatttgttcaggcctctaatatcagaaccttacttgtttcttgaggcaaccatggagttcagtctcagaccaaccacaatcaataattgtcttagacacaatctttgttcctatattcccactgattctccttgttttaaaagaaacaatttcagaagtgaagaggggcatgcaatgccacgtacacgttcattctcaccattttaatttttgcatataaaaacctgcataatagactcaacaaaaatctgggctgcgaacagatagttaatgggagaaaagtcacctcactgcctcattgctaactactaagagccatgcctcccaaagtcttgtatgagaattgccaaacatataaatttctccaaggaccttagttctcacaggcttttctgaaagtttatgcttaatggttttcatttccaaaagtagagcttataccagctagttctgcacaatgtgtccacaccagaatattccctacaggcactggatctgtcctataaattagtctttatcagatttcttctcagaactctggaggtttggcgacattgtataagtactttaattgttatgtagttttgagaaaaagaaaaaatactcctaatatgttcacaaatcatcaccctagaaagtattagacctacttgttgctgtcagatactttttagttcgttggttctttgactaaatacttaatatcatgatcttcctcatctttttaattttcctgaagtggcttttcagatattcccctaagataggttcttctaaactgttataaataatacttttgtttgtgagtaatataagcccaataatcttcctttgaataacttaatagctataaatagatgcatttcaggagataaaataaagcatagcaaattataaaacatagactcttgaatataagcttgaatatataaatatagattgatataaacttgtgcatttatataaacttacatgtcaccattctgacttttttgagaaatgctttacagtatactttttaatgttaaatttttgtgagtacatagttggttgctacatttatagggcatacaaggcatgataatcacatcacctcaagcatttattcattgtgttaaaataatccaattatactcctttcattatttttaaatatccaataaattactgttgactgtagtcaccctgttgtgctatcaaataataggttttatttattctatctaactatatgtttgtacccattaaccatccccactacccccacccctccactgcccttccctagtctctaataaccattgttccattctctatctccttaagttcaattgttttgatttttagatcccacaaataagtgagaacctgtgatgcttgtctttatgtgcctggctcatttcatttaacataatgactctagttccatctatgttgttgcaaatgacagaatctcactcttctttatagcccggtagtactctatagtgtgccatgttctatttatccactcatctgacaatggacacagattgcttccaaatcttggctgttatgaatagtgtgcaataaacatgggagtgcagatatctcttcagtatactgatttcctttcttttgggtccataccagcaatgggttgctgaatcatatggtagctctatttgtagttttttgaggaacctccaactgttctccatagtgattgtactgatttgtattcccactaacagtatacaagggtttttccctttattccacattctcaccagcatttgctattgcctgtcttttggataaaagtgattttaactggagtgagttaatatctcattatagttttgatttgcatttctctaataaccagtgatttgaacacctttttcatatacctgtttgcaatttgtatgtcttcttttgagaaatgtccattcagatttttgcccgttttaaaatcagattattggatttttttctgtagagttgtctgagcttcttacatattctgattattaatcccttgtcagatggatagtttgaaaatattttctcccattctgtgggttgtctcttcactttgttgattgtttcccttgctgtgcagaagctttttaacttgatgtgatcccatttgtccatttttgctttgattgcctgtacttgtaagatattactgaagaaatctttgcccactccaatgtcctggagagtctctccaatgttttcttgtagtagtttcatagtttggggtcttagacttaagcgtttaacggattctgatttgattttcacatatagcaggagacaggggtctattttcattcttctgcatatggaagcttcccagcaccatttattgaagagactatcctttccctaacatatcttcttggcacttctattgaaaaatgagttcactgtagatatatagatatatggatttgtttctgggttctctattctgttccattgatctatgtgtctgtttttatgccattaccatgctgtttgggttactatacctctgtggtacaatttgaagccagctaatgtgattcctccagttttgttctttttgcccagaataacttcagctattctgggtcttttgtgattccatataaattttagaattgttctttctatttctgtgaagaatgtaattagtattttgatagggattgcactgaatctgtagactgctttaagtagcatgaatattttaacagtattgattccccacctatggacatggaatatctttctgttttattgtttcctcttcaatttcctttatcagtgttttataattttcatcgtagaactctttcaattctttggttaattcctaggtgttttattttatttgtagctgttgtaaatgggatcacttccatgatttctttttcagattgtttgctgttggcatataaaagtgcttcatagtgtactttacttcatggtgcccgaaatctgctgagaggcaactggtgacagagacctgaagaaagtggagcccagaaatgtcttggattttgactttatctctttctttgatggtctttcatgatgctaaacaagtcctgtgtgcttagatagaaactgaagcttgtgagaatgttttctcttttacctggggtggattgggatcctcaccatacagcattaatttcttaacgatatatataatcatagaagacaatagaggcatcattccagacaatatttttaaagccatttggcacaagaaataagacaagcaaaaatccaaaaagtgacaaaagctctacccaatgagggggtcagtcccatctaagtaatgcaaaaatgggattggcttgaggaagtaggaatgggaacccagtactgaagttataggccaaatcaaaagatgggaaatctagaagacatatttcttcaaaaagataacataaagtgcttagggtcagttcaacaaaagccttaaggatcaaacctgaagagacaaaaaatagcaacagacgaagtaaggcaataagcagagaatcataatacttacacaacctcaagaggttctcttgatatgacctgctgagaaataaaatattatctgaaaattgcaagactccaagatgttggcccaatattcctattattaaggaattaaatgtgtcttctgcatttcccatattttgatttggcttgtaactgcagtactgagttcccattcctacttcctcaagccaaacccgtttttgctccttgcatggtaaaccactggactgaagctcattaagccttcctttcaaattttatttattaattttcagtttcgtttttctcccatatgagaataagatcgacaaacagctttacagtttgaaaaacttctttctataaacaataaacattcagttttataagcagcctttgtctctgttactatttattatgtatatgttgcatttctcatggacatttgtcaatgagaatttttaatctctgtggtaaggtgttttcttccatttatttatttatttatgcatttatgtgtttatgcatttgtttattttgatgtcaggaagccctacaatttagttgacttatttaatcattcaagagaataatattgaaacagtgaattttgatagcatcatgtctgggttcaattattagctacatcttgctaatctgtataatagtcataccatagggcttagttaattgtaaatactcaataaatttttatttttaacctcaccatgtttacttagtatttattatgaaaataacaatataatagttatttcaaaagtaattgattgatttatgcaataattatctttactttcaagagggttaaattctattaaattataaatgatacatttaattatcatctaaaatcaacagcatcttttactgtttagaaattatttctctacttagtatcaggatctctcctgtcctgatgattattatcattattatttgttttagtgacagagttttgctccatcacccaggctggagtgtggtgatccaatcacagctcactgcagcctcaaacccctgaactcaagggatcctttgcctcagcctcctaagtaactaggactaaaggcatgcactactatccctggctaattttttttaaaaatattttgtagagacagggtctcaatatgttgcccaggctgatcttaaactcctgacctcaagcaatcctcccacctaggcctcctaaagtgtgcgcctccacacctggcctagacccaaagaataaataataatcaattgctctgtgcaagaggttgacacaggatgtggaaaagtgttccaggcagaggaagctgcaagcgcaaatccctacagagcaaaagtacatggttttggggtaactggaagtccagtatggctatgttatagaaagggaagtgagaagaaagtaggtagtgttaaataacttggacttcatcctgacagtattcacttgccaaagaagagttaggaggagacagatgtgatcaaatgtgtttcactggcagcagcatggggagttcactaggggcaggatggggacagaaattgaaggagagagtcaatggcggccttatctgggctagtggcaaaggaaatggagagaagcggactgatttgagtgatacttaggaatatctaagaaagaagaagttgttacgattttgaatattttgcaaacaatcaaacgcacacttaagagaggatacataaaaggagtattcactttgggaatggcaaaaatggagagatgcaatatgaagaaacagagactaagttgatttatttttgtatggtctggaatatttagttaaagtgtctacatcaaccaaaccggaatacaaggagttgttctgtgcaagagggtgcacagagcactgtacaagggtacccattgtcaaaacccatcatgtttttattagctattaattttctcctatgtcttatgttactcatcctgataatccactgtatctatttaaaataaatagaaaggccctttttactttttatttgtgtgtctagtgccccagcactttcaaggagcctttcccaagccaggtggtgaatgaagaataactataaaagtgacaccactgccgggcgcggtggctcatgcctataatcctagcacttgggaggccaagatgggaggattgcctgaggtcaggggttcgagaccagtctgaccaacatagtgaaacccagtctctactaaaaatacaaaaaaaaaactagttcaaccattgtggaagtcagtgtggtgattcctcagggatctagaactagaaataccacttgacccagccatcccattactgggtatatacccaaaggattataaatcatgctgctataaagacacatgcacacgtatgtttattgcagcattattcacaatagcaaagacttggaaccaacccaaatgtccaacaacgatagactggattaagaaaatgtggcacatatacaccatggaatactatgcagccataaaaaaatgatgagttcatgtcctttgtagggacatggatgaaactggaaaccatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtataataataaaaaaaatagccaggcgtggtggcatgtgcctgtaatcccagctactcaggaggctgaggcaggggaattgcttgaaccagggaggtggaggttgcagtgagctgagatcgtgccactgcactccagcctgggtgatggagtgagactccgtctcaaaaaaaaaaaaatgacaccacattttttgagtcatgtctatgttgactaggtaaaaccttgcacacagaacacatgtaaaaattacaatccatgtgggctgaatgctgactgtgttggatggaaatttgcacatagggcacttctctacaattcagtcctaaaaatgtcaagacaaaggagcatttagtgacagtcattctggataacaaagatgcactgctttctaatgcttccctttactttcacatttttctaaagttcacagatgtgccctcgatgtggtctgtgtatttttgtgaactgctggaaaatttcactcacacaccaatggatccaatgaacacaaaatacctcttccagggagcagttgccaataagcagtatttttagaggcacatgtcacagtttctgtttgcttctgttgtgacttttaatgggccctgaatgattaagaaatagcctctgataaaaggcatctcccgactgcttcattatgtactatgggtagtaaatgtttactacacagtgggctcaagctaacatgttattaaaccatgttccggttacatcagcgcccagagaatagcttttcccttgaacatgtttatcatttccttaaatgctccttaacaatgatgtcatattatttatgcatgcttcctcaggaaaatatgttggttgattttatgaattatttggtaaactttgttactcactctaggagactacacctgtttccaataattttctcttacatgttgagtaaaggaattctattgagagaagaagtgagaagtgaaggacacaaatatagatctaaacactagagctaataggacattttattgcatagaattcatgtggtatgttgctgggactagctttcctgtgaggattggagaaccaggatttctgctatctgaccagagtagaaatctattctcctttctcattgtcagagtaatgacagtataaaaatttctcaccctccagcattagcagggaaactttctatttcttctgctgtgattggaaatgaaaaaggaaatgcttgcttttgaaaacacttccagctactataatgttaatactagaaattatgactgcgagtaagaggaggggaaaagtcattcaggtgccattttggctttccatgaacatggctataaaaataaagtgcctctttgggcatgcttagtcattactttggggttaaagttgaagtcagaaaaaaaactctgaaacatagacatgtgtttttcattctgacataaagaattaacaattttccccagctacaactatggagggttagtatcttttaatctgtctgttttctaaaacagcatggtaacattttattttgcctaacctggagatgctaagaataccctgtgtctggttctccttggtacagagtattcgctgtataaactgatgaggttgatttccatgtgtttataaaaaggcaggaaaatgtcttcttgcctaaaactcatgcatggcatcattgcacatggcattgctcaagcacagatctcgcctggtggctccaaaatgaaaggagagtggggagttgccagggtcagagccttcgtgcaaaataagctgccactaactggcattgagcttccataactccctgtgctgggtttgcagtgaaggaaaattgtgttgatggtcagttctgaaagcatatttctggtagaaaagaaaaatagtggagagagattttattctttctacctgttcccagactactctgctcaggcttcctgaatctaaggaagtctaataaattctgaattctagagagtaaattatgaaggttcatttgaatgtcatctgctacccaagttctatacatcccctcttaggaaagaatcataatttattataattatttttctgtttgtggataagtataccataaatgatatacgcaagcatctctttcctactaaaaaagaatgctatattctaccagtagttttcgtaaaagagtaagagactcctctcagaatgaatcttctatactcctatagctctgtcacagtaacagcatgtgtcacaattggcatgtattgaattatttaaggatgattctttctgccccagtagattaagagcctgtggaggccaagttccaggtgtctctcattcttggacttctgttaccggaaagggtcccagttcagacccctaaagagggttcttgaatctcacacaagaaagaatttgggatgagtccatagagtaaagggaatgcaagtttctttgagaaataaacaaaagaatggctactccataggcagagcagtcccaggggctgctggttggctatttatagggttatttcttgattatctgctaaacaaggggtggagtagtcatgagatttctgggggaaagaggtgggcaattcccaggactgaggtttcctcccctttttagaccatatagggtgacttcctgacgttgccatggtatttgtaaacggtcatggggctggagtgtcttttagcatgccaatgcattacaattagcttataatgagcagtgaagatgaccaaaggtcactttcattgccgtctttgttttggtgggttttggctggcttctttattacatcctgttttatccgcagggtctttatgacctgtatcttatgatactagtcctgccgacctcctgtctcatcctgtgactaagaatgcctgacctccttggaatgcagcccagcaaatcttatcctcattttatgcagtccttattcaagagggaaccactctggtttgaatgcctctgacactacaatgcgtgggccagcactctacctgtagtaggtgctccaatcatgtttattgaatgaaatcatattgtacagggagcccatagggaatatcatttatactctgctaaaaagcatttaattttaggatggatttaatggcaaaacctctgtgtactgacatgggacttactgctaaaattgtgtacacaggggacctcggaattgccatgataaaaatcagtgagaaagagctaagtgccacttttgtatgaggaaggtcactcctggccagaaatggagtcagagaggcttattaactttgtgtagaatggagctaggttgattagactggctccaaaggctagctccacttagaagccatagtaagtggcacattaagtgcacccaagctaaatttctcactgtaaagaaacattgcaaaggctttaagaacaagtgacagcaaattacaaaataagcagcaagtcaggatttaccctactacctactgtcataacaattactgggtcaagtgaggggcattttaaaatggaaacactatttttctaatttacgtggattaaaaatgcatatttccctgattgatttataatctattgataattaatttataagatactattacaatatagtatacactgccttgaaaacattccaagtgagattgctttcctggtgaacatgcattagttttaatttttctttgttatgccccacctagaaatgctgtttattcactcataaggaactatgatgtttaatctattggattttgtgttcattgtatctgtttttatcatttacctatgactaaagtgaacagtgagaaatatatatttaaaccaaacaaaacttttaaaatatctttttttcaggggcttatttccagaattctcccagagtgaaagtcgtaccctaagaatatgttaggccacttggggaaacatttattttttatttttttccataaagtctgtattctttgttaaatggaaacatttacttttgaagcctactcaggtatagtttattgcttcgtaagaggaatttgagtttacaaagctttccatcagtttgttagcatgttacacacatctgggaatagaaacttaactgtttttaatccaaatgggcctcttcctttacgtcccacaattaatagaaattactgtctctcacacccacctcatgtaccaccttttaaagtgaaagctttaaaatggttgtccctaggtgtccaagaggtattgattccaggaccccagggactggtttcaggacccctgtggataccaaaatctgcaggtgcttaagtccccgatataaaatagtgtagtattgtatatggccaaagcacattctctcatatactttaaatcatctgtagattacttataatatctaatataatgtaattgctatgtaaatagttgttttactatattttttatttgtattacttttttgttgcaatgttattattttttcaaatattcttgtcctcttgttggttgactctgtggatatggagagtcaactgtaccctgttgtactccttggatcaggcatttaggagcagtggctggactatgagttggttattctgggcttgctgactgtataaagatttggttcatgtcactgtcacccagagcctatggggccaggcaggatcagaggaggaaagagggcaagcaggacttctatgagagcaagagcgtggcccagtgcagagccaggcccaaggccactgatgcacaacattttgaatctaggaacagaaggaaagggaagggtgggaagcagaagacaaggcggtggtcctgtccaccctggaaaatgagtgcctgcctctgagaataggatgaattagccatgctcggtggtgctcctccaccgcagtgcaatgtaatggctcactatccaacctgcagccaggctgcctggcttcaagtcgtcactctggtacttactaattgtgtaaccttagggagattactcaagctcaacaagcacctgtttcttcatctgtaaaatgagggttataaaatcattaccaacctcatagattcctgtgaagattacttagaaaatataaaatactctagctcactcctgtaaagagcaacgcccgacacaggaagttaagcatttttgcatcatatgtcttttgcaactctaactgcacaccactaaactctttaaattctgtatggctttcttctaccactagtatctgctatgctctttgtttctgtgtcaaatccttggcagtaaattaattttttaattcaaatccagtggtttactcatgtcaagcacctaagcctagagacatagtctcagtctttccctttatcatcttgttaattgtcaaagctgatgaggacactaccaatccaggccacagtgacataagaagaattaattcttttcttggttatttttgcatgcatttcctttaaagcagaataccctcacttagagttttaagtaggagacaatttgtcagaagataatgcttatttggagttttaagtaggaaacggtttggtgtaatattcttaattttatatgaatttgtgcatagaatcttatcagctgaattcagaaaacaatgagcaaatatcaggcaaggggaggcatggtaagggagtggagaagtggaccatggtcaggaaatatgggattcagtttgggataattttttttgaagtcctatatgaatgtatggagttctagtgcttggggttttagaagatgcaaagcagaatcagcttttactctcaaggagcctatagagtcaggtgggtgatacataacatgtagatggggactttataacctcagaacctaacacacgcctggcacatagaaactgcaaatcactcactttttatccttagaacacagcaaatgagaaaatgtaataaaaggttaaaatcagatttttataagtatcgtaagacaggtgtaaagttctatgtggtataaacaaggagagatgaaggaaagatgtggaagaccaagcacttgactgggtcttccaagatgtgcagaatatgtggctttgtgggtggagaagacatgagcaaaggcagcaaggtgagaagattcaggaaacattgtgagcagtttagtttgacgaaagggaagtggagagaaatgaagttgaagagtagattggttccaaaccaatcaggattttcaaagctaagcttagatatttgaacgtgattctgcaggcaatgaggatccgaggaaaaccttgtatcagagtagtagcatgatcagatttaagcgtcaggaagtcacatcattaaaatggatcaacagcttaactattgggcagtgagtttagaaatgagactggtgcaagagggatttatttatgagataaaattgatatgactcattttgcacctctaagtgacagacgatggtgccactagcagagccagacagccccaaaagaagatctggcttgatggaaagatgacaagtttaacttggggcacattaagttgttggtgctggcaggacattcaacaccaaaactcatgagagattttcagtggagagatcactcatgtacagaaaataattgaagccttggaattaccaaaggagaaaatgcctgagaacagaggcttaaggccatttccttaaggaacacccccacttgcagagcaagagcacacaaacagtgaatggcaagaaatgaggtgaacactttggaaagctgcagaagtcatagggggagaaggtgtcagaaaggaaagtccagacaagaattttattgtcgcaaataaatatggaacctgagaagagatgctgaatttgatgactaagagaaaactggtgacctttcaggaaagtagaagagtagtaagggtcaaaggcatgctgtgaaagattaaggcatgaacaggtggtgagcaagtagaagcaatgagcatagaagattttctcaagatggttgatagcaaaagcaaagacatcctagaattatcttaattttattatttgcttaaaagtcacaaacttcacttgacaacttaacagaatagtaaaattaaagtaactttgtaagaacggggagactacaacaggctataaactgaaagagagtttccagtgccccataaaggagtaaaattgaaaaataacagtgggtggtcaagaccacaaaacaagtgggaaaatatgggatcaaggatgtaattgacatgttccaattttatgaaatccacatcatatatctagattaacgtaacaattaacatggtctgccaaacagctcagagatggccacgagaattccaacagtgtatgagccattttgtaatccagtcatgtggtcacccatggatgtggcctgtcttcccaaggatgaattaattaccttatctctttattcattgtctttccattcccattgtcttagtaatatcagagaagtagactgagtaatcttttcacaagagcactcctcaaggtggaaaaggaaactagactctcagtagtacattcagcaaagagtagggagaaacagtcctcctaaaacctgccttgcatatgaaagacaggagtcaggtacaactatttcactgacctgagaaatacagaaagatgtttggggtgttgtccagggactgctaggttacatttattgtcaatgtgagtaagaattgtctaagagtaaaatattgaggaagacaaaatgaacatttgcctacttctacaaccaagaagggatatatggaagagttcatctggaaagtaaaatcacattaaaatgctacaaattaatgtagttattgttgttaatattattatcaacactaatagaaatggcataaacataccttcacatttgctactatatattgaattaaaaaatggtagagataaggctaaatttatcctagttcaacaatgattcaattcatatgagaaaactgagcatgatttgttcgttttgaatgccttaaaccaaatattttaatgtgcattactcacaattagattctaaaaatgtaaaacaaacatgatgctacagcactagtacaaaggcagcaaaaatgcattttaaaagcaggaatactacttcagaaaaatgtattaaaattgaacatgagcttgagaaagtaccgctcagtgcaatcatggaaccacaattaaagctgggcaagacatggaaggtttcctgatagccttgttttataattgtagaaactgagggccgagctcagttgctcatgcctgtaatcccagcactttgggaggcggaggtgggtggatcacttgaggccaagactgtgaaactagcctgaccattatggtgaaaccctgtctttactaaaagtaccaaaattaggtgggcgtggtggcgcgtgcctgtaatcccagctactcaggaggctgaggtgggaggatcgcttgagcccaggaagcagaggttgcagtgagccgtgattgcaccattgcactccagcctgggggagagagcaagactctgactcaaaaaaagaaaaaaagaaactgaggcccacacaaaaaaaagaaaaaaagaaactgaggaccaaggtgtccaagagccccattaaatgaatgcttaaagagaaatcaagcaaaatcccttccataaatcagtaggatatgtaacactatgaaagattttatattgatcagttaattttttaaaaaatcgaagctcagtttgaatgaaccttaacttaaaagtaataaaattagcccttttacatcataagaatttgaaaaagttgtgaataagcattcacacatacttatttaaacttgtattaaatgtgaagaaaggctgattaataaaaaggaaatttcattgagaaatcatgttaatgtcatcatggttttaacaggttaacttgttttctctcttgattataaccatacgtctctgatttaataaattttctgagtctgtattaatacagttgtgtgtattgttaagaaattgttagaatttttaaaaacgatttttcacagaaaataagcatactgcaagaagaaaacagcaaggaagggtatttttctgagtactatacatttcagttgtatttgtagtacctatgtgacaatcttaattattggttttataaaagctaagatcaggtaatttgaaatttacataaacattgcccttaatatttaactaaaatataatataaattaaattggaaatgttttatttgatttatcttttacagaagtataaatattacagcatatgagttattttattaacccttgtgttaacaattatttttgagatattttggaacttttaataacagaattactaaatgattctttaataattataaagtatgtattattttaaaataataaatatttaatttaaatttttaagttttaaaaacattttcatattttaaataatttttagtatttgtttaaataatctttgattaattctttaacaaagaattagtgtttttaataacaagataaaattggcattgttttctatttcacagtaatgcttcagtcagatacatacatatgctttgttagacatgttacatgctctgaaaaaagagttaatgactgcgtgcattcattatgaggtagaaaattcttactactattgatcttgttatttcatgatttgaaaatcttaaaagttagtaagatgtgcactagatgtagggaattaatgtttgttttttggttttcttaacagttcgacaattttatttttatttattttaattttttaattattttttaaaatttgtgtgggtacatcgtaggtgtataaatttatggtgtatgtgagatgttttgatacaggaatgcaatgtgagataagcacatcatggagaatggggtatccatcccctcaagcatttatcctttgagttacaagaaatccaactacattctttaagttattataaaataaagaattaagttattattaactatagtcgcccagcaataaagctactaaaaaatcaacatatcgatgaatgaaaataccaggaatttaaaatggaatcatattacataacttgattcatattatttcataatttaaagccctttttgtacaaatcactattaaaatcagtactatttagtgtttcttccaagagtattcaaaagtaagaattatctgatattccataagcaatccaagtcaggaatatctaatgtgaatggttggtaaaactgttggggtcctatagatacatgcccttgctccaggaaaaactcctttctcctatctcctggcttccagtccagtgtcccaggggctctggccgacaggctagcatgagccatcatgcctcttggtatgtctcactggagtaatttctcacctatcatgttttgccatctcagctttgtcccagtgcctcttgagcttctccgaaggtaacctaagcttcctgtttgtctgcctattgcaacagcacctattgccacttccttggcagcctgttgacttggaaatagaaccctacatttggtttctgctcctgacactttctgagcttcctctctggtcttctctgctcccattccttcctctgccttttgctttacagatccccttttaaagtcccttccatctgggtattacactactcctccatttttctccctcttcacatctgggtcattagaatccattgtaccagtgtaggcccattaaggacagatgcttccactctgcagtaagaattgtgtctcagtttatatttttctctgtagacatatgtcagcttctcttgtcatagtgtgtgtacatgcaggttgaacaagtagaggacctcacggttccaatttgaagtccaaaatactatcaccatcagctgtaaatttggggaaactgagggacaaagaggttaaatcacttggatgagtcatccaactggtgagactatgaactgggattcaagctcagagagtcaggatgacgaagtgtgtgctcctaaacacttaccttaatatgagggtaagcaggcagggtgaaatattgaggacactaacaaatctagtcaccctttacctgggtccttctttttctttctttctttctttctttttttttttgtaagttgatttaataggttgtaagtttatctacgaattccaaaaagtaggtgtgttctttaataagcagtgtatttgagtatcttgttttcctatagtgaggagaataaaatatgtaaaagcaggaagacagaggaagcctgggtgaaaggctcagagaatgtggcagcatttttttttctctccttggcatcacatcaaagacagactcacagaaaaagacaggcaaccctcaagatattaatgaaatgtatcatttccctctgtagtgaggacctgcctctgatcaccagtaaagcctcaaagccataacaacacatacggtgtttatgaatttaggattttacagaagtattataagagttgtcattttccaaatagtgttttgtatgttcatcgtgtacttgctggaacattttgtgagtacatgtacaaactgtgtcactggagtttggctgggcttctggagaaaagaagctgatatatggataatggcaaagcatgttgtgacatggatgcaagggcagagaaataaaagacataggtctcaccaacgactatgtagcttcaagagctggtggaatgaggaagacaatgtggggatgttgagacaaagagacataaaagcagtaaaccacaagggacagatggtagaggtgtgtcaggggttgcaactgtattttataaatggtggtagaatatttggcctagtcacccaacattaatgttctaagcaacctgaaatctctccacaaaagaagctttctatgaaattcctatttcatacactccaactgtcccctaaggagtcattctaaagaaggaatacaagagatccatcctgagttctaattctcttctctctaacatgtggacacttatagatattacctttttccttgagctcagctgcagcatgcatataaataagaaacaaatttacttgtctacctcccaaatagtctttcattgaatttcacatattagttcttgttactatggaagacatttggggctaaatattccatcacaaatgaaatgctacagccgtttctctctccttctgaatagtatttgtgacagattagccagctgctcatgaagtttcaagattttttgtttggttttgtttttttttttaatgtattagagttttctctacttctggtaatttctgacattacaagtctctcaaatcatacctctatctcttttgcttctgcttttattgaaaaacaattatttcttgcctggactattttactcctcttctgttgcatttcttggggcctgggtctgtagtaccctctcactgcagtgtcttagtgtcattgccaaagctgccctcagagaactctatgtagtgatttctagtttttctctccaggtccctggccatgcttcttattgcctaatgaaccaggatcaaggagttcgatctctgcattagcctctgatcacagcccctgaacggccctatcttatccttcgtgcatcctctctgtgactctcagaaaggctgtcagtttcctggtcagtcttttccctaataacctagggctcatagcatgctccataatgccctttcttttccctcaagggatctttgaaaatatctctggcatataacaggaggggcctggatctctagtaccttctgtgaccagctgcagagactatcaaatccctgaaatgactgcctaagaatgcaactcccaggccaccccaccctgcaacatcaatttaaattttcctcagaggaaatgttatcatttcttggtcagcatctgccactgtatgtggtcatttgggcgactgcagttctgcaaacttacctctagacataagagatgtttaaaatagacacttagggatttactaactgataaaatcatagaatgatgtgcatgtttttttggaacttttttgtactccctattccttatgtgttatctgctgagctttgttcataagattggtctgcacatggttagcagggactaaaaaccacaaagtataaagatagagacatccacaagatgcttccataaagcatgctttcctagtgctttcgggaacttttgggtgcttctgtctctttgtttttttcttaaataataagttttatcttctgtccattattattgagggtctagcatttatggagaataggacagcaaatcaatctataagctcttttagttttcctactactgctaaaacaaattactacaaacttagtggcttaaaacaacacaaatgtattatcttatagttctggaggccagaaatccaaaataggtcatagggaataaaatcaaggtgaatgcagagctgtattcctcctggaagctataggagagaatgcatttcctctttttccacattccacaaaccacctgtattccttgactcatgaccccatgtcacttagatccctgcttccattgtctcctctgacttggaccctcctgcttcctttttacgaggatcattgtgatcacattgggcccaccttgatcatataggataatcaaccctccccaagggtcttaatcacttctccaaagtccctttgccatataaggcaacatatttataggttccagggattagaatgtgattctatttgggagacctccccaacccccacttaattgtaaatttgaaactacgtgtaatacttttcacatattgcattgaaaataaacatgttaatatttttattaagacaagaaagttgttttttaagatcacaacaagcagttacttggaattttcatgaaagaatatttaccacatagtcttaatacatcttggtggctagataccaaattgtggtttgctgacttctttacactgattatatgtatcattaaaaatggatgagacctaaaactgccagactccatccaatacaaaaatacaagtatttgtaggaaactcttagaattttcacatgtaagaatatgtcacatttctgaaaaaaattctacccagtgacaccatttcttactatgcctatgtgttttttcagcgttagtatttgaacataaacacttttccctataaaagcctataagccaatagcagctgcagaagggagacctgcaagttgttggcaggctctggggctcactcgggttcctgacccaggcctttctgagtctttcagatgcttcacacttccctgcacatcctacttctgtgacacccccgaagttgcacttatggtccaagctaaatgctacctcaggagctcagaaataaagaacattggagtgaaaaaaaattccgaattatgcttgtaaaccaaatatatatggatagtgtgaattgtgcagacaacacattcaaatacatttcatatggtgaagtctagccaacctcaaatctattagtctgatctacttcatccactacatttgtgtaagattacccttctttcatagtaaacacatatgtaaaatattttaatgtgtttttgttagattcattttaatgtttccaaactgtttctattaatattaataagtaccattttatatgttttctcctatatttcttgttttcatccaggactactagattccagtaagaataaaattaaacattagaggtttgtcttccatattgtttaagaaaattagtttccctttttaaataattactaatatttgaagattatgaatcataaattaatcacaagtgccatacctattattttagaagcaattgagcaatataaatggtcttcagttttaccagttcttgatctgtagtaaattccagcggtggtggggtctgtgaaataatgaagaaaaaaattattttaaaaaaagagaggaaaaatgatacctaaattagaaaatcgttggttttatttcttgtatcaaaatatctgataattttaacattcattatgtgttcttttaagaactgatgctcatcagttttctcatcagtttttctgtttttcacttggcatttattgatattttctattgcctgagtaatttaagagcctgcaaaattaacctgcctttcaatttgcacatgtacttattatggtaaaatcaatattttcatcctaggattggtcatgtactttgcagcctaatgataaggagaaaaataacctcagaagagtgaagctgtgctggccagcaatggagatttgatagggaagaaaggtgtcatatcacctggatatagccaactaacagcttgatatatatgattccaagccaaaacctacatttagtctctctctctttctttctctgtctctgtgtgtgtgtgtgtgtgtgtctctctctctcatctttatactatagattataaaatttggatacgtaaatagtcatcccacttatttctaacacaattctgtgataataatgccttttcagtgtgtagctttcattgttttcaaagcacctttatagcccttctctcctttgatctttacaacaacccagagaagtgggcaggagagacagtaatcttcccattttgacacatgaagaaatctcttcaagcttcactgtctttgaggacctctgggtaatgatgtcatctgtcctgaaactgccagatgacttttgctctagaagaaggctagggagaaaaaaacaaaacaaaacaacaacaacaacaaaaaaacgaacatttaggctgggagactgggctgtcttttcccccttcacccctaaaaatctactttgcaaagagagcaacatccactcaccatccccaacactttctgttccccttccctgatttctattttttccacagcacttactactttgggttgtgctgcactgtatttcatttatttacttactgtacttgttgtctggcttccccaccagaatgtaagatccttgaaagtaagtatttttgtttgttttatacatatctccccagcaacaagaacagtgccactggtagaaggcataagaaaatgccagaatgagtcactgagtgcagactggaactgggaacaggaacagttagctggtggtccacagggaaggttctctccttttccttggtgacagtgagaagtcttatttgcaagaggaagagagcatgacttagaataacagtttggctttaggtgggacctatactatgcaacatgtggaacttggagggccttggagaagctgagcttgggagcaggctcacttgcctggggaagggaagtctctcagcccattctttagccacctagcaatagttgttagtcagtcctgtttgtctacccacactagcacatgggaggcactgtatttgtcaaatgaatgaatgatgaatgaatgaaaccagtcatttatatattgaagtaaatcagtgtcatggaatgttttatgtttaaatgaagagagaaaactttaatcagattaaatataggaaggatatttgggatctagaaggccaacccagttgttcaatcacagttgcctccatgggggtcaaccttaagcgttgtgcctgcaagcaatcacacttctctggtggaaaagccattctgattctggggccctttttccaccatttcccttcatccacagcaaggagcttcagctctggagactgtaatttgcacaaagcaattcagggtataaaagcaaaactacacacttgcaaggtaaagataccaattcattcgactctaaccatcaaaagatacatatacacatatatgacatgaggaatactttagtcaccagttacccttcctgcaagattagtcattagatcccatgataggccttgttaatgccatggagagaaaagagataattataatgagttaaatttagaaacaacagtcattttttgtggattagaaatagtgaaagtcagtgtctttctatcagtctttcacatcaaaagctacaggaaaatcataagaaataatgaatagaagaaatatgtactatttctaattgaaaaatgtcttttatttcagctcccttgtatggctacctgcttaaatatattcatgcttatgtttaatgtctcctataggttcctgctataatcttcttttttttaattgttcttgggttttaaaaaaatgtttgtttgacaaataataattatacattttcatgtgatagatagtgatgtttcaatccatataatgtataatgatcagaacagggtaatttgcatatctatcatctctaatatttatcatttccttgtgttagaaacattcagtatatttcttctagctatttgaaacaatataatacattattgttaactgtagtccttccacagtggtataaaacattataactgattcctcctatttagccataatttttatatcctttgacaaatctctccctatccctcccttccccctaccctcccaagcctccagtttcctctgttctactttatacttccaagagatcaactttttttagcttctgcacatgggtgagaacatgtggtgtttaactttatgttcctggcttatttcacataacgtaatgtcctccagttccatctatgttgctatgaatgataggaattcattctttttatggctgaatagtattccattgtgtatgtatgccacattttcttgatccattcatctgttgtggtacacctcagttgatgctgtatcttggctattgtgaatagtgtggcaataaacatgggggtgcagaagtctttttgatacaatgactttctttcctttggataagttcccagtagtggcattgctggattatatagtcattctatttgtggttttatgagaaacctccatactgttctctagagtggctgtactagtttatgttcccaacaagaggtataatatacagttcccttttctccacaccctcaccaccatttgttattttttgtcttttttataatagccatcctaactggggtaagaagataccacattgtggttttgatttgcattttcctgatgattagtgatgtcaagcatttttaaatacatttgttggccatttgtatatcttccttttataaatgtctgttcagataatttgaccattttttactcatattatttgggtttttgctgttgatatgtttgagttccttgtatattctagatattaatcccctattgaatgagtagcttacaaatattttcttccattctataagttgtctttttgctctgttgatgtttcctttgctgtgcagaagctttttagttttatataatcccagttgtttatttttgcttttgtttcctgtgctttcgaggtcttgatcataaaatattttcccagtccaatgtcctgaactgtttctcatatgttttctcctagtaattttatcatttcaggtcctacatttaggtctttgatccattttgagtggatttttatatagggtaagaggtggaagtctagttttattcttctgcatacggatatccagttttcccagcagcatttattgacaagactgtcctttctcaaatgagtgttctaggaacctttattaaaaatcagttggctgtagatatgtgaattaattgttgggttctttattctgttccattcttctgtgtgtctgtttttatgttagtactatgctgttgtagttcctgcaggtttgtagtatatattgaggactggtagtgtggtaccaccatctttgttctttttgctcaggattgctttggctactcagagtcctttgtggctctattcaaattgtaagtgtttttttctatttctgtgaataatgtcattggtattttgataggaattgcattgaatctgtagattgcattgggtagaattgtcatttcaacaatattaattcttctaatccatgaccataggatctttccatttgtttgtatcctcttcaattcctttcattagtgttttgtagggttccttatagaggactttcaccttcttggttaaatttattgctaggtattttacttttttgtagctattgtaaatgagattgccttcttgatttctttttgttagttcattcatgtacagaaatgctactcatttttgtatattaattctgtatcctgcaactttactgaattcgtttatcagtactaagagttttttggtagagcctttaatttttctttacataaggtcacgtcacctacagagacaatctgacttcttcttttcctctttaaaaaaaatctttgtactacctacctctatttgtcaaaatgactttttctcctttataatgtggatgcctctttattttgtttggtctaattgctctggctagtacttccagtactatgttgaataaaagtggtgagagtgggcagccttcctattctagttcttagaggaaaaccttcagcttttccccattcagtaagatgttagttgtggtggtctttgttttaatacaacctacaaaataaaatacatttatgtacatatctacatatatacacacacattaaacataatgtgtatgtatacatatatagatatatttatatttatatagacctaaatacatctgcatagatatatgacacgttcatgataaaccagtttgactgtggtgtggcccacacacctttgcttgcctgtttctcctcccacagtactgtggctctccagagaggctctcatatataccctgctccaagagccccaatatgtgtcctgttctgcagcaggaccgcttatggagatgctcttcatcaactaggtagtgctcatttctgtatgttcttgaaatctggaaaacctcaagacagaaaatgaatttatttttaaagtggaatttaatgcagcaattagacagatgagaaatatttttggcccaaggcatttttgttcacaccttataaaggagcatttttggttctgcttacaaatgactttaccacagtgttgaaagtgtctctctctctcctcttctcttctctctctctcctgcttaaaaatgactttaccatggtattaaaggtctctctctctgtctctctcaattctttcattcatttattcaatatatacttaatatattctatgtgcaaggcacagtgcgaataactctcgaagatgttttacactcataagacatgtgcccaaaatgctacagcattaatttgccacatgtattatttggacaattcagtagatgccatagaggttctaggagaaggaatgtttctggaccaaggatcagaataacattcagggaggaggtggcaagcatacaaaaggtggaatgaatagatgtttgagacaaagtaaattttcaagtttacataaaaaagaacgtttttctaagagagtagtgggaaagtggaactaaagacttgtagcaaacaagttgtgggtaattccaaatgtgggctgaggggccttagatttctgtattgataggtaaagagagccacaccaataacagacaaacagagagccaaatcatgagtgaattcccattcacaattgcttcaaagagaataaaatacctaggaatccaacatacaagggatgtgaaggacctcttcaaggagaactacaaaccactgctcaacaaaatgaaagaggacacaaacaaatggaagaacattccatgctcatggataggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcattgccaagacaatcctaagccaaaagaacaaagctggaggcatcacactacctaacttcaaactatactacaaggctacagtaaccaaaacagcatggtactggtaccaaaacagagatatagaccaatggaacagaacagagtcctcagaaataataccacacatgtacaaccatctgatctttgacaaacctgacaaaaacaaggaatggggaaaggattccctatttaataaatggtgctgggaaaactggctagccatatgtagaaagctgaaactggatcccttccttacaccttatacaaaaattaattcaagatggattaaagacttaaatgttagacctaaaaaccataaaaaccctagaagaaaacctcggcaataccgttcaggacatagccatgggcaaggatctcatgtctaaaacaccaaaagcaatggcaacaaaagccaaaattgacaaatgtgatctaattaaactaaagagcttctgcacagcaaggaaactaccatcagagtgaacaggcaacctacagaataggagaaaatttttgcaatctactcatctgacaaagggctaatatccagaatctacaaagaactcaaacaaatttacaagaaaaaaacaaccccaccaaaaagtgggcaaaagatatgaacagacatttctcaaaagaagacatttatgcagccaacagacacatgaaaaaaatgcttatcatcactggccttcagagaaatgcaaatcaaaaccatgagataccatctcacaccagttagaatggcgatcattaaaaagtcaggaaacaacaggtgctggagaggacgtggagaaataggaacatttttacacggttggtgagactgtaaactagttctaccattgtggaagacagtgtggcgattcctcaaggatctacaactagaaataccatttcacccagccatcccattactgggtatatacccaaaggattataaatcatgctgctataaagacacatgcacacatatgtttattgcggaactattcacaatagcaaagacttggaaccaacccaaatgtccatcaatgatagactggattaagaaaatgtagcacatatacaccatggaatactatgcagccataaaaaaggatgagttcatgtcctttctggggagctggatgaagctggaaaccatcattctcagcagactatcgcaaggacaaaaaaacaaacatcgcatgttctcactcataggtgagaaatgaccaatgagaacacttggacacaggaagcggaacatcacacaccggggcctgtcgtgggatgcagggaggggggagggaaagcagtaggagatatacctaatgtaaatgaccagttagtgggtgcagcacaccaacatggcacatgtatacatatgtaacaaacctgcacattgtgcacatgtaccctagaacttaaagtataatttaaaaaaaaaataaaataaaattaacagaaaaaaaaagaatgtctttaagagacggacattgttgcagagcccttttactagggttaaactggagtacagagaacattagagtggggctttagtgaggtgtgtgggcctgatttcagggagtatgtaaaggctgggaaacatgaattgtaaggcagagatgttgggggctaacagagagggagggggtcaaaggtaaccaaggtgtcaatcctagatgtctggtagaatagtgtagcatttaatggaatcagaacatcaggatgaaggcagtattaattgcctacaggtgataaaagttgtccacagaaaatatccagcaggtagcaggaaagacagacagaattgggatttgggaaagagtctggactaaagatgcatatttgagaattgctcatggagagatgagaattgatgagatgtggcaatggataagatgtttggaagagtgagaggaaagagaaatgatgagatgtggcaatggataagatgtttggaagaatgagaggaaagaaaattaatgagagcagaatcctttttgtttttacctaaattttaatgatgagccctagcttttactgtcctccctgttttagctgactctgtataccctcagtagttctcaactgagggcaatattttttttaagtatgagaaggagagggtgtgataccactggcatccctgggtagaggccagggaagccactaagcatcgtgtcatgcacgggacagccccacaacaaaggattctctggcccaaaatgtcaacagtgccaaggttagaaacactgctctgtgtttgccaaaagaaaatcccttcagtgtcttgtttagtcaagcaaactgtctcctaaatttggttatctcctacaagaaatggaaagcagaaatcctttcagaaccaaatacgctctcccacaagggtctctaattcttcctgcacacttctctgtagaagaaagactaaatattcaagaatgacaatttgggagcagattattttttataaaaccaagcaaacactcatcttatttttcaagtaattccaactgaacacatatatggtaaaagccactgggaggaaaacgaggaaagggctcccacatgctcatatctcttctggatgttcacagacatatatgttaagtaaacagcatacccatgtacttgagcagcccaggtctgcctttgaaccttctttcctgcttgccatggacagcattgatctacatgggctgtgttgtgcttgtacttcattgcacagtttccaaatgtttctgcacgtggaaataatattttatttttgcaacattccttaagggatgtctagttgattcattgtgataaaattggaacaataagtacatgtgaaagaatctaaatattcatgaactgttcgacaggccacttaacttctctgtgtggcattttaggacagtgcttaagggaggaaattctgtgctattctgtccagaacatctctttctctgtttcctcatccataaagtgaggatgataatgtgcccatctcatagggttattcgggaggtagagtaagctaaattattagccacatccccaaagttctggaaccatcataacaacattattcagcattgcttgcttagcatttcaccaaaccaaactcttcatattttatcatattgtatactttgaagtgacgtgtattaccccacacggatatactgatttcttcccttgtcaatgacacaaaaataatcatgaaatatttcttacctgaaaaatgtagcatttttactgggatgacattttgtaaatatgtgtgggtatctttagaatgcccccagaccaaaaatattgatagagttttaacattaattaactttataaatagtgagatcaaagaaattttgcttcttctttgcttggttgatttctaaaatgttttcactggaattaagttaatgtttaaattaaatatgagaaaacaacaaatatttaaagataaaagttgcatgggtttttttcagtatttattttagaaaaacctgaaagttcatccataggaaagtagaaaaattatgacatatttatatgatggaataactatacaacagtgaaaagcaatgacatttttatatttgttgatatctatagatctcaaaaatataaggttggatgaaagaagcaatatacaaaagaatacataaagttatactacttgtgtaaatttagtaagagacattatgcaatactataaatggactatggatagcaattgtatctggtaaagaaggtagaggaataggatggggaagaaaagggagacctcatctttatgaaaaatgtatttcttttacaaatccaaatgaatacataagaagcaaaatgacaaaatgtgaacatttgtgaattttgggggtggatacatgagtgtttgttatattattctctgtacttttctgcatttttaagacttaaaaaagaaaaaaaagactttcattaaattgggcttggatatagaaaaaaagaactgaattgactgcaaagtaacaactctaaaattaggataatttgccaagacctgtactgctcaaaagcaattctcattcccattccagtaagaggtttagtgttggatattatggatattcatctgactctgaaatatgtgcctatatagaataaatgattttactgtttgagtagagactctaaagataatacactgaaagatgcttgcaaaatataggaattgattttgataatttgcaagacctgattacaggtagtctgacacttgtcagggtttacccaaaatagttctattgaacataagctacccttggataagaagactgaagcacaattaaattctatcctttttgctcaaggaaactttaggattggccctttgctgcaagactctgttggccttccttcttttacgtggaaatagaattcttatactccttagaaaaccaaagcaaggcctgtaatctttcttaacatgcatgtgtaacttccattaacacgtatcccagataatattccagcactgctatttttgttgtatggctctcagatggaatgtagaaaaacagccaggaatgattttcttttggttccaggtcccatgcactttatttcattttccagctgcccttcctccacaaaactgaaattgagccaggtttgttttctggctctaaatttgatcataaattgtataaatttataaagtaaattttataaatgttttacttagtcgacctccatttcaagtatgtgaaacccccaaactcaggaatatgttcaagtggtaacttttttttctttacaagcagggtacaacatgaattttctccagacactgtaagcatagacccagctcaaggatggtcaatgtgtataatggtttctttcctccccatcactaaccatagtggctattgctcgtatattaaagtggtctttcctgccaatcttagaagcaacctcaggattttcatcaacattacacgctcaattaatctgaattaatacccaagaagaaacctatttactcttgctgcagatgtactccagaatgtatggaattactttctgcttcataatctggctaattaaatattgcatcaattatattggtcgaggccatttttccctttcagtttctaatagtagagtaccatcagatgtctaggaagcaaaattgactaaaattttgtgattcttagatcacaaaataaggaatatattttttcatcaatgaaatttcactcactatttttatcatgagtagagtaaatttatcaaccatgttatttattataatacatggagtgaattattattatgtttcagacattgtgccaagtgtcatacatgtatttcctcattttatctttgcaacaacttcatggagtaggttttataattatacagataagaacactgaggtgtagagagattaaggaatttgtccagtaaaacctgaaagtggcacatttctgtttcaaatccatatacctcccaagctctttaaccattacgctacactcagtactcactttctaattatttactccattttactattgtaactctttggtttatttacatctattgtgtcttcataatggaatgactatataatagtatatcactgtgctgcttctcagttccacattcacacatcacactggtagcttgaaatgagccatagacagggaatttatgccacagaagttggcaaatgctacaaattagggttttgttttgttttattgagacccagttgttaaacatttaccagaatgccactgaccacattggtggtgttcttgttatttttgtttgttatttttgcagtttgttttgccctcattagcttcctcactaataatataattttgagtagaagttaagattttggtggatgaatctaatcagagagtgagaagaatgatgagcttcattagattatctagtcaagctgcaaattacttattcaaaaaagcctgtattttaagaacagaaatatttattagatggcagatagaaaagtagaaaatggggtttctgagaataaactgatgattatgtgaccctcagataagtatctaaaattttttattgtatttattagagcaaaactggagaagaatttacaaatttggtgctctctctctgtgtgtgtatatatatatatttgagacagggtcactcaatcacccaggctcatcatacagtggcatgattgtagctcactgcaggctcaaattcctgagctcaagcaattctcccacctcagcctcccaagtagctgggactacacatgtgcgccaccacactctgctaatttttttttttctgtagagacagggtctcactgttttgcccaagctggtcttgaattcctgtgcttcagcaatcctcttgcctcaaacttacattcattttttatgtaaacactttgatatattttataatctccagctttctgcaatgtctgggatcactgtctatacaaggtaatttattgtttcaatttctaaaggaaagtggtgagattttgagagcagagctgggcctgttttatccttttatttccattctctgtcccaccctctgtcttttgataatgcatagcaatttgtaaatactgataaataactggaattcatctagccataagattcatagctggtgttctctttttaacttaatatattgtatttcctgcaagtctgatagaatatggaactgggtggaaaatttgcatatttctgttctcatgtggaattgctaaataatattctagttcaccttttatataaaccttcaaatgaaccacttagcacctcctggagaccactattacatcaaattttcaaattaataaaattacgtcattattcatttgttcattcattcaacaaatttttgatgaagtaaaataatagtataagcataacaactgctatttattgaacacttaatatgctccaggttctaatatacatactttactggctgtatcctacacaaaacacacaacaacatcatgaggtagctgttaatattattcctacttaaaatatgaagaaactattatttggaaagttgaagttacttgtccagatctgaatccagataattgtttcttaattctgagctcttcattgtctagtaccttgcctttgtatgtaacacctgtactaggtgttacgtggaatgtcagagaaacttgtaatattgttgtgaatattgacctttcagtctcattggagaaaatatacatggtaatgattacattgaaatggtgagtatgtattcatttagccacaaaaatccatcaaatgtaaaaggcataaatgaaggactttcttctcagtaatactgggtttccattgctatactgcttccttttgccagcataagatattcatatatcatggaaaaatagatcagagaagtcatgttatatgttttttaaagatgtaatatgttaaacatatatatgtttaaacatgttatatatacatgttatatatatgttgaagcatgttatatatgtttaaacatgttataggttttttaccttaaatatttggaaagtacactatacattgaattaatctggctaaatagaaacctgatagtatatgttatggacaccaagttattttttttttggattcttcatccttttttttattattatactttaagttttagggtacatgtgcacaacgtgcaggtttgttacatatgtatacatgtgtcatgttggtgtgctgcacccactaactcttcatttaacattaggtatagctcctaatgctatccctcccccctccccccaccccacaacaggccccgacaccaggttatttgatagctctttcacggtttcttcaaacaccaccctctgtcaccaactctctaaataggatatcaatgtccgagacttcagtagctcttttcctatggacaccagtattgattgaatacttcctttgcttcttgtgcagtgtgctagaaagttgtccccaaagtagaataaaatagatctccatactccctgaaaaaaataatattttgtaaaaggaaatcagtaaatgagattcagtaatcactcacagatattccctaccatctttgctgtgtctaatgtatataaaacataacttaaaaacatagcttaacaacactgctctcaaattatatcactttaattttcatgaattatgtttatatattttgtatcatataacctaaagaaacaccaacacttaaaatagttacagaccacaaatttgtgagaaatttcacttcacaccattttaaatagttggtattctccttataaatgttattatatattttattctctagacgtctgttagaatatggagctgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaatatggagctgagtgtgaaatttgcatatttttgttctcacctaggattgccaaataatgttttagttcactttttacataggactgagtccaagtatataaaatgatttttttcatggttaattttaactattttatggcctttcgagagcagtaggttttaggtatttttctggactgtgtatttgactaacaaccatacagttcttgtgtgaaaattatttagaaatacactttcttgcagatactacttccatttgcttggaaattgtcttggtatactggtgttattatttttattttctctgaagagatttcatatcattttatacattacaagcatttttgttttatcatattgagcatattctaatagctgctttaaaatatttgccttataattccaaaatttgtgtcatctttggattggcatctgttggttatttctcccttaaaagtagatcgtgttttcctggctgtttgtcaaataattttgaattctatcctggacactgcagggattatgttgtggggactctggattctattacattactctaaaggttgttgatgtttttgctttaaaagacaattatcttggttagactcaaactgtgaaccatctcccctgcagttattggtagctcagttcaccattcagagtacttttgttttgttttttatttattttaagtttttgattgacaaattataaatgtatatttttatggggtacaacatgatgttttgatatatgtatataatatggaatgattaagtaagctaattaacatatctattacctcacgtaattttttatggtgagaacacttgaaatttactttcagtaatctcaaaatatataatacaacacattattagctctagtcaccatgttgtgccatagatctcaaaaacttatttctcatatcagtgcatgggtggttcggtggtagaattctcatctgccaaaaatttatttctcctgtctaactgaaactttgttcccttcgaccgatatctctctatttcccttccctcccaacctctggtaactaccaatctactctgtgtttttatgagtttgactgtttaactcatccaaataacagaattatctttttttaaggctgagtagcattccattgtgtatatataccacattttctttatccattcattcactgctggatacttaggttgtttctatatcttgacaattgtgagtaatgctgcagtgaacataggagtgcaggtctctctttgacatactgatttcaaatcctttggatatgtacccagaagtaggatacctggctcatgtggtaattttatttttagtattttaaagatcctccataatggtttttcataatgcttctattgtgtcctgtgcttgcatacttaaaagaatagcaagagacttgagcggaatttatacacaaaacttggagtcctctttctcaggctctctcctttatgaagttccccagctcactctccagtggctctttcctcatgttgctccagctaccctcagtataaaactgtgaagatctgaaactcaacccataccagtcacttactccaagtattgactccccttcaaaatcttcctacttttgttcactctccaagccccccggctagttgtttttctgtattttgaccagttgttatttgcaagaggttcaattaggagcttactcttcaagattacaaatggaaactcctatactgattttatagagaaaaacattttactatttgccagaaacaccttgcaataatataggaatgtatgaagtttatgatccacggactaggcagtggacagtcttctgtgagcagcagctctgataatgtatgcatattatggcaccagcacacacagttattttgatactgttaagcttatggatggttgttttacatgaagtctacggttatgttttacatttgcccctggtcctcaccttcactgagatgctcacttaaagcactaaagtatccagactattgagaattaattctgctctcaagtaactacggagctttaccaccatgttctgagtaattcattacaatacgtaatatagaattgccaagaaagtccaacttaaatctcacctactgcctcagtcactgccatgactgcaagctaaatcctacacctcttcatagtctccctttctaaccacactgcatattgctcactgcttgtaaaactatcataatttctattagttttgcattaccactattttgactatgaacccttaatggtgaagacaagctatgtgcctcctattaacatattgaatcaaaaacttctacctagcttgaaaacaccttcttgaactgcatgcatcccattcttccaacttgttttactgctgtaattatggacttgttcctttccttattacgtcataggtatagcatgtcactctccatgcagacctttgttgcaaaatgcttaggatattgatgacaactggagtggataatttagaaaataaatttaaaaaaatgcttaggatattgaaagaaatacctctaaatttctacattctttctcatgcatattcctcctaaaacgaactgttaaagagtatagtgccatatttcttacatgctctttctattccccataatctcttagccctttttctgccaatgttataccggattattcctttatatattcctatatatattccttatatttcatataagcatgaaaatgttctttctctcatttggatatgtaatcctaattaaacaaagtcccagcattttcttaaaagatatggagctcatctgtcgacttgtaccaatatcagattaattactgtaattattaagaaacatttgaggaatgttgacattcaaatcaactatagcataaaacatgtaccaaaaagatgatgacgttaaataacttttagaagactatgaatcttggttgtcaaggggtccttaattgctatcacattgtctgttgcttaatgcacataaagtataaaagtaactttaatcaaaactaactcaagaatagaacaaataagaaatataataggattagtaaattctattaactggacattcacacacatcacgaagcaagggttcaggagagatcaggctaaagaggtttctggtggaggagggtcaactctaatgaaaacattggaagtcgatgggatgtggaagcatcatctgttgaaatgacttccacaatgagagagaaacatctttctctcttaataaatcattacgtctccactgtccattgcactttggcccctgtctttttacgatagctggcaagtattcactgtgcctgtagggctagacagcaataggaatgataaaaagaagagttgacaactatgattcattgaatgcatactgcatgcatacatggtgctcatttgtattggccagacaatttgtaaaaccgttatagtaatcctcatttttcagaagaagaacctgattctcaggtcacaatgtagtttatctaagatcatactggtggaagtggcataactgggattataattcacacccatctgactcttaaatttaagctagtggctgaactaatttacactcctaccaacagtgtaaaagtgtttctatttctccacatcctctccagcatctgttgtttcctgactttttaatgatcgccattctaactgtcatgagatggtatctcattgcagttttgatttgcatttctctaatgactagtgatgctgacctttttttcatatgtttgttggcagtataaatgtcttcttttgagaagtgtctgtttatatcttttgcccactttttgatggggctctttgtgtttttcttgtaaatttgtttaagttatttgtagattctggatattagccctttgttagatggatagattgcaaaaattttctcccattctgtaggttgcctgtttgctctgatgatagtttctttgctgtgcagaagctctttttaattagatcccatttgtcaatattggctttcgttgccattgctttcggtattttagtcatgaagtctttgcccatgcctatgtcctgaatggtattgcctgggttttcctctagggtttttatggttttaggtcttacatttaagtctttaatccatcttgagttaatttttgtataaggtttaaggaaggggttcagtttcagttttctgcatatggctagccagtcttcccaaaactgttcattaaatagggaatcctttccccatttcttgtttttgtcaggtttgtcaaagatcagatgattgtagatgtgtggcattatttctgaggcctctgttctgttctgttggtctatatatctgttttggtatcagtaccatgctgttttggttaccataggcttgtagtgtagtttgaagtcaggtagcatgatgcctccagctttgttctttttgcttaggattgtcttggctatatgggctctgttttggttccatatgaaatttagtgtagttttttccaattctgtgaagaaagccaatggtagcttgatggggatagcattgaatctataagttactttgggcagtatggccattttcacgatattgattcttcctatccatgagcatggtagaagacagtgtggaaattcctcaaggatctagaaccagaaataccatttgacccagcaatcccattactgggtatatacccaaaggattataaatcattctactataaagacacatccacacatatgcagcactgttcacaatagcaaagacttggaaccagcccaaatgcccatcaatgatagactggataaagaaaatgtggcacttatacaccatggaatactatgcagcataaaaaagaatgagttcatgtcctttcagggacatggatgaagctggaaaccatcattctcagcaaacttgctctcactcgtatgtgggagttgaacaatgagaacacatggacacagggaggggaacatcacacaccagggcctgtcagtgggctgggggctatgggaaggatagcattaggaggaatacctaatgtagatgacggtttgatgggtgcaggaaaccaccacggcacacgtatacctatgtaacaaacctgcatgttctgtgttctgcacatatatcccagaacttaaagtataataataaaaaaaattaagctagtaaccactgcaagacacagtgctttttggagggaatgagctcatcaaataaggacataccttgtaagctctctctggaaagattcaagttatagatgtaaaaaagctttgaaagccagagagtgctacaaagatgcaaggcattgttcctgtttatttacttttctttgtttttccccttttctgtagtcacctttggtaaataggagaatcatctttaaaatgtgcagttctcttcaggttattctctagatccattctataatgaaacatattcttcagtaacctaagacagtataaaatagtagaattactataagataaacccctaacctgtataattcaaactgtacatatcaccctttattttctattaatctaaacttttgtaatgcatacccaaacttaaggatcaactagtaagcctgactcaagtcttcaccttcaagtattgcataaaagcaaaattataccaatgaaaataaaaggcctccataaaaatcctgcaaagtacacaattttaaaaagtaaaacaaattgtaaagtaatcagtcctataggaatgacatccctaacctttccctaaattacatgaaggttgtgacatttcgtggccactggtacagctaaatataaacggattattctgtgcctgctccctgtgcttttgctgactgacacaacaattaaggaaacaagtttccttcgtaaattatagctccatgcagctttgagtaagcagaaagtgtacattagaaatatttttagcttgacgtgaaactttccaaaggctcctaattaagcagttaagtccaagaaactataattgcaactgccaaaataactgggaaatcataccttggatgggatcaatcttaaactaaaactattgtttggaaaatcttatgaaaagactttattattctttaacatcctctttaatagaagggtacttctaatattgcccactttctgagaaattcaggtgcactgtttatttgcagagtatgtatacagtgagtgtgtaaacaaatactagcaaaaagaatgaccgtaagcattggtcatttgtcactagaaaataaacctccagagtcttgtcctaatgaacactaagatagagcatcaccaacccatgggtcagatatggattctcaccatggattcagctatcagaaacagtagaagagatctttttagaacaccatctcacttataccttgatccaaaagctatttaacctccatagatgtgtcacattttcaaaagaatggtagcagagttttatgcagactatttctatacaactcagatatcagatattgttatatgaaggtaatgattattatattttaaacactttcagatgaaaacatcagttgcattcatgggaatgttcagagtcagagcatatatgaatttaaaataacagtcatctagctcctgttgtcataacaaagtcatgttacggtcactgatgcagttaccttgataaatctgtgaaggtgtttagaggattttatattcatgtaattttaaataaataagcatattaaagtggtgtttatctcactattatttttatttgaatttcgttatgttattattttgattcagtttaatcccaaattagaaatgttggtagcagattaagaggcacaaagtgggctgtcagtaaaacttttttgacagctgcatttatggaatgcttatcatgggcaccaggtaatgcatgcatttactcactgaatccccactgctaatgttatagccatttctactcagatgaggagactgagggtcagagaggttaggaagcctgttcagggtgacacaatacaaagtgtcataaattgggtttgtactcaaccactctgcttattaacatcagcagtatgttaatgggtgaacgattgttaagtgtcccaagaatgaatgcaaactactccagcttagaggaaatcatcaaacaacagaatatagtgtcaaaaaatgagacttaaaactaaacaaacacatcacatttgtttcatatatatatagtttcagaataggtcccctggaacactctcatcctatactaatggcatcaccatttctcaaagagttgtggagctatccttgggaactgattttagaatcaattaataagccactgtcttacacaatgtagcctaatggcttcatagtctcaccactcttcttctaaaattgaagtggggcctggcacagtggctcacacctgtaatcccaacattgaggtgggaggattgcttgacctcaggagtttgagaccagcctaggaaacatagtgagacctcatctctacaggggaaaaaaaaaaaaaatagccaggcaaggtagcacatgccctgtagtcccagctacttgggaggctgaggcagaagggtcacttgagcccaggaggtcaaggctatagtgagccaccattgtgccactgcacttcagcttgggtaacagagcaaggctctttctaaaaaaaggactgccctgactgcttatgtaccttccttcccaaacttggctctgaatgacatttggctgttaaaagtgtcaaattcatcctcaaatggtgaaaatgtgccaattgtcaaagtagttaaaaggtcctattgcaatttactttaatcaattccaaaaatgttttgagtaatgaaggcattattataaatgtgtaatccattaagttggaagatctgatgaggatcctattcatttggataaataagttatttaaaaagacccccaaaacaggcctcattcctttaaagtccatatgtgaaacttctgccttgctccacattctgtgctaggggatatatgggttgaaatagaaagtaaagtggatagttactgatgctttttttatcctagaaagttgtaaggttgacattgtctcttaaaaaaataataataataaaataaattaaaaaaaaattcccttgcactccaataaagttgttgttttctttttttctttgagatggagtttcactcttattgcccaggctggagtgtaatggcacggtttcagctcatgcaatctccgccttgtgggttcaagcaattctcctgcctcagcctcctgagtagctggattacaggcatgtgccaccacgcccagctaattttgtatttttagtaaagacggtttctccttgttgttcaggctggtctcgaactcctggcctcaggtgatctgtccaccttggtctcccaaagtgctgggattacaggtgtgagccactgcatccaacagagtctttatatggttgtggtggtgattgggggtggacaacagcgatttaccagaagtggaagagtaaaggatttaattgagaattggccttaggcaaagcttaaaagtcaaaacttggtctttcaaaaccccgttagatctccccagagcctctatttcctctcccaatgagctttgctcctcctccaatcatccttccatcccctgtatttcaatgcttgctgtcagaaaagtactagctaatggcagcttgccattatgtatatgaccaaccacttgtatttgcattagacaatgaaactttcagagaaggaaaaagcagactaagacatagaggaaagcttctatcctctgcacccactcttcttcatggagacttccaaaccaaaccatctctgacacttagagtggtagcaccttccttagatcgggaaagccaaatagcttagaagattacattaaatttactggtataatcaaaataatatatcacaagccatgaatatctgaagagacccttgaatttctggcattgtatctccatccagaaaagctaaaaaaaaaaactcccaatgaaaagcatccaattttaaaggaaatacctgaaattagtctagttcatgtccccaggaggcaaggacaccagagctgtggtatttcctaagcacttgaaaggccaacagtgacctcctcatgtaaatatctttatgataaactctcaggacagccatttttttttttcttacttaaagttccgggatacatgggcagaacatgcaggtttgttacataggtatacgtgtgccatggtggtttgctgcatctatcaacccatcatttgggttttaagacctgcatgcattagctgtttgtcctgatgctctccctctcctcatccccctacccccgacaggcccaggtatgtgttgttccccttaatagtgataaagtttacgcatgacaagaatgtaacattgatcaacattaacactgactaatgctggttcattaataacaaatatatttagttaacaagattaaaattaaagttttcttgtgcaatttggaatgaagagagggggaccctgacctagttttgtaactcaaataactttacccatccctaaaagtctatctaacccaaagaaaaatgacagacaacttataaaaacatcacttcagccttcagacatctgattgacaagattaaacatatccacatgactccactccactatgaagccatgttgtgggaggttattgaatcgtgggggcgattacccccatgctgttctgtgatagtgagtgagttctcacgagatctaatggtcttataaaaggcttctcccgctttgctcagcacttctccttgctgctgccatgtgaagaaggacgtgtttgcttccccttctgccataattgcaggtttcttaaggtcccctcagccatgctaaactgtgagtcaaataagcccgcttcctttataaatgacccagtctcaggtatgtctttattaacagtatgagaacagactaatataatgccatatttgactttctgtttctgagttgcttcacttaatagcctccagttccatctgtgttgtggcaaatgatttcgttctttttaatggctgagtagcgtatgtacacatacacacacacacacacacacacacacacatatgcacacgcacatgcacaccagattttccttatgcagtcatcctttgatggacatttaaattgattacatatattttattgtgaataatgttgcaataaacatacaagtgcaggtatctttttgctatcacaatttcttttcctttgggtagataccaagtagtgggattgctggattgaatgctagctctatttttagttctttgagaaatctccatagtgttttccatagaggttgtactaatttacattcccaccaacagtatgtaagcattcccttttctctgcatccttgccaacatctgttattttttgtatttttaatgatagaaagatatttctgattcctcaaaaggcactgtttttaaataggtttgagaagtccagttgagtcataaactggtgccatgtggtttcatgttgtcatgtgaaaatttgatgatctgcaagaactacatgcccatcagacagattcagggaaaagggggcaagcagacagaaataaaaaattccagcaatttaaaacttaaacaatgtatcaatgtttctttccacatagccctctatgtttatggagagagaggtcctcttcaagaggattcatcaacaatgaaagagtctttgaaacattgatcctgtcaggtcttgatcctatcgggtcttgactctctactcatgaatcttttctctctctactcagtggtggatttatttctagtaattcataaatggctcccagagtcaccaacttgttggaatttataatacacaccccaaaataaatcttaaacattctactatttaacatttttctgcatcaaatatattccttatctaaatatattgggtctacagagaatgttttttgaagacgtcaacttatgctggtttcctccttgcacacttagtcaatttatgaatttttaagacaagaaattttataatattagggtcttcttttacccaagataaaaaatgcttatttagaagaataagtttgtatgagttctaggaaggcacattgtcaggtaatagatataaggctggctctgtcttacatcagccaatttcatggagaacagaattgctgtccagtacaaatgaaatatgagtcaaagtctggacttgagtttgaatctaaagtagtttacttatctgagatggcttgcacagttggcacgatctataatggcattcatttcagagttgctcaaagtcggctttctatgtaaaagagaggcagagctatggctttttagctcttgctctaagattcagatctattaaattatttttattgagcgcctactacacacacagcagcagcactctgtcaatttcattgtaactcctggaaaagacatctctggtatgactcttgtccccggatctcctgtgggaataataatctttcacacttacttagttcctggagatgctgtgataattgacaagtgaatgtttgtgaagtacttgaaatcctcagatgaacctgttatgtaaacatggaagaatgctgcctttccaggtcacagccatagctggagcttctctaaacaaccaggttttcctggttggatgctacttgcctaagactgttattttgagatagctggtgtgtgctttattaatatgtatccctgactcttggcccagtggaagacaaagatatgatgaccaaattatattttacatgggctaaatatctcctaatctctcatttcttttgaatggagtgcctcaaatcttggtgatgattcattatacatttataaaaagagtgagagaaaaagaaaacttgctttttgactaacagatactcctcgtgttcaggaagattcttgcaaggatattaaaaccctcaaaataatagtctgcttagaagtaggttcacatataataaaagggagaaatttctcaagttctatcaaatttcaaaataatttaagaaatcatcacattaaaacaatgtattatcagattaaggatggtattgttataaccttttcaagtagttcaaacattagaaagctattcatatgaaggttttttaatggactcagtgaacatcttgcaaatttattttgtaagctgctgaaaatccctactagtttaacttgtcaacatacatctgaaattattagttcaacgacactttctacaaaatacaattttgtgtctcttgtaatgtgtgtcaacagttatctgtattaattagcactcatcagtcaggaactgagctcatttccagctattaatctgggaccagctcaacaaagactcccattatctaagcaagcccagctattggtccttcaatctaaatgtcatagttttctgggtaaagctttattcccacttgtttttttaatacctaaactattattgtcatggcttgcaatttaccaaaaagatcattttctgaagaaggcatgtagaaggcaaaacacaaattttacccaaagtagcttttagacattttcagtctgtgatatatattcaactgatttgagtcccatcaacttctctccaccctctacattcatttacataaaatctaagttattctgtaaacactttaggggcaaattaatactttaagaaattacctatacttattaataaagttaagaatagttattatttgtttggtaaaattttattttacagagttgtttttcttgaaaataattgagatactttttccacaacaagatttttatatgtagatatcaataaatttgttatatgtagattgatatcaataaatttcaccttattaatctagatacgtataatgtaaaaataggtagctagagatggagatagttcactgcatatataactacacatacacatactattagtagttactatcctttctgtttctcatttttcttcagtaaaattaattaataaacagcaaggttctctgtggccttcctaacagtgtttaaaatgaactctttagcaatattaaagagaacacaaacaatttaagtatgagtaaatgggacatatttcatgatatttatataaacatgaatgtctacctaccccagtgatgtgctggaagttgctcatacaagcttgtgagagctggatgttaaattttctggattttagaaaggaaatcaatacatcaaagatatatctactcttccatgtttattgcagcattattcacagtagccaaaatatagaatcaacctatgtgcccatcaatggatgaatggatttttttttaatttggtatatatacacaatggaatattattcagccataaaaataatgaaatcctgtcatttgcaacaacatggatggaactggaggccattatgttaagtgaaataagccagccacagaaagacaaatatcacatgctctcactcatatatcggagcaaaaaaaagtggatctcgtgaagatagagagtagattggtagttaccagagaccagagagggcagtggagagaaggagatgaaggggaaatatatatatatatatatataaatggcacttaatggtaaagatgttaaattttatatgtatactttacctcaataaaaaaaagataaaataattttttaggaattttatgagcccatttttaaacacacacgtcaaacaattatataaacataattaaataaattacattaaaaacaataaatactccagactcatcactctctaattattgtattgcctatgttcttgggattatatattatctctacatgatgaaatattatatcatagagagctaccattacagacttcttcccaacttcacagtcagtgacatctctttttaaagcttacaatagcagaagtatttataccatggaaaatggcaaatgctgtgcattagcatttatttttcctggagaattgattattaaataattagtagcacaccaccaatttatcctagcaaaattcttaggtaaataattatgttgatcctttatatcaatttatccctccctcctgatagactttagtcaaagcgaagaaagtacatcttatgtccccttcttccaatagacagttatccaatagacagttgaataagacatatgtatttctcttaaattctgtaaaaagtgctttgagattttgtgattctaagccctctttctaaatttgaacttcaggtgggatcctagacaatactgaacatttctttccttttgggaggctgcgggggagacagtatctccttctgttgcccaggctggattgcggtggtgccatcgcagctcactgaaactgtcgcctcccagcttcaagcaattctcctgtctcaaccacccgagaagctgggactacaggcacgtgccactacgcctggctaatttttgtgttgttattagagacaggatttcgccatgttggccaaagtggtctcgaactcctggcctcaagtaatctgcccacctctttttgaatgtaggccagcaaataatttttgttttgcacccttctgtggggcagccctggctgatgtgcagccatgttgagtgattgtcctgcatccaacagcaggaatgaagcttaacaggcactgaagggaagtgaagcaaccctggggaaggagaggattcagtataaatgtaacacaccaaagtaattcatcagtagtaccctttccaacaatagcccaagtctttacagttccatttccattcatttttattttgtagcaaattatcatgtttcttataaacatttagagaaatgtatagttggattattattatgcacactgaaacttaaaggtatatttatgactttctgcacacctcctaggtggaataaatatgccattttttgtaaaccacttctaacagggaccatgacagaccaaatcatgccagtgccctactctgtagtgaagtatctgtgcaatgaggttacaatgacctaataaacggatataccatgagaacgcttaagaacctgcatgcaacattacctttgagatttaaatgagttcttctctgaaaatataatgcagatctttccaacttagtagaaaagcatgcttttagtttgcttagtagaaaagtagtaacattagaaaaggggggaaatagatgtatgaatataaataaatttttttttaaaatttggttgtattgaactttcaaattagccaactaatggtacatataaaataattataatcacactttacttagacagcattaaatatgggatgatcagagtattatctgtgatcgcaaaactgttaacagattatgtagctttattagaaaaaaaatttctttttactattaatatgtgttcatttatgtaaaaaattcaatattactatgaaattctgctgaaatttttaaaaataatccaaaaaagtttacgatgtctatcattaagtcttaaaagagagaataagtgtgaggatatgttaaaggattcttttattatacttcagtcctttgaggcattgtgctttctattcatcttttttataatgtcaaaacatgaaaaaatcatatctaaatgacttgttaaggagttagtaacaacctctctctttctttgtacacacacacacacacacacacacacacaccatggtttgtgtgtgtgtgtgtgtgtgtgtgtgcgtgcgtagattagagcaagcagattaactttataacgctggttgagaagtgtcatttatgagttcacaattttccaattctaattacatagccttgtggaaggaaagacataattatcatttctagtgtccctggcctcactgagcaaatggctcttgatattgacattttgtaccatggataatgatactttcccttcatttagtggaacaagaagtgctatacaagcactcactcatcaatgaccattgttttatcatcaattatcacacattagaaaagaaacagcaccaagcctcacccaatataaattattatgttctcaccaagcctcaccagtattaaacattcaaatttagttcaggctttggataggaagataagaaactatgccatggtggaccaaatttttttaaaccagttctagcattttaaacacgataaattaaaactatttgaaatttaaacgtttatatctaaggaacatgaaagccctggctaaaattaactagatacttaaaaaaaaaaaagttcatcatctagttacactaaatacattattttactaaaatgctaggttaaaagaaggaattattaaaataaatggcaatacaaataaagaaaggtactttgtgtttttgtctatatcagtatgcatacatacatgcacaaaaaataacttaagcaaaagtaagtagatcttaattttatacaccacagtccattatatttgtagacaaagctagaatacaaaaattttattgtttggtcaagtatttttatttatactgacaagacaccaaggaaatgatgttcatatggtttaatgtagtttggaaaggcactcgtgaaattttggctaatattagacttgggggagaaagcactattatggaaaccaagggcttggaagtaaatggtctatgagtcagaagcatattatgctgtagaaataatgagtgctaccagctgagatataaaattcaccatgcagatttcaccctccggtatagagattttaaattagattttagctaaaggcctattttctgaaaatcttaactaaaattgttgcctgaaatttgtcagtatatctgaatttatcttaagacttaattaaccaagaagttgaatatgggatcctgtataaaaccattgtaattcacatccatacctctcaaaagaagcaaaaatgagaagttttgtttcctatgaattgaggaaagtatacactcttactgtgtaaattttgaatgaacattttaaaatatctttattaggcacagctgcatacaaatggtatttctattttggctctgttagcaattctgttgtttctatcattgactttttccatctttcttcaagcattctggaaagagtccttctaagaaatcaacacacataaaactggtttagattacagcctacctggcatgtatttctttgctcaattttttcattgcagtaatcttgaagttgacaatgacataagcctcttaccttaaaaggttcaaagattccctacatgaattttagtttcttagataagagtttttttttcataattggaaaatgtataatttgataagaatttaataataaaataggccaataattttaccaaatccttgatagcaatatatatgtatgtatacatacacacacacacacacacacatatatacacacacacacacacacacacacgtgtgtgtatttaaataaagatgctttccagcagggtagacaagttgggcaaaggaaatatggtatgagctctttcctttatgactcctctgccccattgaatccttataaaaatattagactagtgatggaaatttgtcaacagttacagaataagaaaatacgttaaatctgaatatatggtactgaatacggctaataattctttaaaaaattatctaatgacaaagaaatatttgtgcattaattaaaattgattgatgaaagtgcccaggatctagaccgttgcattgtggaggtccccatgtccagcagatctactccatggccaactctggtgatgtagctgcacacaccccaggttgtgctacggtagaagaaccccagaccctgcccctcccccgtggggctggagatgcagaatgctggggatatgcctgagggttatggactcacatgcttaagcagaacaaagaagtacatatcaggcccagaataggggaagatactctgtcacaaagtggcaagcccagcacaggctgtgaaggctcttaactcccactagggaaatatcacaggcccatagcactcatgcggccatgcaggggccaacaatctgtgcatgactgcctttcccaacagaaagatatatgactagaagaaaaaaaggactattcaaactattcttaataaacttttttcaaagaaataaagcacttattctctaggtttctaatgttttaagttacagtatactaaacaaatcttcattttattcttttttttcatttccctaggcatttataactggcaatgagagaatttttaatgtttatattaaaaaattttaaaggacacagatcaatcataattttttccattgattattaagatcactttgcacagtttcaattttcaggcattttcatggtcccattttactgtgcaaagactgactatatgcttctaatgtcggtatattttacaggaagggcagtttacatacaaaacaagtttacaggatgaagccttttcaattgcctcagtaatgaccttgatattctgtctttgtgattaagcataaaactaaaagaccttagaatgtaagtgagcatctatccagtgaaataatttgtgttttttgcatatttacaagtcagggaagacaaaacaatggcagctttgttgacccagtatgttgatttgtgacctgaaatactggaaattttctcagtagatgttacatcacatactgattattagcagttatttactgatagctcaatacgtatgcaagagaggagacacaagtgcatggcatggaccctactctcaaagagttcacagttgaattgaagaataaaagtatgttcactaatttacacagtaaacatttcttgaatgcctactatgtgctgggcattgggcaaactcttggtattcatgagaaagcaaaatgcacaaataactctgcctcatagaacttgcattcctcaatagtgagtaagaaaaatatatttgagtgaaaaatggtgtagaacaaaaaggagaacaaatagggcttaagaggttgcgagaagtcattagagaaagcagaatttgagctgaatcatagctagtagaactatatatggagtacaccttagaataaacttattctaaatttttcccatggcatttaactttaaaatacatttttgctttgaaaaaattcatttataaatatagagaaaaatttcacagatgctgagctatgctttaaaattgtttctatatttctatgaaaatatatgtgtggcatgtctctacatccatagaaatttatttcaaaagttcgtttgcatttgcacgctgagatcagatgttcctgtgtttctgtcacttcatactcttttttccaagaaaagagactgttttgctgacacatataaatttttggaggattagaccattttcctattgtggaacatgtatacatatttatatatatttatatttttccaatataaatattggaaaacatttttctgaaaatagtaaccttcgaaatgtgattttttttaacattgttgctctccaaccctcatatttatattttcagtttagtacattttttctttatatttaatttttccattattttattttaaacattctggttttatatcccgtttatttgtctttctaagaataactttcttatatatagcattctctgttgtctaacgcttccattccaagatgttctccagttctgtatcttgattgtggtggtggttataaatctatgcatgtaataaaatttcataaaattatgcacacacattcaaaagagcataaaaactggtgaaatttaattaatatctatagtttagttaatttcattgtgtcaatgctggtttcttggttttgatgaagtgttatagttatgtaagatgttgccatggcagaagctggatgaaatctacacagaagctttcgatgctagttttgcaatttttacgagtctatacatatttcaaaataaaaagttttttaagaatattctctagttttcatccttattcagattagacctgtttatgccatataaatgtaaaggctttatatactcaaagagcatataacttcctctttcaaaaactccaaggctctctgatatgacacagacagttttattataatagagttgtattataatatttgaagttttattataatagagttctataataataaacttttccttttaactacatatgcctattccataatgccttgagaaaaaattccagtcaatggcattgaacacatctattgatagaaattatatttttttaagcatgggtggcaaaagttatttaatgaatcatcttccaatgtgcagaaatagttgacaaataatgtacccttgttttccccatatttttcgtatttttttcaatttgcctatatcatacatcactttttccaatatatgattttatctttgcttctcctaaaatgccatttctctatttttctcaaatttaactctgtattttttcttgtgtcttgtgcctgcttccctcacttattccagactttttttttcttttggagccagggtctcactctgtctgtcgcccaggctgaagtgcagtggagcaatcacagctcatggcagcctcgacctccccaggctcaggtgatccttccatttcagcctcccagatagctgggactacaggcatgcaccaccactccgggataattttttcatgtgtgtatttttagtagagacagggttttgccctgtttctcaggctggtctctaactcctgggctcaagtgatctgcctgccttggccttccaaaatgctaggattacaggtgtgagccactgtgcctgacctgttcctgatttttaaatacctggttgtcctcttcttttgtcatttctttattattatgtaatcctattcaccaaaaaaaaaaaagctttttccccttttgttgtctccatcctcaaaaagtgattattgatctcttctttatgtaagatactaggcaggaccccaaagggaagacaatgccctctcctgaaaagccaaggcccagtgaagagatgagagacaggtccaatgaaacaaatacaaatggtatgaataaaaatacaaatgatgtgaggctcctgatgctaagtgtcacaagcacgatgacacttctccagccctatttccatttctactctaaattaattttgtcttcttttgaagtctcacctgcaaggtagcagaccgtaaaaaatacctaaccctctgaactacttaaactctattccaattcggttatttcaacaggaccttttcaacatgctcagtctttcttggtggcggaaagattttaaagccctagaatacaggaattggagtcgtgacttcaccctttattaagtgtgtggctttggcttacttaatctttcctaggcttcagtttcctcatctgtaaaataatgggagtaatgatatagaaatgttctgaggattctgtgagacaattcgtggaaaacacttagtaacataccaaaaaattagtcagcacagtgtatattatttttcttctttttttaattatcaaggtcagtgacttttagagaatcaatgtattcattttctactacaagaactttaatcaatagtatctattttccttgtaaaaatctgttccagagatactttccccttccaaagcattactgtatttcatacactttgaggtatgaatataactcctatgatctttatttctgtttattcttggtcttaatgtattcctggctcatcactgtccttttaaggcatgtgtgtgtgtgtgtgtatgtgtgtgtgtgtgtgtgtatgttttaggggaatagaggaagggaaaggaaaagaagtcagactctactctgagtagttttccctttgattgttatgttttgtccatttcatagacattagtaattatatatacaatattagaagctttatctgaagtgttctgtggatattagggttgagagctcatattttttaagatagcaatgtaagtattgctatccagtcctctaaaatattcccagactgataggattagaagagtggccaccaggcaatttgaaacccttcaaggacgtgatgagaatgaagaagtccagccaaacagggaaacagcatgtgcctcatgaattttcttttttgttaataatgactcaagaagaaaacaggtggttgtaactatgcagaccaagcagcaaaattccaaatacagaaaataaacctcagagattcctttaaaggattatttaaacacaaacaaattcctaggggacagtaacaaaattgaaatatgtagaagaaagaccagtgtggtgtgtatggaattagagaatgagttgtgagtgtgaccctcagaatcccgggagcacataggcttccagagatgaaatggccaaagaaagaattcaccagaatgtccctaagtaaaggtctccagaaaaaagtttccttggaaattcagttcagattcctcctgaccttctgcaaaagattctccttagtgtgtgtctggatatcttcctcagaaatgacttgattgtaaacagagagaaaaggaaattaatggagcttaagctttagggcctctcacttgagcttcatgggaccctgtaccaaattgtctgttgtaattttgaattcttcttctggagaaggctcccaaaatgatatatgtttcgggccccataaaacctggatacatatgtaactaacctgcacaatgtgcacatgtaccctaaaacttaaagtataataaaaaaaaaaaacctggatccacccccagctgtcaagtataaaaactcctttaaaccaactagagtaagtcatctctcctgaggtctctagctttttctttctacccttctcactgtgtctgctcctttttcctgccctctgccagttttctcagcctactcatgacttcccggccctactaaatctttagtacatgtggttctggctggcagtggtgctaagtctggctcagactctatgtgaactttcaaaccaaactcccacaggcaagttaactgactcctgtccttctgccccaattccaaattccttggagagggacctgtctgtctagcacaagctggttgtcacctggatccagtcagctgtagctgggctaactggggagggtcctgtcatgggcccatagaactgcttcttggaaagtgagaggggaaattctctaaggaggagtaagtgaggaggccataaatgtcatgtctactgtatttaaaaaggaagttgactaagtgttttcaatctgccaaagatacactaagagctgaagagggaggggcactagcaaataacttgcttcctcattatgattcccgtagtgttccaaagccactgctttcctgctgtctctttttttagtactttttaaatccctcagtaagttgctttcaaaagattttttctaattaacagaatatgtcataagctcattctagtattctaccacccttataatcaagttttgtccagtgagtccattaggctaggggaaaaaacctagccaatgtcttcctacttttttatttatttatttatttttgagacagggtctcgctctgtcacctaggctggagtccagtggtgcaatattggctcattgcagcctcaacctcctgagctcaagcaatcctcccacctcaccctcccgaataactgggactacaggcactcagcaccatgcctggctaagtttttaattttttgtacagatgaagtctcactgtgttgcccagattcatcttgaactcctggactcaagcaatccttctgcctcatcatcccaaagtgcaggaattataggtacaaaccactgcaccgggccaccaatgtcttttaaatatctaaaaatttataattgtttgtttttctccttgcactgttattcataggaatgttgccaaaaaagagaaattgtattattttccagagaaaataggctaaaaactggaagcagcttatggcagactaaatgactcagttgctactgtgtgtataaacgtaccctgtaaagtgtagaggatgcatttctcagcaacaggtgtgccttaaatgtgttagatgggaacataggaaaagtatggccccaggcttctaggaaaaaaacagccttttcctgcccatactaaatagccacttagagactagagtttttccagacccttacatgttaatcctttttaacaagttaccagatagctgaacacaaactgggtcaagcaagtctgtttctcagaaggcaagatgtcccatcctaacaccataaatcacactcactttagaaatacgtttttctttgatccaaatgtcttttcttaataactcattcctaagatttccattttcagattcctgtttttgcataagattgcatgaaatattttttgccattacacacagtgcattttattgaaaggactctaaagggcttagggaaaggaaaatttccctaaactgcaaagaaagtcagctaatcattctgaaacataataaaaactagtttttaaaaatagctcatgataggtaatggggagtaggtagacccaaacaagattggtcagtttctacctggacaataaagtaaggcattaatttccttcagatataggtatttctgtagcagatattttttagaatttttttaaaagttgtgtaagggtgttttatttatcagaaaaaataaatgtattttgaactgtttgaaatgtaatccaaaaattacagctgaaaacatcaattatttaaatttatgttacacaaataattgtaagtcttgtgtactggaagtaaacaataaaagtatgaattttcttttgaccacccctttcccctaccaggggaataatggctccatggcagaggcagtttgtacctcagtccatatacatccccttcttattggcattgcagagggattgcagcctccccgcggcaagtagctcaataaccaaatattgaaactgtctgagtctgtaccctgctgcccatgtcataaattcttgtatcttaaggtatcaattttttatatgctttacttttacttatgctttttattcctatgccctttcccttgtactctacacctacctgaaatgcagcatgcatgccagccatgcctatatcccatgaacactacctccaatgctacctgactctctacccttccacttttctttttattatcattaaagtaataatgggccattagtactactcaagacacaaagccaaggagtttacaaaaactaaattactaagtactgtcctagcagccttcctaacttaatgccagttccaaaacggcaaactctttgcccagaagcaatgtttgttcactgagaaaatctgggtcagtacatggccttagttaagccacttgttttttctttatctcattttcccccactgtggaattagcctggttattggcaaaacactctgatatttttattaaatattaaaatgttagcagtagccaaagcttgagtgaatttgattttatgaagccatgcagaattatttggagatgctagtttctctcaataataacatcactacataatttaatttcatacacacacacacagggtcctaaaagtcttagcacaattttaggcttgactaatttagaaatataagtgctacaaacttaaaaaaaaaactccacataatttgaaagtttaactagacttctttctcatttgtttacttttgtgaattttgaataataaaattttagttttgattgtttttgtttaaacatttgctactttcagtcagaaaaactgacatgtatttcaaggatatgggaaaactagcattgtaagaattacagagctcttcacatctgagtcaatatttgtacattgctttaaatatagttcatgtctttcatccaggaaacacttgttgagaaccttctacctgtaaggcctacattacatcagttacatttcttcatttaatccttactgcatctttggagttagatatcataatcctcacttggaaaatgaggaacttgaagtctaaaggagtgaagtgactttaccatgatacttagaaattgtatgtggaaatcaggacctcaatccaaaatcctccaggtctgcatctcaagttctttccacactcttgcattatcactctccttgttgatgttctgcgtatagactctatttcattcaagtgtggatatatctaaaagtcctcatgaaaatgtatattgaaaggcagtctgggccaaaatacagaaaattcataaaccaagtacctcatagatataatctcctttatccagcataattaaaggaactaagcagaattagtggattcactacagaatatcgaacctatctcaggtcatataatggtcctgtcaccattcttctctctgtaagattcagtgcattatctctttgacaggctaatccctaggatgagctcttttgatcataagggatcctgaacaggatgttttgccatccagaaaaccagcaccactgagacgccagctggagacatgtcacgaaaacttggccctaattccaaagccaacagtgtgttgaaattagggcatatcatttgcttagttcctgactgcatactttacaactgacaactgaagattactaataatgtcttctactcatgtgtacccctcatccaggaggaatccaagtcattttatcagtgtgtagcagccatttaagtctctgattatagagtgcttttaagtcctcagaatctttattgtggagcagcgcttttctgcagagaaggattctccattaaagatctaaaccttataagcacttcctggaaccatactgcctgtgtcaacttgcctggtagacagacaaacattttattgaacatatactatatcttgagagctttacattatgtaatctcaattaaccccacagtactttcaaaatagctgttattaaacccattttttaaacaggaatactaagacttaagtaaaagtaaaatagataacttgcccagaggtcacataatataaaatagcagaggcaaggttgaaatcatgtttgtctgattctggagtcttcatgtttgcaactttattatgtcccctcagaatttccccatcatgcttattctagtttcctccgccatctccctttttttttttttttttttttgaaacggtctcactctggttgcccaggctgaagtgcagcggtgtgatctcggcccactgcagcctcaacctcccaggctcaggtgatcctctgacctcagcttcctaagtagttgggactacagatgcacaccaccatgcctggctaattttttgtatttagtagagatgggggtttcacaatgttgcccaggctggtctcaaactcctaaactcaagcaatccactcacctccacctcccaaagtactgtgattacagacatgagcgactgcatctggcccagccatctccatctttatcctcctttataagaatcttaggcttatccaaacaagctaaaagagatgatacagttgtgcgtttatagttagacacatagatctgtctccaaaccacacttaagtcaaaccctttagttcatttcagtccctgctatacatccacatcaacaattagttaatttaaaagcatgaaaacagtttcagaatttagactgtgacctaatctaaccatattgcctaaggaccttgaacctcataacctccgtcattaacattctcaacaccattaaagatgtaattagaatatctcctttaatttggaaaactacatgaacttcttaattttaaccacctcccctttatctgcatgagctcaaattatttgctggcaaaatgtatttaatttttttttctgtcaagcccttatgaatttaattgattaagctctgtcactgccacaactgatataggcatatattggatatttgagaggctcacctattagtttaatagttcagtgataagtatatgtgtatacatagaattgaaggaagatagtttgaaattatgtatgggaatcagcatttgctctatggaaggaaataagttactgaattgtaatctaactaaatatatcacaaaaaatttgcttagcttttgctttctcagagtttctcacagttttctttatactcctctttaaaaaagtaattgtaagaaaatactttggttttgtttaatttgagaattatttaagttagaatacttgatacctgaagctcagagtctctcttgccagcctgttaacaactttctttggtcttaaggtgccttaaaagaaacacagaatgttgtagaacaaggagaattataaatccacattggtgaaaccaacctgcattagtgctgtgtgtgtttagggcatacttgaagaaaaatacagataaatggaagcatattccaaacagagccaacaagaaggagaagggatttttaaaacttcacaaagaggtatagttgaaggaactcaagatgtttaacccaaagaaaagaaattgcagaggtaatagagcagctgtttccaaataactggagattctggctgagtatggtggctcatgcctgtaatcccaacactttgggaggctgaggtgggagggtcacttgaggacaggagttaaagaccagcctgagcaacatggcaaaaccccttctcttaaaaaaaaaaaattaaccaagtacagtgggacatgcctgtggtcctagctactgggaaggtcgaggcaggaggattgcttgagcctcaacacacaagacttcagagaggtatgatcagccactgcactccaggctgggcaagagtgagactctaaaaataatactaataatactaatactactactactactactactaataataataataataattggagagtcttgtggtggaaaagcaatttagacctgttatttgagattccaaggaacagaccagggccaatccgtcagtcacatagagttacatggactgcatgtaacttcatgggagtcctccaccaggacttccagacaaggaggtaaatgtgggctgaaattttgccatgctcctatggccaagcactgtggcttggattaggctgtggtatgcagagtttcttttaaaaaaattgatctgtttagaagagatgcctttttgtaatgtgcccaaaagcactgtgtgtgttatgtagactctgatttcatgttcacagaattaaaacatttctaattagtcatttcttttcatgagataaaatcagcttcctcaaaaactagtggccttttgggtctctaagccccaagaaattggatgacgacttaatagaaatttcattctaatcatgatacacacaggcctattaaccagagggagtctgggagtggcccagacctgagcctcaattctggcactggcagtggttgttcaaagagtggacctagctgcaatggaaggaaatgaattcaggagactgccatattgcattcagtgagtgttatgattggcaaccggtgactctgcagttgcagctggcatcaagaaccaggcaaaggtgacagtcaggtagagcacaatcatgggaaagagagcaaccagtaagctctatgaacagagctaaatggatggcagtctacatggtagctgagctcccataacgagatggtgttctgaggagatctgcggaaggtgaggcagcccccacttcctaaggaaggtaatgaaaatagggattcaagtacaagaaacaaggttgagggactggggataaagtggggatggttaatgggtacaaaaatatagagatagaatgaataaggtctagtatttcacagcacaacagaacaataatttactgtaaacttaaagataactattataaaagagtgggactgtaatgttcctaacacaaagaaatgataaatgcttgagataatggatacccaattaccctgatttgattattacacattgtatgcctgtatcaaaacatcacctgtaccccacaaatatatacacatattatatgtgcccataataatttttaaaaattaaaaagaaagaaacaatgtcaagagccactttctggtcaagacttagtctctgataagagaaaaacacccaataagaattagtgcttacctatagtgcaggatttgtgatgaggctgtctccccagttgtcaaaccggaattccttctatcccggacatgtggggatctgagcttggggccgatggacactacaggcgagggtcattgacttacttgagagcaggaaaccaggcgatttggaaaatgaaaatattaggttagcatttagacaaaatggtcctttaggtatgttctaacccttacatattctgattctgtagtaatagatggacttttttgaactttagtttttccattttctcatttactttggttaaatacatgagtgtcttttcccctgtaggcttcctcgctcatctttgacaagcatcgcctttgtaaagacagaacattttgacacagcctttttgatattcagtcacgtcaagatgtaaaaatgtttttacattgaaaaggatgaaacttttgctttgttaaagaagtactttttaatgacaaaaaaaaatgggggtggtgttttcgagtaatgtgcctaagggatgttttcactcctatgccttccttcaggatattccccacagggggagcgaggcccagtgtcgggtcaaagctggacatggggtgcaccacaacttcagggcagcccacaaagccagggtgcgatgagggtcaaagagaatttggataatttttgtgcaaagaacttggtatttaaagaagttaaaaatataatggtttgctctttaaggcatatcaaaatattcccttgccaaaattgctgcattgaaaagtccacaccactaaaatggccctgtcaaaatttcacctgcacatgctcatactgtaaagtacagctatttctgaagtgctggtgttttgattattattctgtttgactattatttaaaaatgttaaaatttagaatcatggtataattattacattgtataatcagatacctggatttttgtcatgactgcaatgacatcaggataaataaccctgctccttggctccttggctccttgggtgatgtatttgtcttttgtcttttgggttttttgttttgttttgttttgttttggagacaagctctctctctgtcacctaggctggagtgcagtggcatgatctgcagctcactgcagcctcaacctcccaggctcagatgatcttcccacctcagcctcttgagtagctgaggctaatttttgtatttttttgtagacatggggtttcgccatgttgtccaggctgctctcggactcctgggatcaaatgatcggcctgcctcagcctctgaaagtgctggaattacaagtgtgagccactgcacccagccgggtggcatattttatgtctcttccatactgatgtgccctataatcttggctaaaaaaaatacaataaattcggcatctttattaaatagcatccaaatacttaaagccactcattttttaaactgttttattataatctgattgttctaaaaaattacttatttgaatgcctatattatttatttgaatgcccctatacctaacatgtaaccaggtagaaattttaattatacagtgtactaataatccagtaatgcagatttcttatgtatgtcatcatgataactataatttatactatatatgtggtacataggcttttaaaagtcaaatattcactagaagaggatgatggttatttctctgctgcttcagttttcttgtgttaaatttttcctttcatgttttaaccatttgggactaaaatcttgaaaagaataggttttttagcttccaggtagataccctgagaatacacacacataggtccaggattggagtgactgatgcttttcatacagtaatagtccctgttgagcatcctctatgccccagtcctgcgtactctgcccactgcctcaatattatcaccacgagcttttgagaaaagaacaagcatcctcattttatagaagactgaaccaaaagaggtcttcttcattaaattattttttttagtttggaagaagagatcatttaaatatatatcactgttatggtttgacttttaattttttggttcaccatgtgacatattctgattttgattctgcaaaacctagtaggaaattctgggaaacaaatgaagtagattgctagtttttcccttctcttgttattttctactctttgtaatgcatttacatattaatgtagtaaatgctgtgatgatatggctgccaactctttcatcatttaatctgttaaataaacaaacgtgctttggaatcaatcactaaagaaatagctactcactaaagttagagatttattttactttgagtataataactcgcttgtagttgtaacaagcaaacttaaaccaaaatattctaaattatacttgtcatattaatccaaaaagaacaatatttaacctaaatgtaaactaaaagccaacatgttgatccactaattacagaataataaaagccagactaaaatcaaagaaactgccccaggttccttgtaatgtactctgactctgtacataaagttacctctcccaccttctcccacccctctgagtattagtccaaggatacatctctccatctatcaaaatctgagattgagcaggcattcatctgtaacctcatattttttcctcagacagatcgttgaaaagataaatgttctaactgggagaaatggagaaaattttgctctttcctccctcttccaggataggaggcttccctaaagaacaagaaacaaaaacaaagaaagaaagagcagcaaaacaaataaacaaacctaggtgtccaggaaattatgcatgtttcttgacagagtttcttcagtctttgaaatggacagatggatgaatagatggaagagaaaatgattttatgtaatagctttatccaaacatgttcacatgtacctctctcccttccctttacttcctaaagaagtgcttttagcatgtgtctgagtcatgacctaatgtaatatgtgttgttattaacctgctgacatttttaaattctaattttaagttaaatcaatcatagtgatctctgttataatgtcacttttgctaatttgccttccagtatatttgtcataagagcataaggaggtctactctgtagaaaatggaccaacaagggtgtgttgcacatgaggacgtggtttgtcttgtgagtctcagcaaaaaacaaaatgttaggacctactgctctgaaatagcaatcatggctggtacttgctgaataatttctaaatgccagaaattgtttcaagatctttacatggattatttcatttaaacctctcaaaagctctgttaggcaggtatcgttattcctattttataccctaatgtgcttaagtaattcagccaaggtcacacaactggtaattcttagagccaggatttgaacccagaccatccagcacaggcctacactttgctgatttacaacgaggaaaaattttcatttcgcgaattgtacaaaaatagggggatctacattcaaagcaacttcattattcaatgaagagtattgttcaatactctcccatctctggagagtattcaaattatgaatactgtcaaccaaaaaaccttgaaattgatgtccgtattttacattaaattatttttatagagaattcattcatacagatattggagaacctaaacaatccctgtgaactttccagatagctcttctactaaaaatcagaaagctatgcatgatttttctgctctaaaagtgtccagaaatgagagtgctcacatttttgtagcggcccactaaagcattttatacacttagagaatctcctttcttttaaatctaagccttcctaggattaatatatcttgcattttcttttcaatcaatgagattttgttttcattctctataaatactttatattcagataatttttctaatcacctcttctctctgttattaatattgctgaagctaaaataaaatgtaccaattgaatatgatatttgagtttaatgtttttatttgtatttacttattggaatgagacatgctcttcaccttgggtaatttaaaaaccattattatagtttaaggttctgtgttacatctgtcgccaatatggtgtgcccttcctgaagtatactatcaattttgtaaaacaacctcaaatcccagtaagtaaagcagttctgcaggtacttgtacaatctgggtgagattttatttgaccccatcaaaaatctttctctaatacaatcctccaaccttttatggacaggaaaagaacagaaatgcttacatgatatttctgcttccagatatcagatgtgatttattactgagtaaggcaactggcacaatggctttaactggcttagaagagcctaactgtactttctccttaatcatgttagtggcaatcttagtatttaattacatttccagagcatctcaataggagtagtgtttttcgtacattaaaaataatctagaaaaaactgttttcttgtttcccagacaaatgagatgagctagtttctcagaccagaaacattctaagataataatttaatatatatgcttatattttaaaattcttctcttatgtgcatataaacgtatatcttttgcaaaactttaatgacagtcagcaagtatgttgataattacgagttgagaaaaggctgtataaaccattacactcagtgatatataaactctggaatgtatttttgattaaagctcctcactttacttagatataagtaaagatttatatctttacttgtattttatttatatttatatttctaaaatccagctgatattatatttaatgttttaattatgatatcctttaagcattaaaaaccatagtttttaagctaaatgagaatgcccttctcaaacctgaaaggacaaatatttttgtcctttgccatattgagagtaggaaaataaaggaatatcagggttttagttttctggaaaatacattatgaataattttacctaattagataagctagacatggttatgtataatttcttagaaaaattttacaaagtgaattcattcatctacctagaagagataaatatgcactaaatttcttagatcagataaggtaacaaagttgtagaaatggggataaatagagtttgggacctggatggtctatctacataaatatttattgcaaatggtttaacaatcatacaatgagattttgcaggaaaatttattttcactttaatcactgaaataactaagaccaaaacagaaaaacctattattcctcaaatccaatgggaagaattaatgagaagaaaaagagccaaaaggccttttgtcaaataaataatgataccataaataataataataacagctacattttactgagtgcctgccataaacctggcactgtgcttggtacctaacattgtcctcattcctcacagcacacaagaaactgagtgtcacactctacttgaagggcagaacaagatttcggtccctagcccatgtgcttcattgagttacacacttctctgaaatacttgtatttaaaagtaagcacaaaagcgtaaaatgattacatctgtacaaaatggaaaaacacatttctcaaaaacatatagcagggtttatattgtagccaattattattttctttaaataacattgtacacattttttccaataatgttaccgttaatgaaaatactttggggatgtggttctggaattgcctgaaaatcctacagcatattccctttgattgtctaaactggtggactatatttgtctggggagattgatttcatttttaaaagcagcctgaaggcatttaaaaccttgttttatgcataaagtgatgattaaagtagttaatacaatattgctcaaaactcttttacagaaagtccattatgacaacctcatcacagtgaactcagccacagccacacaatcccttggctttgttttatgcagaatctctcagatgcatcattattcctctatagcgatcaatttaattgagcattttatccaataatatgaattctccaagaatgtcatttgtatcacaggaataaatcaacattcatttcacttagattttcacaagtaaacttttctccatgttggagtttccagtgcagactctaattgtttatttccaggttttattggaaacaacatatttcatcaccagttaccagttttctcagatacacattattttgtcgaaagaacacaacaaatgtcaagttgtcactgtttgttaatcagtcataatgtgtgaaacatcttggcagaaacttctttcattcttgctttgttttaaatgaaaatgttttgttatgtaattttaattactcaatcatcatcttcccagtaaatctattttttagtagcccaaatctatgtccatttcactatttctattggtcccttgggttcttcatgtatttttatttgaatttttgcatcagaaatattaattgaaataaatttaacatataatgaataatattatcatcactaatgtacctgctatcaataaacaaatattaattttttgttatgattattttagtgttttgaaaaatatttcaggtaaaatttcatgtgctatcttcccttcctcagtttacatttctatatttttattactgtttacatggtaacccatatatataatgtatagagttgtttgtgttacttttcttttttatagaaattatgtcacatgatataatattttctgtaattgctttttcacttaacctagtcaattggctttttggtatcttaggggagatgtctttttaatacagaaaacaacatttatagttagttatttgtctctaaattattatcctgtttaaaagagttttaattataaagcctagtttttcataagattttagagtaaatttacaaatttaaaaccagtaatttcgtggataaattaatatatcagctttaattattcttgaattaatattccattggtttatgcatttaatagggttaaaattccctatatatttgaaaatatctaaagaaaaattaagcaagctctcttaaacatttttaatgaaaaccacaaattggatatatctgtttctagcacttcaaacacccaggaagcagactctcaaatactcataaaaacaataaaatcttcctaagcactcaaacactgcttgtaaacaataagcctaagtggatagttctaataaatcagattgccttgagcatctaaatattgatttaaaattaaggtaaatctttttaagtatttcaattaaaatctcatcttttatgtcagattcctttaaatgcctctctttaaaaagcagatagcacaagttaaaattaacaaaaaagatataaatcattattacacttggatttcatacaaaagtattatactaagcatttgtttcatgtctttttccatctccatcatgtgtcatactatcaagagttaaaattgtttatcacagaagcaaaataaccatctcaaactggctgtttagttagagatcaagtttacagagtacagaattaggaccttggtatgtttgcagatttggattatggcgagagatttgagactaaaacacaggaacctgagtgtactttcttacatggcagagccagtgatcactgggatgggaccttcctcacactaccatctgctgcggtgtcaagtagtcttttgcagagaaatggtttttcatggtctgtcccgtatgcatcccttaattatcactctcacccatttttttttaattttgttttactttaatttctgggatacatgtacagaatgtgcaggtttgttacataggtatacatgtgccatggtgttttgctgcacctatcaacctgtcatctaggttttaagccccgcatgcattaggcatttgtcctaatgctatccctctccttgccccgacccccccgacaggccctggtgtgtgttgttcccttccctgtgtccatgtgttctcattgttcaactcccacttatgaaggagaacatgtagtatttggttttctgttcctgtgttagtttgctgaggataatagcttccagcttcatccatgtccctgcaaaggacaagatctcactctattttatggctgcatagtatctcatggtgtatatgtaccacatttttttttatccagtctatcattgatgggcatttgggttggttccatgtctttgctattgtaaatagtgctgcaataaacatacatgtgcatgtatctttatagtagaatgttttataatcctttgggtatatacccagtaatgggattgctgggtcaaatgttatttctggttctagatccttgaagaattgccacactgtcttccacaatagttgaactaatttacactcccaccaacagtgtaaaagcgttcctatttctccacatcctctccagcatctgttgtttcctgactttttaatgattgccattctaactggaatgagatggtatcttgttgttttgatttgcatttctctaacggccagtgatgatgagcttttgttcatatgttcattggccgcagatctcatacagaactttttaccacagactccttgaatttttaccttctgactttttctgatggaactgaggcaaataaaatacaatacagttaagtttcagttaagtatcttctgtagacgttattaaaaatccataggccgggtacagtggctcatgcctgtgatcccagcactttgggaggccgaggcaggtggatgacttgaggtcgggagttccagaccagcctgacctacatggtgaaaccccgtctctactaaatacaaaaaattagcggggcatggtggcatatgcctgtaatcccagctacttgggaggctgaggcaggagaatcgcctgaacctgggaggcagaggttgcagtgagccgagattgcgccactgcactccagcctgggcaacaagagtgaaactccatctcaaaaagaaaaagaaaaagaaaatccatagatgcctttgctttcatatatcttctatcattgtcccagcttgtgtaacattatgaactcacgacctttgacaggattatcattttcttttttggtactctgattgtcacaaccccaggaggctttttttccccccttacagaaccattcccagacatctttgaaagcattctcacttcctggtaacaattacatagttcaaatacaactttgttttctctaccccatgacagggaatcaattactcttcaaggagtcctggctgggtacttttatggaatatagagaccaaaatctgggcattaggggtgcaggtcaaattgttactcatgagaaagaaatggtgacattttcccagcctacttaatgactgagctgggagagatattttttcaagttcatgtgaacttcatgaagttcattttacctttaaattagattttattaaggcttgttaaaaacttttttgttctaatataaaatgtcttttctcatttgtttccctttcagactatcgttctttcaccattctgaatatgccattttattagttgctatattaaattatgtgattaaattatgagaatgtctaacctttgtataattagatgtgatttgctaagatcgtgtatccctctcagctgccgctgagtctttttctttatataaatcataatgttatagtcatattttggataagcattatgttttcaagaaacattatatttctttctatgttatatataatttttgactataagagacaatgctgtaaacaaatatccttatgtatgtctctatcactatctgccagtttctctggggtctaaatccagaagtataatttttaggttataggttctgctcacttttaattttactagatattgacaaatcacctttcaaactgggctgacaatttgcactccctccaagagtggtgagagatatgagatttccaatttctccttattcttaccaatacttgatactgtcaaatgttttaattttttgccacttctgataagaaatcactcctcttcattgttttacttttcactcccttcattacaaatgagattgagcatcttttcatgtttttatttcctgtgtagaatttctgtttaatgaatttcttgtccatatccttgcccatttctgtttttgtgtctttttcttttcctaaatgatgtttcatattctaaatatttaccatgtatgttaatatacatcttctcttagacactttacttctaccattgtggtaccttttattgtagagacgtatgtgtctacatagacaatttaacagtttgtttaatcgtcttgtgttttgtgtcttatgatacaaaaaatactttcttgccctaatgtaatgaggttatgctcctaaattttcgagatgtctcaagttcttttttcacattcaggtctttaaatcatttggaggggtttttttgtgtgtgattttttttaaagtctaatttattttgtattcctttccagtggccactgttccaatatcatgtttagtccattttcctattttctttgctggtttttaataccaagatcaatatatgctcgagtagcctcctaagctgaatattcttttgcacagatctgcttttcttctatccctgtagccaccaatattcttgattactacttatttataacatctggtagaacaactctctacttcctgatttctttttcttaattgttatgtctaatcttggatctttactctccatatgataatcaaatcactttttcagtctgccctttccccagggaaaactgtttatggtttgtttggaaaatgacagaatttatagaaaaattcgaaagaacttatctccaaaaaatattgtgtcttcatcttttcaagggacaaaataatataactaggtggcttataaacaacagaaatttatttctcacagttttaaactctgggaagttcaagatcaaggtgacagcagattcagtgtctggcaaacgcctgctttctggctcatagatgaaaccatctagctatgtcctcacatggtggaaggggcgaggggtctccttatgcctgttttataagagcactagtcccattcatgaggcttgacctccatgacataattacctcctaaaggcccaacctccaaatatcattaccttgagacttcaggttttgacatacgaatttgaaggggacacaattattcagaccatagcacttgctatccatgcacttgtgtggccaaattccggtcttctgtgagtaacaatgaaggttacagacatatgtgtgtatctgttatatttatgcctgagaatcttaacccttttgttgcccctgtgaatagtgtcttattattctatttcattttctactttgctattgtggctgcagagtaacactactgatttttatgttttggtcttatatcctggcaaccttgctgaattacctaattagctttactaggttttatattatcttggatattatatataaataatgtcaacttttttctctaccgtgctaaaactcagtttcttgtcttattgcttttactagaatgtccagtacagcgttaagtggtaggattgatagcccttaaggccaaataccaagagcaaaaacatgaacagttggattgatccaagattgatggagcagagaggattaaagatgtcgacaagattctgtatacaactggacagtgctgatatgatgatggtaattatgatgatagccaacttttaatgagtgattgtcactacattacagaaacagggctaaatattttatatttgtattgtacttaaaccttaggaaagccatagaggaaggaaactcttattatcactatcttagggataagaaaatcagtcctagcaaagtttagtggcttgctcatggccacacagctatcagttgatgaacacagagcactaatccaagctgcaggttcaatcccttagaatcctcaatggtagaccatcaactagttctttagctctatgaagaacagaattagaggtaatggatttcaatttggccataaatggttttaagcccattttcacttcttcttcaagtatgtctctgattattttctctggagttttttaaaacagatagaaacccatgttttttagatttcacttaataaacaattattgcacaccaatcatgtgacaagcatgataagatagtcaaagatattatctatcaacatttcttcaaagagatttcagtgtactaaagcagatgaatgaggatgtgaccaactataatttcaagcagaattttaaaagtgttacaagtaaaagtacaagcaaaatgctaccttggataaaagtcagggaatagattatattacttttttattttattttattttatttttgagactgtctcactctgttgcccaggctggagtgcagtggcatgatctcggctcactgcagtctccacctcctgggttcaagtgattttcctgcctcagcctcccaggtagctgggattgcagatgcatgccaccacgcttaactaatttttgtattttcagtagagatggggtttcgccatgttggctagcttatctcaaactcctgacatcaggtgatctgcccgcctcgacctcccaaagtgctgggattacaagcgtgagccaccacacccggctgtatgtagattaccttttgagactgttttcagtggtgattctgcaattcagtcattatttttaggatttttgattgtttattcactgattaaaaaaataaaaggatggaaatgagtaaatttatctggacacttgcccatgcacttgattttttaaatgaacagaataaagaaagcaaaaagacagtatactttcccattaagtaataattttgtaaaatatgtgatgccacttcaaaggccaaaatatcccaatttaaattttaaaagacctgtgctatcacagatatatttaatctctgaattttagtcctgctgtacaaagagagcatcatgttaaaagtagatgtgggtggttctaagattcatttgcataattgttagtaatgcagagcagggtacgggcatcaactaggaaatactctttataaaaggcctgaacttgcacaagcaaatcttggggaaacttcctctgaatacataagataccataaaaataaaaataaaaatgtccctaaatgcagtggaatgagtgagagaatccatcagcaggtgatgtgttcagggaaagtccaagacatgatattgtataaagttaagagaatcagatttaaatgctcaaaattttggtccttttactttgcttttctttaacttttgggtattcatttttctaaaaatcaacattttaaaattcacttttgagggtttgggagtcattatgtacatggatggacatattgcttttattttcttccctttgatcagcacacatcatatacattctaggaacggtttaactcatgtctctgcattctgctgggttggtgctgattatgaggtgattttccaaagaatacatggaagtttgacaagagtgtacgcgtgcatcatcataagagctttatggtctttaattttggaagcaactttttttcatgtgggaaaaatagatcaatatcccattttatcttcaacttgatttagataattttaatgtgactaacaagttatgactcacgcatgtgttggtctgtaattaatcacaggcctaagatccatcagaagcccactcttctgtgagatttccaatagttgtgaaccttatgttcaccaatcttcttgctttattcttaagaggtgtcaagtaatcattgtctgatgagagcaactgaaaataagaacagtacccatgctctgcactctcaaaatgtttaacaacgtgattttccctcttacactgtttctatctatttatttataataacattactttgtagagtagtagttgatgcctcctgttctcaaaagaacaatgttgttgttgttgttgttgttgttgttttctgggtgtgctgtctttgtaaaacaaagtgagaaattataacatgaaaaatcctgataagactactttttctgctgagctcatgctctattaaaaaaaatccctgaaacatccattgttggatttttatagattcctcttggaaattcagagccaaaaacttttaaaaggtttaagaaaagaaataaaaagaagaggaagtccaacatgaagcaaatacacttgggatggagctgactcaggaagacaggagtcaaaaaaatagagcatttgcaaggaacagtgagagataacatcagaaagacagcattgtatatacacaggagccaggggtgcagaagaactgaacagaaaagttcccattgctacctgccggaaaatcttatgctgaagctcattacacagcagccaatgagtaagaataagaggagaccaggcggccacctgggctgccacaaaatataaggaaatagagagaacaaagaatacaaaaagtaggaacctaaaataaggcagattaagaagagtgaggtggtacttcaaatgccaaagaagtacaagtaccattgaataagtacaagttgctgctgaaaggatgtcattaatacaattaaatgcaactctatatgacatagtgatcattatggttattgcttgtaagaatcaatattcttaaggacatatatgatagtcttctttagtttctcagaatttatatgatgagattaatctctgccacatcaagtagatcttcaaagatataactcaatttaaaaacctgatacatatcaaacaactgaggtttgaattatttgaccaaaaaattttacatcatgattagaatgatgttcttgcctgaagatactcccttgtcaatctaggatataacccagagcctacaaatcctggtaaaaactacttttcacagctcatgctatattaaaaatccctgaagcattcattgttggtttttatagactcttgaaaattcagagccaaaaccttttaaagggtttaggaaaagaaatataaagaaaaaagaaggaaaagtccaatatgaagcaaatacacttgggaaagaaagaagtcatcataatagagcattcacaagcaacagtgagagatgagagatagcatcagaaagagtattgtgtatgcatagagggtccgtcctcagagatacatcctcactttccttttgatgtgttcaagtgaatctctgaaaccatgtatagtgttgagtctatagcaatagaaatcattataaaaattcaaagaataaaatactttttttttttttgagacagagtcttgctttgtcagtcaggctggagagcggtgagacaatcttggctcactgcaacttcagcctcctgggcttaatcaatcctcttacctcagcctcctgagtagctgggaccacagatgcacaccaccatttttgcctaattttttgtattttaggtagagacagggtttcaccatgtttcccaggctggtcctgaactcctgagctcaagcgattcatccaccttggcctcccaaattgctgggattacaggcgtgagccaccttgcctggcaagataatttaaatttttaaaatgtaggtcatggctaactaatcataataattattatactccactcttcctacacacaagtcacttctctcagcctcagttaccctatctttaaaatgaaatattaataatggcaaattcataggatagttatgaagattaatatgagacaataagcataaagtatcagaacaactagacaatttgctaaataagaaatgattcaacaaaaattagcttgtattatttttaatttgtcagcttcataagtgcagggacgatttcaattttgactacctttatatatacagccagcttcatacatcagtgcattagtaaataacagaaacttattatttcttgactaaataaattatgacatggtaagaaattgttcctgccctcaggatgaacacaatcaactgaaaaagataaaaaattcgacatttacaaaagaatgtactttggtaggctgaagcaggaggatcacttgagcccaggattccaagtccagcttaggcaacatagtgagacactctctctaaaaagaattttaaatttttaaaaagaatgtactaaatattataaaatgggaaatttgaagcactatgagaaggacttacctttctaacaatatgaaggaatatgtactctgaaaatcctttttataacatcacttacaaaaatacatagttgagctgacaaaaaaataagagagccccttaaaggcctgaattaaagagcgattttgaattcagagagaaaatagttgacatctgccatgtgcttctgccattgcctagtggctgagagcttagatcacacatgcacaagggaaaggaagcagagccttctagctggtaagagggtcccaagtaaagcaaaaactgcttaagggcaattgctgcaaaaaaataataaaattgggtgagggaaccacctcagaaagggagagactaaaaaaattaatctatttcaaccttggatctcactggagggaggaaaaacatctcctagctcttatatgagtgtcaacttgagttcacattatctgtgtgttcccccaaacctaagttcacacctcacataagcaaaagaaaatcatatctgggagaataacctttaccccaagactccaagaattctaacaaatgaatacccaaagagcatgagctagcatgagtgagggtcagcaaaagaaacaaatgacagactcagaccatcaaagattgcagatagtgtgtcaggcagtttcagaatgtaaaatagacaagtaaaatcttcaatgaataaaagagcattccataaatatgagtggggagcaagggaacattagagatacacaggcatcatacctgaaagaagaatgaatataactcatggaaattattatgtgtatgtatgtgtgtgtgcctgtttagtaaacattagcatcttagacacaactgaagagagaactagtaaagtaaaatatagacatgaagaaattacccagaatgcaatataaaggggaaaaggatgaaaaatatgaaagagaagttaaaaggtacatttaatcagaattccagaaagaatacagaattataaagaaaaggaaatattttagaatatgattattaagaaatttccagaattgaagagaaacagcagttatccagttcaagcagccaaatttattccaaagtggagtaataaaaagaaatccatacacactatagacaaactgtagaacacagaatagtctcattagaagccagagaaaataagcagacaacataagaaagaatgacaattagactgacaattcttagcaataacggaatatagaagactgaaataattattttaaagttctgagagaaaaattactgacaggtgtaattgtatgtctttcaagcacaaaagcaaaacaactttgtttttggtcattccaaaaaataaatattaaaaactggaactaaataatttattacccagaaaccctcacatgtgtattttcctaaaaggtctacttcaataaaaaggcaaattgccccagaaaggatgtcttatctaaagacaaaaaagaatgatgagtattattatgtaattatgagcaaatagatggaaaaagctaattgttacagtgttaaaaactactgtaaaacaattgcaaataaattttaagaggattatcagaataaaaatgttctaagaaagaaggaaaattttcttaaaggaagatgtattagtccatttttatgctgcagataaagacatacctgagactagaaagaaaaagatgtttagtggacttacagttccacatggctgggaaggcctcacaatcatggtgaatggcaaggagaagcaagtcacatcttacttggatggcagcaggcaaagagagaacttgtgcagggaaactcaccattttgaaaaccatcaggtctcatgagacttattcaccatcacaagaacagcacaggaaagacccacccccataattcaatcacctcccaccatgacacgtgggaattgtgggagttacaattcaagatgagatttgggtgaggacacagccaaaccatatcagaagatctgagatacaagaaagtatgatgaatagataaatctaaacaaatgttgactacaaataattgaaaataatatttaatttgcacattaaataatacaattaaaaagcaagacaacagcatatcagttgttgatagtggtggtgattaaagttgtgttcagaggtccttgtattattccaaaagtgggtaaatatactgattaaatttaaactttattgagttatgtatgcatattaggaattagagtaagcactaaaattatagagtccaagactgcaattccaaaactagcagacagaaaaactaagaagaggaaaaaaaacctaattagcttgaaaagacgaaaaggagaaaatttttaaaagcacaaatatactgttaaccaagtgagtgaaaattggctaaatacttgaattaaaagacaaagaatgacagataatacattttaactaacaatattatgtttataagcagcccacttaaaaatataacacattaatattaaaaataaaattgtgagaaaaataactaccaagaaaacaaaccaaagggagctgatatagctttaaaatcagatgaaataaagtttaagaccatgaaaaacattgtcagagataaagacggttaatacataaagtaaaacgttaaaatttggcagaactacaagaagaaactagcagatcccgtctgctaagaagtagaaggtaagttaatgcatcctaggcagtacaaggaaggtttttcggaaatgatgaaacctgtattgggactcaaagatgcggaagttggcaaaataaatagggtagaattgataaaggaaacaagtttacaaaagcagagaacatagcatttttgagaaactgcaagtactttaatatgacgctgtgcacagagggcctgtaataatgaggagtaaatgaagaactagcatactagttttatgcactgttagactttatcttgaaaaatgcagaaaatcactgaagaaccttaagcggacaagagtcatagtcaaattttactttgagaccagtaattctggtggtgctgagcataatggcttagaagggatccagactgcatttgcgatgaaccatacatgtttctggtctcagaattgggggaccataaagtagtgacaacgactgtaaaaccaaatgtcagtccacatgacctgggccttactgctctttgtaatgcccagataataaatttccagttccactaagtgttagtgaatacccatcacttggccaaatataggggtgtcttacttttctgccatgttgcattcctgagtagtccttcattcacattttttaattcatttaatatttattgtgcaaactactacttccaagcatacttttataggcactggggatacagcagtgcgcagaagaaaaaattccctatcttcatggagcccacagtctgtatgtacatctatgtgtctgtgtctctgtgtgtttgtatatgtataggaagatacagacaataaacattccacataagtaagttatataggacattaaagattagtaaatactatggaaaaataaaagagagtaagggagatggacagtgcctgagcaaagaaaagattacaatttttaggtgtcatgagggaaccttgctaaggaaatatctgaactaggacttgaatgcagtaaggaaaaaaccatgcaaatatcgaatgaacagtattccaggcagcagcaacaataaagttaaagaccctggagtgtgattgtgcttggtgtgttgaagaacatcaaggaagtcactgtggctggaacagaatgaggcagaggggaagcagattagataggaccttggagcctcggaagccactgggaagctttgatcagagagctactcaacagcatataactgatgcatttatagtgtgtattaggaatagcctgaaatgtattcaagtaaagacttacattctcccttcaccttccaccctcctttcttgccatctctgattattgaaggtataaaatgaagcagtaccaccaaggccatggtaagagaaacaaactcaccttgactcagcatctactatgtgccaagcgccatgctagaaactatagttttatctcaattcagcagcaaaatcagtctatcaggtttcagtggcacaaagaagagaacacagaaatattttagtcaattaccaaatggtaagctacaattttttaaataagtcccccctgcataaagaaaagataaatttttaagttgatggatttctgaattactctgatttgatcattagacattatatgaatatatcaaaatattgcatgtacctagaaaacatgtacatccactatgtatcaataataaatttttaaaagcccccaagccttcttggacatttgctaagggcagtgtggctgtttgcagccctatatgcagaaacctccatgaatatgtagggtacaaggcagagagaactgaattcagtcagagctgaatggtgcttggaaggtgcccagcctcccaagaagatgtctatttaccctcagcgagcagtcacagtgccctctgcccaggagggcaggattagctttgaagcagggttgtttgtttctctttttagaaaagctctgttgaaacataattgatatatttaaaattgcatatatttaatatatacattttgatgggtttggacatatgtacatatttgtgataccatcaccataatcagcatactaagcatattcatcacctgtcaaaattaccttgtgttcttttgtggttttgttttgctttgtgataagagcaagtaacatgagctctatcctcttaacatactttaaagggtacgatgccatattgttaactataggtactatattgtacagcagatctctagaacttactcatctggtatgactgaaactgtatatagggtttttcatttctgtggcaactctatacatgaaagagctgtttgtgggggaagttattaggttgcattaaaacaagtcattgagaatagcagtggggttgtggtgtgtggcagtggctgctgctatgggaggttgtgtgcctagtggtcatgaattgtgccaccactggcaccatttgagaatggatggaatagtaggacacaccaggatcaaaaccatcttgccgaggttcttattcttgatcgaaatagatttgtatttcataaattatcagataaaaacctttgtgtcttaactaaaagtaaagtggaggtcccagtgacaagctttgcaaaagccccacatcacataagcatatcatatcagaagacagtagaaagaattgtgaacatcaagattgacaccaaacatctggcccttgtaaagagaacatgtagccctcccaagggagttccagtaattggaatggaatgaactctatccaagtatctgcaaaactcctaaatcagattaacaaattattgtccactgttgtggaagaattttgggaaatgggaaaggtgctggaagactagagacagacaaattttattgttgattctactatgttaggcaatttcaagagccaacaagcttcatattgatcaaaagcaatattccagaatggatttaataggtgggtatatgagtactttgaaaagcaagtgtccttgggatcctgtctgtgctcaccaataacaaatcacattactcttactttaattccttgtttgacagatttactatgtccataatgctagtattgcacagttaaattcagatttcagtaaagtagttgacaaaatctaacatgaaagtcttcagaaaatgttcatttattcaattctacacttgagtatgtgtaaatggttggatgtgtaaatggttggatgaacatactcaaaaagtgtcaattcagatattctagagaattatcaatatatgaatgaagatatgtggataaaggatccttcatacccagatcacctatgattttaatactcttacctgattactatcactattaaccatggctaaaaagcctagaaaaaggtgacaaattaaagtgacttaaagaaaacaccatataactaaaattgcctgctccatatgccccccaaaatggttacataatctacagtcatgtaatgaatgcctcaaaaataatggagttgcataatttatgcaccgatgttagaattcagtgccacctaaggtgcaactctaccatcttgtttaatccttcctaaaataaagaaatatataaacatatactgattttagatgctgaattttaaaacaaaaatataatcgctattatcaggcaagactattctagaatcccctatcatccattctctatttacctcaaaaatctgatagtaatctaggcaggaaggcttgaatgtccacacatttggatataggctttcagaggctctcagatcttggattatagtaattattgctatgttaacaacactgtgaatactacactttatggtcaatttaaaggaaacttagggtcatttttactgtgtgtaatggtatgtctttctcattagatttagagcctaatccccatgtaagaggctactctcatttgcattagctatatatacaccatcacagaatgatggacaaagatttctctctcccctcaaaaaggaaaaccattaacatttactgggtgcttgctaaaagagcatcattttaggatctctaagtactttaattaaaacatagaaccttccttcaggaaggtaagaactcatctccatcagcagcatcactttatgcacaactgaaagttcctgttcttaggctcttactgctctaggttatcttagactgctctagtagatctaaaataggtcaagtttgatcagataatttgtagtgcctcaattggtcagagcccttgacatacataggtcttctctagttttgaggaggaacattgctaactcacatttgtgatgaaagttcacccagatccctctagcaaactatgccggtggcttcactacagatgtacctctctggcagattcggagatttcaagcaaatgtatcaaaccctaatgtgctatgacaggaggatttcctccaccaatcataagtagaaatgcctgggagctattattcaacaggaaacaaagctccttcatctgaaaagcaatttgcagaccgacactcctgctacagcaatttttatcatgagtttgtactttgaatggaacctaccttaaaaaaaaaaaaagacaatgtatcttatatcctggatgttccagattttgaaacagaacattcatagcagaaagtatcagttttcggaagctcttctgctctgaattaaaatatcagagttgggttttttttcctgtttaaacaagaaaaaagtatactgcccataacaaattatattgtttatcagtcatataagctcttaaagcagaaccatatgaatacagtccctgtaaagttatagtaggaaaaaatagacatatggacatcctgggggaagaggcggccatgttcattttccatttgcctaccccagaacattccatattgtgtaaaatttttccatgcatgtgcatctccaaaaatgaaaataaaaattataaaacagctttgtgagcatgctgccagcagaagagtagggtagagctggatgcataatcaacctttttgatgtaaggactgctggcaagcagtgtgggccagcagagcacatgggaagctgaggagcagccatagatacactggagacttctctgtcccaggctgcattgagatgtatgcatcaggctattgtggtttttttttaatactaattctagatatttttttctttgtaaaataaggctatcaaaaagaggagcgcagaatgtttctgccagtttgtaagtgtgtgacaatgggcaggaaacctggctgtcttcaacagaaagggagtaggaaccaccaggagaatggaagagatgcttttgcagggagcgtgagagaaaattttgacacacatcttccccagcctaatctgcaatgcaatgctttagggagagccaggcaccatgttaaaatctggttaaactaaatattgtactgttttctttccttggtaaacactgacttggtaagaaaaaatgatatcctttgtatatgaatttgttctcctggtaataataatgaatttagacctatttttccacaccatttttgctgcccaggcagatattatcaagccagctcactaagtttaagtgagtaatccacgaacattcatttatttaataaactttaattaagcatctactctatgccaggcacagtgcttggtacaatcacaatagaaatattgcctctactccaagctcctgcttattgaaactataccagggaggcttagctttcccaggttatcctgggaccctaaacccacagctcctagcagggattctcatcctttctgatgttctaatactatataattaggtatataattgggtgttgtgaaccaccctcactcctaaaagtatgattagagtttgtttgtcctatacattaaaatgaaaataatttggtgtagaactttatagtagacttcaggataactaaaaacgttctcaaacactgaaatctaaacaaccattctgcaagagcagcttttctgggcccttttaacatttatcatctctattgactcaaatgagtcaaagcaattattctgacacttgaaattttacctttaacgtttcctgggaaacatagcttatactcacctctacacttcttgtgggttcatttaaagaggaagtaatctggaaaagagccatgaataacagaattacccagtaccttgatgttttctcatttctctgccggcattcagcccaacagctgtcactgtacctctacaggaacttagttcttgtatggcaacttgagtggcattgagctctgatagaaggtcataacatctttgttagaaataatatgcaaatttttccaagaggttatgtctcaagtttctattctaaaagcaagaaaagtcacaaaacaaatttctttgtagatcaaatactaagaggtgaagaaaattaatttccctctggcttttgtcttggttgacaattcttctgggataaggttgattatttttatgattcctcatggagactgtcagctctgcctgattaactgaaaactagcataaaaagattgtataatgaacattattcatataaaattattccttttagaggctaaataagaaaatttgccttacatagagggaaatttggcactctatgttggttgtcttactttgattaccaaaaatcactttttgagtcctgtatgataactcccatattttagagtagcaattgatctcataggaagtaaataacatagccacacaactattatgtggtcagacaaggatttgagtgcagtaattattagctgggagtgtccatgagcacgtgtgcacacacacacacaagcctcagctccacacgttctgattcagtaggtttaaggtggagccccagtaatcccagactttgggaggccgagatgggcggatcacgaggtcaggagatcgagaccatcctggctaacacggtgaaaccccatctctactaaaaaaaaaaaaaaaaaaaaaaaaattagctgggcgtggtggcgggcgcctgtagtcccagctacttgggaggctgaggcaggagaatggcgtgaacccaggaggcggagcttgcagtgagcagagatcgcaccactgcacaccagcctgggtgacagagcgagactcggtctcaaaaaaaaaaaaaagaaaaaaaactccataggtgattcgtgtgctcctcccagttaggaaccactacccaatatgctacttcaactacagaagggctgtgaaatgacaagaatgctccccaaaacatctgattaacaattcaaaaacatgccatggagaacacgattttttaaaataggactttttgaaggaaaagaagaaagggtgcagttatatggattctttaagaaaaaacaaaaccaaggagaaccagggttaggaggaacgttaagtaacactttgaattagtcattaccgtgtacagtgtaatgaactcaatttctgagttgttgaaccactgaggaatatgtataatatatattcaacatatatattatttagagtcaacatatattatatatatatactatatatattcaacatatatataaaacttacccataataggcctaatgcatttatttaatgtttatgtatattaaaagtgttagtctttttaaagaatggaaaaaggactttagaggcttttctcttacatccaaagtaatataaattcaagggatttataaagtattacagatcagaaaggctttgtgtctattccagaaaatgaagttacttactagaaatttcagtgagatctttactagatggattggacaaattataagatagttggacactgtagaaggattttttttattttaaaacaatgtgcctaagtcacaaaacttaatagtctcaaaatagacaatggattgagttccaaaagtttatttcttagcaagtctattaaattataacaaagttatgtacaaattataataaagtacccaatgagcctttgtaaaggaggtcacaatgtagttgaaatgtcatatactttccttgaaaaatacttgaaaataatacttctatagttatttaacagtatttaaaccaagtctttaattgagtagccatagtagatataaaagcacgttggaaatggcagacaaaaagcaagttttaactttgcatgttgactgtaccttaaaagtaccctatgtggattatttacctagtaaattgtattaatgatcatctccattaaatgtttagaggaagattattgaagaaaaacaaaaagtaatatctacttgtaaaaaaaaaaaatacctacttgtagtgggtctcgaatttcaattaccaagaaactgaagagtttatgtaaaatgcagattccatgctgtaattgcggagattcagagtcagaaggtcagatattggaaattttatatttctaacaatacacagtaagaagcactaaaaactcgtccataactgtactgctttttgcttgtcccagtataaattttaataacacccactcccagtctcagtatacttatttggatgataaattatggtcaacagaggtttagagtatgcagaattctctgaagtcttccaagttggaaaaagtgccgctcctagaattggtaggactccctgccaccctgtagtcactggtacctttgctgtgtggtggtcacagagccatctctcaaaaactcatagaaaatgcaagtattgttgaaaccactccaaaagaggtctcctttggtgttctcttactagggaattctgagtcctggttttttgtttgtttgttggttggttggttggttggttggttttttgtttttttcttgtagtaaattcttatctaccatgttctcatattatagtcatcttaggaggtcattccgagcaacatgaaaagcaagaagaagagccccaacatagaaaacagaacgtatttgggtaacgatgggaagagcagagtactccaggcatagaaggagaaagaaggtaaaagtgcagattggaccactttggggcccaggataatgggggaaaaaattggaattacatggcttctgtgatggaaattattggaaaaaaaatttattaaaaaatgagggtctagcagggcaaggtggcttacgtctgtaatcccagcactttgggaggccgaggcgggtagatcacttgaggtcaggagtttgagaccagcctgccaatatggtgaaaccccacctctactaaaagtacaaaaaaattagccgggcatggtggcacacgcttgtaatcccagcttcttgggaggctgaagcaggaggatcgcttgaacctgggagacagctgttgcggggagccgagattgtaccaccgcattccagcatgggcaacagagtcagactccctctcaagaagacaagcaaaaaaatgagggtcactcagagatgaaacttttcttaactttttcttggttaactaagataacacatatgaaaatacttggtaaacaaacaaacgaacaaacaaaaatagaaccaagagaagaaatagcgaaagaaaaggcaaaaaggaggagagggagtacgcaagctgtggctccattaggacaggccctagaagtaaggaagggaggaccacagcctaaaatcatggctttgttggggatgggggccagtggaagggaaatatttctgaaactaattttaagagtaagtgaactccctagaaaatatttttgtcttataattgatactgtgcttcttctaaaaaatgaggtagtatctattctctctacacttcccaaatcctgtcagtcctgttcatactaccaaaacagaccaaggcaggaatggttttcttgaatattttgttcatcttccatgacagatgtagaacttcaagtactaaaagtttgctgtttaattaatattcaggcaaaatacattttctatctgttaatgaacaatggcacctgaggggaaaatgtctgtatacatgagggggaaacgtttgtgtaatgagattttttttttaattttactttaagttccaggatacatgtgcagaacattcaggtttgttacataggtatatgtgtgccatggtggtttgctgcatctatcaacccgtcagtgaggttttaagccctgcatgcattagctttttgtcctgatgctcttcctcccctcgccactccccacccccggctataggccccagagtgtgttgttcccctctctgtgtccctgtgttctcattgttcaactcccacttaggagtgagaacatgtggtgtttggttttctgttcctgtgttagtttgctgagaatgatggcttccagcttcatctatgtctctgcaaaggacatgatctcattcctttttatggctgcatagtattccatggtatatgtgtaccacatttttttgtccagtctataattgatgaacatttgggctggttccatgtcttagctattgtgaatagtgctgcaataaacgtaagtgtgcatgtatctttataatagaatgatttatatttctttgggtatatacccagtaatgggattgctgggtcaaatgttatttctggttctagatccttgaggaattgccacactgtattccataatggttgaactaatttatactcccaccaacagtgtaaaagggttcctatttctccacagcttctccagcatctgttgtttcttgatttttttaaataatcaccattctgactggtatgagatggtatctcatgtggttgtgatctgcatttctctaatgatcagtgatgttgagcttttcttcatatgtttgttggccgcataaatgccttcttttgagaactgtctgttcatgtcctttgcccagtttttgatagggttctttgtttttttcttgtgaatttgtttaagttccttataaattctgtatattagacctttgtcagatgggtagattgcaaaaattttttcccattatgtaggttgcccgcactctgatgatagtttcttttgctctgtagaagactgagacattattaaacagataatttcatggcctgatatttcatttacattttaacaaaaagattttctcctgatattccatgtttttctcaaaattcatttctaataaccatatactattccaacttgtacatgtaccaatatttcccagcaaccatcatcctttcttgttacatttgagattctttttctctcaaatattgctgtgcattggctttttccttctctcagatcgtttactaatgatagaattatgagagtgcgattatggggtcaaacaatatgagtagttttgaggtgcatgatacatatttccaaactacttgaaaatagatttatacacacattctgcactgtgtaaaatttttatctcaaatttaattattttgataataaaatatatttttcttaatttactttggtttacttattaggtcaaacatatttacccatattttctctttctttgacgttttcgtcttttctttttttatttttccatagattataggggtacaggtggtgtttgattacatgaatgagttctttagtggtgatttctgagattttggtgtacccatcaccagagcagtatacacttcaccctctgtgtagtcttttatccctcacccccttcccacccttcaccccaagtccccaaagtccactgtatcattctttctctttttttttttctgagacagagtctcactctgtcacccaggctggagtgcagtggcatgatctcagctcactgcaacctctgcctcccaggttcaagtgattctcctgcctcagtctcctgagtatctgggtgtgcaccaccacgccctgctaccttttgtatttttagtagagatggggtttcaccatgttggtcaagctggtctcgaacccctgacctcgtgatccacccgccttggcctcccaaactgctgggattacaggcgtcagccactgcgcctggcctattgcaccattcttatgcatttgtgtcctcatagctttgctcccacatatcagtgagaacatatgatgattggttttccattcctgagttacttcacttagaataatagcctccaatctcatccagatcactgtgaatgccgtgaattcattccttcttatgtctgagtacatatatatatatcccatctcatatatatatatatctcatcctatatatataaagaaactttatatatataaaaagaaactgtggtatatatatgatgaaatatatatatataaactgtggtatatatatgatatatatatcatatatatgatttattttatatatattccatcatatatatatatatactccatcatatatatatatatttatatatataccacagtttctttattccctgttgattgatgggcatttgggttggttccacaattttgcagttgcgaattgtgctgctataaacatgcatgtgcaagtatctttttcgcataatgactcctttttcactgggtagatacccagtagtggggttgctggatcaaatagtagttctgcttttagttctttaaggaatatccacactgctttccatagtgttgtactagtttatattctcaccagcagtgtagaagtgttccctcatcactgcatccacgccaacacctactgttttttttatttttttatggccattcttgcaggaataaggtggtatcacatggtggttttgatttgcatcccctgattattagcgattttgagcatttgttcatatgtttgttggccatttgtatatcttcttttgagaattgtctattcatgtccttagcccatttttttaattatgctttaagttctagggtacatgtgcacaacatgcaggtttgttacatatgtatacgtgtgccatgttggtgtgctgcacccattaactcatcatttaccttaggtatatctcctaacgctgtccctcccccctcccccctcccccgaccccacaacagggcctggtgtgtgatgttccccttcccttagcccattttttgatgggatttatttttcttgctgatttatttgagtttgttgtagattctggatattagtcctttgtcacatatatagattgtgaagattttcttccgttctgtggattgtcagtttattctgcttactgttccttttgtcatgcaaaagctcttttaattaagtccccgctatttatctctgtttttattgcatttgcttttggcttcttggtcatgaaatccttgccgaagccaatgtctagaaggggttttccaatgttatcttctagattttatagagtttcaggtcctagatttaagtccttaatccatcttgaattgatttttgtataaggtgagagataaggatccaatttcattctcctaaatgtggcttgccaattatcccagcaccatttgttgaatagggtgtcctttccccactttatgtttttgtttgctttgtcaaagatcagttagctgtaagtatctgggtttatttctagattctgtattctgtcccattggtctatgtgcctattttataccggtaccatgctgtcttggtgactatggccttatagtatagtttgaaatcaggtaatgtgatgcctccagatttgttctttttgcttagtcttgcttgggctatgtgggctcttttctggttccatatgaattttatcattgttttttctaattctgtgaagaatgatggtggtattttgatggaaattgcattgaatttatagattgcttttagcagtatggttgttttcacaatattgattctacccatccatgagcatggaatatgttttcatttgtgtgtatcatctatgatttctttcagcagtattttgtagttttccttgtagaggtctttcacctcctcggttaggtatattcataactatgtttttgcagctattgtaaaaggggttgtgttcttgatttgattttcagcttggtcgctgttggtatacagaagagctactgatttgtggacattagttttgtatctggaaactttgctgaattcttttatcagttctaggaactttctggagaagtctttagggttctcaaggtaaacaatcataccatcagcaaacagtgacagtttgacttcctctttaatgatttggatgttctttatttctttctcttgtctgatcgctctggctaggacttccagtactatgttgaagaggagtggtgagagtgggcatccttgtcttgttccagttctaagagggaatgctttcaacttttccccattcagtattatgttggctctgggtttgtcatacatgacttttattaaattgaagtatgtcctgtatgtgccagttttgttgagagttttaatcataaagaggtgctggatttgtcaaatgcttttactgcatctattgagatgatcatgtgattttggtttttaattctgtttatgtggtgtatcacatttattgacttgtatatgttaaactatccctgcatccctggtatgaaacccatttgatcatggtggattatctttttgatatgttgttagattcggttagctagtattttgttgatgatcttagcatctatgtgcatcagggatgtgggtctgtagttttcttttttggttatgtcctttcctgatttgggtattagggtgatactggcttcatagaatgatgtagggaggattccctctttatcttatgaaatagtgtcaacaggattggtaccaattatttgagtgtcgggtagaaatctgctgtgaatccatctggtcctggacttttttgttggtaatttttacattattatttcaatatcactgcttgttattggtctgtttagggtagctaattcttcctgctttaagctaggagggttgtatctttgcaggaatgtatccatctcttctaggttttctactttatgcacgtaaaggtgtttatagtaaccttgaaagatctttcgtatttctgtggtgtcagttttaatatctcccatttcatttcttattgagcttatttggattctctctcttctcttcttggttaatcttgctaatggtctatcaatttgatttatcttttcaaataaccagctttttgtttcatttatcttttgtaattttttgtttcaaattcatttagttctgctctgatttttgttatttcctttcttctgctaagtttgggtttggtttgttcttgtttctctagttccttgaggtgtgacgttagattgtcagtttgtgctcttaccatctttttgatgtaggcctttaggactatgaactttcctattaccactgcctttgctgtatcccagaggttttgataggttgtgtcactactgtcgttcaattcaaagatttttttaacttctgtcttgatttcatttttgacccagtggtcactcaggaccaggttattcaatttccatgtatttgcatggttttgaaggttccttttggagttgacttccagttttattccactgtggtctgaaagagtgcttgatataatttcaattttcttaaatttattgaggcttgtttgtggcctatgatatggtctatcttggagaaagttccatgcactgttgaatagaatgtgtattctgcagttgttggatggaatgttctgtatatatctgttaagtccatttgttccaaggtatagtttaaatccattatttctttgttgactttctttcttgatgacctgtctagtgctgtcagtggagtattgaagtctcccactattactgtgttactatatatctcatttcttagggctattagtaattgttttataaatttgcaagctctagtgttaagtccatatatgtttaggactgtgatatttttctgttggacaaggccttttaccattatataatgtccctctttgtcttttttaactgctgttgctttaaagtttgttttgtctgatacaagaatagctttaaatgtgttttgtctgatacaagaatagcttgcttttggtgtccatttgcatgaaatgcctttttccacccctttcctttaagtttaatggtacttatgtgttagatgagtgtcttaaaggcagcagatagttggttggtgaattcttatccatgctgcagttctgtatcttttaagtggagcatttaggccacttacattcaatgttagtattgaaatgtgaggtaccattccattcatcatgctatttgttgcctgtgtaccttggttttttgtttggttttttaaattgtatttttgttttataggtcctgtgagatttatgctttaaagaggttctgttttgatgtgtttccaggatttgtttcaagatttagagctccttttagcagttcttgtagtggtggctagtagtggtggattctctcagcatttgtttttctgaaaaagacgatctttccttcatatatgaagcttagtttcactggatacaaaattcttggctgataattgttttgtttgaagaagctgaagattgggccccaatcccttctagcttgtaggatttctgcttagaaatctgctgttaatctaataggttttcctttataggttacctggtgcttttgtctcacagtttttaagatactttccttcattttaataatcttcatttagataacctgatgacaatgtgcctaggcaatgatctttttgtgatgaatttccagggtgttctttgtgcttcttgtatttgtatgtctagttttctagcaaggctggggaagttttcctcaattattcccccaaatatgtttcccaaatgtttagatttatcttctccctcaggaatgctaattatttttaggtttggtcatttaacataatcccagacttcttggaggctttgcttatattttcttattctattatctttgtctttgttggattgggttaattcaaacgccttatcttcaagctctgaatttctttattctacttgttcaattctattgctgagactttccagggcattttgcatttctataagtgcatccgatgcttccggaagttttgattttttttatttatgctatttatttcattgaatatttctcccttcacttctcatatcatttgttggatttcctttcactgggcttcacctgtctctagtgcctgcctgattagcttaataaataacctcctgaattcttttacaggtaaatcagggattcttcttggttcgggtccgttgctggtgagctagtgtgattttgcgggggcatgttaaagagccttgttttgtcatattaccagtgttggttttctggttccttctcatttgggtaggctctgtcagagggaaggtctagggctgaaggttgttgttctgattattttgtcccgtggggtgttcccttgatgtagtactctcccccttttccagtggatgtggcttcctgagagccaagctgtagtgattgttatctctcttctgggtctagtcacctcactcctggctggtactgggggttgtcggcacaggttccaggctagtactgtgggttgtctgcatggagttctatgatgtgaaccatctatgggactctcaactatggataccagcacctgttccagtagaggtgtcaggggggtgaaatggactctatgctcgttcttaactttggtggtttaatgctctatctttatgctgcttggcctcctgccaggaggtggcactttccagagagcatcatctgtggcagtatggagaggaaccagtggtggacagggccgtagaactcccaaaagtatataccctttgtgttcagttacctgggtgggtagggaaagaccatcaggtgggggcagggctaagcatgtctgagttcagactctccttgggcaggtcttactgtggctgctgtgggggatgggggtgaggtttccaggttaatagagttatgtaggtaggaggattatggctgccactgctgagtcatgcagattgtcagggaagtgggggaaagcctgctgtcacagtcctcacccagcttccacacaatctgaagggccggtctcaatcccaccatgcccctgctagcagcactgagtctgtttccaggcagcgggcaagcagggctgagaacttgccccaggctacctgcctcctagccgcaaaagaaagtaggacattagttcttcccctgcctgtggagtctgcacgctggatttgcaccctcccctgagttctgatcaggaggcttcttgaccagttcaaattgttacaaacttcagctggagatttccttttccctgtggtgctttccctctgcctctggcctccttcctgaagggtccccatggtgccaggcagtgatggcctgcttggggacccagcaagctcccagggcctttcccgctgcttcctctaaccctgtatttcacttggctgtctaaattgactcagcttcaggtaaggtcagaatcttcacctgcaaactaggcctttagtttccccagtggggatgtgtgttcaggggcggaggatctccctttcccacttccacatttgggcacacacggtatttggggtgtcttccaggtcctgcaggagcaatccacttccttcagagggtctgtgggtcctttcgagtttcctgatttattcctgcagttgttctggggcaaaaattcaagatataagcctccacacactgcttcatccatcagagttggggctgcagtctagttctgcctctcatttgccatgatggattattttctttctgaagttttctgattatgttatttatttactagttggggtcatgtttttcttaaagattataagaatcttgtagtcaatgactgtcacattggtgaccgtgctttttttccatctagattatatggtgccttttagattttagtgtattcctttgaatcacgtaagaatttcaaatgtttattactttaactgtgttatcttgtgcatgcttataaaagtctacccccggagaggagggagaggatcagaaaaaatactgttggatactaggcttagtacttgggtgatgaaataatcagtaaaacaaacccccatgacacaagtttacctatataacaaatctgcacatgtacccctgaacctaaggtaaaaattcaaataaataaataataaaagtccatcttcaaattgattttctataactaatcatttatatttttatttagactgtttggaggtttattatttacaactagctccaatatatatggaatgtatttttggttaatgctgtgatacaaagacttcacattattttctctttataaatagccacttgtcctacaatttattaatccttcctttctctactatgaaaattgtggctatttatcttactataagtaaaaggagcttggtgtttatttcctcctaggctatctccttttcttccttgacattcctatcaatcatatgacatgacagaccatcttaactattataccttatatttttattaaaaataagctttcaacacagtttatgacaagtcagtataaatgattttactttacttggagaagagattctgaccaatcttcatcggcaaaataggttagctgaggtttctaagcaatcccactaaagactttttataaaagtgagtttgggtacttttttttaatgagaaggaggtcacttaaaagatgtaatgttccaaatccacatcattaagagaataaaaacttagtggtgcctttttctgttaattatttctaaccactatcatgctgtgacatcagtggagatacaggcttttcttttcttaagaaattagcacatacaatgaaccatgacaataattatcataacccttgaaattttaatatataggaacattgccacagtgttatttttagacagatctcctaaattgctttctactagtctttcaatgacatataccttgaaaatttggaacatttaaaaagagctcaaatacacagaaatagaaaatgaaagagtggttaccataggtggagagagggagaacatggggagatgtacaccaaaggatacaaaaagcagatatgtaggatgaacaagtctagagatccaatgtacaacatgagaactaaaggtaataaaattgcgttgtgtttggaatttttgttaaacaaatagatttagctgctcttgtcacaaaaaaagtaattatgcgagataatagatatgttaatcttcttcactatagtaactcttttgctatctatatgtatcctataacatcattttgtaaaactcaaatataaacaataaaatttgtaatttgtaattttgatctttattttccccagacatttaaaaatatgtcaaagaatatacttcatccacaggcagatttttcatatccatttaactatgtctccagagagcacttattaacagaagctaaacatatggaccttctaaaattaagaaaacctttttggaacttgaaaagacttttgaatagggctagaagcaacaagccatagtgaattattcaacaccaggatatcaaagaaatggaggaagtaatttcgtgctgtagaagcaaagttctgtaaattgatatgtgatgatattcaggatagtttaatttggtagcctggaagagaatcaaatgaattgaagaaattcttataaatatttctttcttcttttttaaaattaaagatatctgctaatttgaatatgccacctgtgctttactccaatgttcaaatttctttttataaattgcaaaaaatgcatctaattttacaaatattcctcactctctacaattaaaaatatatgcatataatttaatattcttatgaaatcaaatatctaaaatagaaaaatcctaacacagaccttactttatgatcatctttgtgatattctaaatcctcagttattttaaaattgaaacaacggggaagttttcaaataaaagatcttatttcacttgaaagaaaaatgtaggtgtaaggggaaaagttataggtaataagatttaatggctgtgagaaatagacaaaaactgatagtgttctctagagaaaatagctttggggcagacagaagagagatgaggtgtgatactgagtgaagttttaaaaataaagaaaacagaagcagtaatagcagagaaagaacaagaattaaagagaaaatttaatcagaggataacgtgtgaagagtccccaaactattttcttgatcaatatgacgggaaattaagcgttaaatttttccaaagtgagaataatgatctttgaccaacattagcttgtttccatggttagaggctaggataaggtaatgtttgtagtggtttaggtggggagacagcctgcattgaggctctggtccagagctggggcctcaagaaccatgaagagagctaagcagttcaagaggatgttttctagaactcttgaaacctaatggaaacccaaagactggaagcaacaatgttcaaagataagaccctcactcatcatgtgcctatttggaggtttcttagcttcctaatatagaagacagaattcaaagcagatacctaaaggaatatctgggagatttctaaattaatagactgactgtatctaaggcagaaaataaaatgtttcaaactgttaatcacaggcaattttacattaagtgagattaaagattttggacatcctcccagccaaaatttagacatcaacccacttttactggataaaacaaaatgtgataatcagtgagaacagttccaggttgttccttgctcttgaatgtgactgactttctttaatgtggagttatatatccattgataaaatgaagtcatccctttatcaaaatatatgcatccctttatcaaatgcaactcagttattttttttacttgaattgcacggttacaaacacattactaccaccagtttgtgaatacacctaaattgcaggaatactatttaaccataatgataatctgattattatttataatattaagttctgggattcattatgattttatttctcacaaatttccaaggaaattccaaattgctaagtttagagctggacaggacctttaagttgaattcttttaaccttctcatcttatagttgaggaaataaaatgatacagtttacatttgttcagtgttaacacagtgaggggtagaaaaggaaacatttgccagtgcatataatgcttatattgaatattataagaattgcattttttctactgctgcctatggaccattctcttacctatcattcttcacccgattagccattagtgtgtacacattcataaacctaaaccttttcaattatagtaactcttatagaatggaaaggtaggggggtgtgtgtgtgtgtgtgtgtgtgtgtgtgtgtgtgtgtgtgtggctgataaattattgacttctgtgtactattctttacccatactttatcacttcttacctggacctccttctcttctaactcaaatacccttgcactctaaattttgttgctgtgtctctggataactacataaagaagaaaccgaaagaggataaaagtgaacataggtatcaatttatatataaagagggaagcatgaatctgacttggtactcactctatgagcagcacggaaacaggtatagggatttatcagcttcatatcagctgaccaccacaagaacccataaatggaagatacatgttgttttagacacttgcaagggaggataagtgaaagagaggcctgagcaaagaagctcacacacagggcctgtgcctatgactccagatgaagcccaggtcaggctgtgaacagctctgttagctatactaaccaagaagtttttaactgtatcccaagggcaatggaaagccgatgaaggctttacagcaagaaaatgacaagacgagatttatgttttggaagaatcctcctggcttaaatgtacggaatggagaaagagtggtgcaaaggacagaatgtttatgacacccaaccccaaatttatgttgaaatcctaactcccaatgtgatggtattaagagattgggcctttggaaggtaattaagccattagggtggagccctgatgaatgttattaatgtccttatgaaaagaggccagagagctagctagcctctctttccgccatgtgaggttacaataagaagttggtagtctgcaacccggaagggggcctcaccagaaccccaccattctgacaccctgatcttagattttcatcctctagaactgtgagaagtaaatttccatcatttgcaagccaccagtttatggtggtttgttaagtagcccaaactgacttaagacaagtgggaaggggctgagtagtaagaccaatgcctagaatagtgcttggcaaataggagatgacaaatgaataactgttgagtatgtatgacagcagaaaatccaattatgatgctgttgagaaatccaggcaggagaaggcatcactggggccagcatggtagctgtcagtgagtgtgcattaggattaagtgtttaatgcaagtgtgcagaactaagaacatcctatgtttttatggtgtgtccaaatccggagtaaagacaaagttttttattttgtttgccaagatagcattttccttttagcagtttttcttctttaaagatattgtactctttcaccactaaagttgcattacctctgaactggcagttttgctgatggcttctgtggtctggaggcttgcccatttattttctgatttcccctttggcagtgcacatttctgctctcattcttcactgcaagcttcaaatatataagcgttctagttactaacaaccaagagacaaagagattgggggataaaagtacaagagcaagcagattcatacctgatgagttattggagtgtttcccttaatcaatgccattgtcatcccaaatgttggcagatcaagcttggataggatccagtatactcactgtcactgaaaatagttaattacttggagggcattatgtgtggtggtagcacagggctatgtacatataggtaaatcaaaaaaaaacttaatgggcatattaattcataactttttcgtagtaagcatcgatggattagatctgtttactgaatttatagatacttccactagagaataaagcttttcaccttcttgttaatccagggtcctccttgcttagtgtcagagctgtttgtgatttaccagcactgacaactactgttttcctttttggttcatttatcagagaggtttctagccttgtgtaatgcaaaatgctcaggctttgttaccatactaatttgggtttaaattcaagtcatgggatattttagcttggtgaccatgggcaaattgtcaaatttttctgaatctggcattctcctagtataataatcacaatcccaaagaagtgcttgatgagtttcatttgattatttattttcttttaagtctagcacaatgttagacacataaaaggaatgaatcttcatgaccgttgtatcaaataaaaaagttctccaatgctatctttgttgtatttaaaaacattagataggcagaaatatttttaaatagatgctcagagataatcacaatggtgttatttgaattctatattattacttggaagactttattaacttcctttaaaaggacatggggacctttcagagagtggaaggtgggagatgggagaggatcaggagaaataattaatgggtactagtcttaatacttgggttatgaaataatctgtacaacaatcccccatgacacaaatttacctatgtaacaaacctgcacatgtacccctgaacttaaaatgaaagtttttttaatggtgcatacttctgcattctcatttatgatatatacattaagcctaatttaatttagataaaaataataactcaaaatatttgggataatagcttgaaattttaggtgtatctttccaatttctattttttcaccacaagtagatttcagtaagattttaatcaatggcagtgttgatgctaaacaagactagggaactctcaagttagcccttgtgataaaattacagaaattcagacctaaaatacatcttcaaggccactagatcatcatgagagtttacggtagtaagtggcaccatgtcaacgtaactactccctagagcagtggttcccatttgtattctgaggaccaatgggagactttgagttgtggcatggggtgtgtgagtcctgggtccactcttaactgtagaaaatcagtattatgtatcctacatatgtatgcagctgcttttcaaaagtatacagacactattgtgattagaaaaatacaaattcattccaaggcattaccacatttcagtagtgttttgttatgggttttcttaaccaacagttgtgtaaagtctatctgttctcatgtgaaatctgtagacattttaaacagtgtaggggaaggaaatatcttctcttcccatcttagagtcacggctgaggcccctgtaagaaaagacagattaacaaggaaagcttacagattcgtttaatgtaagttttcatgacatgagagccttcataaagaaatgaaacaggtaaagttgtgtatttttatgcttaggtttgataaagagtggacagtcctgagaaatatgattggaggacaaaagggaatgacctaatggtaacaaactgggggaacttaacaaggcgtgtttgttcagattcttctctgggtctgtgtgtcatcaaagataaggatgttcctttcctccaggtgtagggagggcacctctggaatgaggaacttaggatctgcttcaggggatatgagggagggaaaggtaagagtaaccttgctgcttaggctgttttgtcaaataccaaggtgacatgctttggggtagaatgtcctgaacccccaccaatggagtccttgtatttgaaggtcagaggcttggatttattcatatgggcataacaactttgaataaagaaaccatggcatatgcagatagcatctggagcgcttactcagtttaagctggggaagaaagtaatgaggaacttgataaaagagaataacagtactagagaaaagctatgaaggatacatgggcttattttcttggtgaaggaagatgatttttagcctgccaatgttttaatttattaaactaccagaagggagtactttagggaagaaataacaaagctcaacaaagggctatctttcacaagcaggccaccctgtgaactcaacctcttcagtgccaataaggaggactggtctcatgcttcaagattccaccttccccctgacacatctagcatgccgtagagttctctcttgcccattttagatgtgaaaatataaatttaaatttaaatttataacaaggaacaaattaaacaggaaaactcccattgctatgacaaaagaagcatcgagccctcaaagagctaaagagtagatcttggtttctttgctaaggagcttgtcttataaggctaagttgatgggggctttctagccactggtggccatggaattgccattggctggatccttacattcgggtctcaagccagggggctcgggcagtaatgtattatacctggggtggaggtgggagcctttggaagaatgcaggcccagcaagtctcctactcaaaggaaacatgcaaaacccagaccaaataaacacttctggctgtctggctctcttcacctctcagtagagaaggttgccttttctatggccctgcactttcaaaaaagatatagagagaaagttacaataataatacaagaaccagaacatagaactgttaatttaaaaaaagataaacagattgaagttatttagtcaagagaagagatgccaaaaggaacatcttaataatggctttttagcaaaaagtaaaaaataaaaataaaaaatgctgcagtgaaaatgcagatctatttttttccactgaggcaaaataagaaatagccagagttggcaacaagatatatttagattaggcatgaggaaagacttctcagttataagggatgtctattctaattataaagggtatatagcttgactgcttatacagtctggcttcaaggatattttgcctcttatttttaaaagcttaaataactattgattcttttctcccaaataaaaaggttcatgctttttgttcttttaaaaaaaaaatcacaacaaagaatccaacaaaattgatcaaatggcttccatagtgagtaattttcctgagtttttcccaaataaatattccttaaatctcccagaaaatagcagattccatcttaaatatttaaattttagaaaatgttatttttaatgagaaatgtatttgtctatgctaagaacttaaagatttaaagcatagcagactttttcctgtgtcatgtgtgcctcacctgtacacataatcacacacaatcacgcacacacacacaggcacactgactaaactttaagtactgtcaaaaaaaaaatttccaaccaatagaaaatgacaagtgcatttattgtatgtctgttttcacatccagtcttgcttgtatagttatttatgtaagatcttgtacttgaatattaacacataaaaataaatctggcttgaaatgttaagattcatgagggacatagatgctactaaaaatcataatcagtaccaaaattctcacctaaactagaatttctagtgcaagcagagcctcacacatgaatttgctaattgaattcttccctagactgtggatattaggcagctttggtttttatctctgatagataatcttggggaattgagatattactatagaagtggtcttttggagaaaattcatttttaatggtaaattattaaaaacggagctcttttataccacagtgacagtgtggaaacattggtagtttctatggtagcaatttctcattttatgtctttttcccagccactttattatttatacaggtttagtaataggtattaattcctaatacaaagtaaaaacaattcaggtttcacaccaagcattacatggtcataacccagtaactaccagatattgtgcctgcctttaaatatttacgatttagttgatattagctcatgctctctaagacttttcaggagaataaaccaaaagaaaatctaagcaagccggaggggaataaaaaataggaactgtgccgatgatagagagaggcagattactatgagatgacaactcacttcactcccccttacaaacagttgtgcaagtaccactgcttcctaagcactatcggagaagaaaagcatgtttgtattcagcctgattattccatccgcagatcttagcagtaaaaccttctcaagtctgaaagggagaacatttttcctattgtcagttccacgggggtagaattgaattcttccctttcatatctcattgttaagtaaattcaaaaagttttcctatataactacagtcttctgcaatattttatttaataattgattttatatacccccccaaaaaaagtttacttgctgggccatttctgcctctggcaatgatgtttccaaatgaggaatgatgcctctaagatggagcctcaagtgttggaagtttcaacttctgcagtcacttacagggcagatttgaagggggatgggtagaccctgtactgaaatacccacctagagagatgtctaatatttccacatgaatgctcattttcttgtcctcttcctgtatcatgaacatattccctggccatggaggaataaggcatcagcgttcttacacatccacaggaatgagttctatgtcccagaagagaggccagggaactggagaggagcccagggtgctgaagggagatctgatgcagggaggagttagggagcagacagtcctcaaaatttcctctgctgctgcttatcttctatggtgtgtggtagaaataaattagattgaataaatcttgagaaagcattaagccagaaaaaaataccaatacttatttcacccttactttcccttttctgttgtaaatttgaaatatttttaaaagtgtgaatgtaataacactgtaagacatgaaaaagctttttgttaaactgagaccatcaaaaacctacagagaacttaatctggaacagattctgggggatttaggagcccccccaccatttttttatttttatttttattttattttattttattttattttattttttgagatggagtcttgctctgtcacacaggctggagtgcagtggcatgatctcggctcactgcaacctccacctcccaggttcaagcgattctcctgcctcagcctcctgagtagttgggactacaggcacatgccaccacacccagctgatttttgtatttttagtagagactgggtttcaccatgttggccaggatggtctcgatttcttggcctcgtgatccgcctgcctcagcctcccaaagtgctgagattacaggcatgagtcaccatgcgcggccaggagctcccttttcataatgtgttttgccctgggaaggaaggacatgcccaagaagcctgccgcccactccctcccactccacccttcaagttactataccctggatcaggatttctcaacatcagcactattgacatttgggccaggtgtttcttttctaggggggctgtcctgtgtcttgtaggatgtttagcagcatccttactgtctgcccactagacgcaatagcaccccgcaccccttagttgtaacaaccaaaaatgtctccagatattgccaaatattcctgggaaaggtgtgagggccagggggaacagactgtatgcagctgagaatgattgatctagatgaaactttccaaactgagtttcctgtgtcactatgccccataaaaacgtggcctcttgggaactggtgcatgcactcctctctcttaaagattcctgctgcacagtagcatattaggatctctcaaagtccagcttgtctttgtttaaactcatgccaaatttatttaagtatgggacccctgtttttcactaatgtcaatcagtactttgtggaactctttgtctttgaaacactctggattgccttggactgatagagcctagtataatggacaatttggtttatattaattgttcatgtgctcaaaagtctctgaacatgagagttatcatttttgtgaacgtgtctcaagatcatgagagagaggtctttatatgaggaaaggcacattttattcctccaggaccttgaaaatttggggaaaagtcagagtgatagagaaaaggacagaggtgacagaaaagttcctaattagaacttcaaaggaaattgagggctggctggccctaccttcctttcccctccagaaaatcaagccaaaccaatcaatacaatgagagggagataaatggcaatacctggcctagagagccaccaaataaaattttcgggtcctatctactaattgggggcccctatgctgtatatacttctatgatactataatatgttagggtgaaagaactaaaatcatgcaaacaagctgaagtaaacaagcagcaattattgaaaaggaaagttgcatgaagtccagatttacaaagactagagctagaaagagaaaatttcaggagctgaagtgttgccttctcttctcccctcttgccttgtcttctctcgtcttcttttctctctttttgttctcctttctctccctccccttccctgccatcttcctgatggtttcagttctcataatttcagttagcacatgactttgtgactttgttgtgatctagggctgactttggccctgattctagatggctttttcccaaaatgacttgatcgttcatggccaaccaatggacgaggtggccttgcatcaaggtgtttgcctctggtccagtcatctgaagccaaggaaagatggggcaggcaaaaaataaatcagagggtcacctagactactcattcagcagtctgtaaggacaaaggcagctcttaaagaactcatgggagagacagaaacctcaaaacatagctattgccacctatgctgtgtatagtttaagcagtagtagtcacataaacaaaaacaataataatagcattattgagtggttgagtgctaacaacaaatatgtcaggtacttttctaaatgttttttggtaatacactcatcttattctcaaaacaagtctatgggttagatatagttatatgttgtatttttcagatgaggaaacagaggactgaagttcagttcccaaaatcaagcagttgatagatggtgtagccaggattcaaacctacacatctggctcacagtctatgctcttagttaatctgctgagctccctttctgaaaaaaaaattaatcataataattagaatgtaaaaaatataacttcaggaaagtagatgcctagattttggcaaactgttctgggtgggcttgcatttcagaagtatcaaccaatgttgaaggaagcctgcctttggttatagaccaatcatgtcatttgtctctgacgttccatgcccaagatggatgtattcttcaagagctcactagtaatttactccacttagagtttgtctgtttgtctgttgcttggagccaagagcctaagcccagcagttgtccactacaatccagagctggggcctggctgctcaccaaaagtgtcttgcagcggcactgcctctacctccattatataagatagtggggccaggcacagtggctcaagcctgaaattccagcactttaggaggccgaggtgggtggatcacctgaggtcgggagtttgagaccagcctggccagcatggtgaaaccccatctctactaaaaatacaaaaactagccaagcaggtgcctctgattctagctactcaggaggctgaggcaggggattcacttgaacccgggaggcagaggttgcagtgagccaagatcaccactgcactccagcctggacaacagagcaggacactatatcaaaaaaaggggggagggggattctgcctgtctcctcacttccagtcagtctgtccatctgtgttataagatgtacctctcttctttattggtaaaccaaaagaatggtttgatccctttaaaaatagtagagtattctgagccagagtgttggaatacgcatctaagataatccgtgaccctacgcagatcatttatactccccatagcttgctctattattaataggtggccattaaagcctctttctgaagacttctgccactcaggtgttatttcagaatcaggaaactcaaacctttaacatttttctgacatttatttgagtgaagaaaaagcctgacaatctctttttctatgttctacatttttgctcagaataatattaatagtctgtcttttagaaatatttttcttactaaataccagccaatactttttatatgtgtattttgtctgattttctaagtgcagtggttttgccacacactaaaatgtggatggatcaaccatcttctttaactagggagtcaaggggttctgcttgctaccacagcacctatctggcttcaatagatgtaatcttaggctgtacatttgagttgcgttcaattgggaacaaaaattaccttaaatgttcttccttatctatttaattaaactcaattcaacagacatttattggaccacctgaaacatgaaaaaacactatgatattaaccttagtaaactcaaagaatagtgaaacaaagccctgccagaaaggggcttattgtctagttgggctgaagggatagaggaggagacagactaaaataagagttagagtaagcagccccaagttccatattaagattgatctcataacatggggaataatatacatgttataaaatcagcatagccatgctgcttgagttgaaaggaaacagcagtaagattcaattagaaataaataggaaatgcttcattagaggccactgtgcaggaaatatagttaggagaaccagatgttcaaaatatatgaagaaagacacagaaataagaatacacatggcaagtttagaaaataatgtgaaggttgattgggctcaacagcatgtttggcgtgagtagaagatgagcaagaaatagttgaccaggggcatttctggaaagcccaaggatgtagtgagtggcaaagagcaagatagtggtgtactggggagttttggggagtagacaggagtatcagggtttgaattctggagctgctacttactagttgtatgacgttgcttgcatgagagattctctttgagcttcagtttcctcctcagtaaaattgggaagggaaaataagagaatctacttcaccaggttattgcaataattgcctcagctaaaccattttaagttctttgtagacactcagtaagtatttattaataagtactcataataagtactctaaatttgttgactaatctttgtcctagagtcttgaagtggacatttttgacagaaaatttcccagtggaccaaaacaaagctgggtgtcagtaattcataactcactgaatcactgaacctaaacccaacttggctttatgatctgaatatattaactttgtcagttaaggatgtaaagaaaaatttaagacatgtggctccctcaacttgaaattcttgatacagttaatgaatgttcctccaaaaaaggttgtgggtgggagagaacagagccaagaaaatccatttacttacagcttttggtggtatgtaactagcaattcactcaaacgatatcagaggtactatccccagttctgtaagaccaacttcgtatttgtggacatattttatgtataaacatcctaaggactctaaacatataccaaacactcagttaatcctcatggattattcaatagataagaatattattttactgtctgtgctttagctatctgttatataatgctctactttttatgcagtctttgttatttaattttatttttcaattgagaaataatattgtatatacttacagtttacaacatgatttttaatatatgtatacactttgaaatgactaaatcaagataattaacatatcctttacctcatattgtttttttgtagcaagaacatttaaaatctgctctcagtaattttcaagtaggcagtacattgtttttaatcatagttaccattacccacaatagatctcctgagtttattcctcctgtctaactgaaatgttgtatgctctgaccaacatctccccatatccctctcaccagtccctagtaaccacaattctactctctgcttctatgttctcaaatttttcaaattccatgtaaaagtgagatcatgcggtatttgctttctatgcctggtttatttcacttaacatagtgtcctccagtttcatccatgttttggcaaatgactagatttccttcttttttaaggcttaataatatttcattgggtatataggacacctttctttctttctttttctttttctttttttttttttttttttgagatggaatctcactctgtcacccaggctggagtgcagtgtctcaatcttggctcactgcaacctcagcctcctgggttgaagtgattctcctgcctcaaccccccaagtagctgggattacaggcacccaccaccactcctggctaatttttgtatttttagtagagacggggttccaccatgttggccaagctggtctcaaactcctgacctcaagcaatccacctgcctctgcctcccaaagtgctgggattacagatgtgagccaccgcgcccagccaggacacatttctttatccatttacctgttgatggacacttaggttgattctgtatcttgatgattgtgaataatgcttcagtaaacttgagagtgcagatatctcttccacatactgatttcatttcctttagaaatagaagtagaattgctagatcatgcgataattctaggtttatttttttgaggagccacagaatattctgttttccataatggctgtaataacattcccaccaatagtgtacatgggctcccttttctccacatcctcaccagtactaattatcttttgtctttttggtaatagccatcttaacaggtgtgaggtgatgtctcattacagttttaattttcatttccctgatgattagtgatgctaagcctttctttatatacctgccagtcatttgtgtgtcttcttttgagaaatttttttaatcctttgcccatttgttgcagtttttaaaatttcaacttaaattttagatacagagggtacatatgcaggtttgttacatgggtatattgcacacaggtaatgagtatagtacccaataggtagtttttcaacccaaatttgcctttctccctgccctagtagtctgcagtgtctactgttcccaagtttatgttcatgtgtgctcagtgtttagctcccacttataagtgagaacacacagtatttggttttttgttcctgcattagttcacttaggattattcttttgcccacttttatttgttttattgctagtgggtcatttgagttatacaatatttaaataaaagagaaccataaacagtttttgtcttaggggataattttttaacacaatggtttccttttcaggtcaagatgagctcagaaaaaaaggtattgaaataattcaatcatagtttactaaatgagaacattttgctaatactttatgggttacatgaataacattcaacttgggagatttttatagtattgttcattttgatttctttttctaaagaatattaatgtcaaaacaagttttcttatagttcatcttctaatcattacacaccataacatgctcacttgagatctacccatcatttttataacaatttccaatgcagctgagatgtgaactcatgacagatttttttagttttttgagattgaagaacagatttcaaaataacacactgaactaatcacaggaaactaggaagcagaaatagcaatttttctgaacagaaattaatattggaactatcaagtcagtaattttatttgaaagtgaaaactagggtcaccaaaatcccacttagaggtcgtcacctcacactgaagactaagataaaagcgcctcttaagtgggtcgccatccgcatcctagttgtgggcactctgtccttccagaccccacagcctattgtcatcaacagcacatctctggcactgtgattagctcaatgtgctatttttaaatctactattcatgctcagagctctcacgcaggtggaagacccttgccttcccttcccagagctatgcagtattcttctctctcaccctccttccactcgcataccacacacacaccttcaacacttcgacctcccttatggggtgagcaactgctgtcttggtttgcctacaactgaaggatatcttgggatatggaatttttggtactaaacccaggacattgggtcacatacgtgaggagtgatgagggtgagatagtgagggacctctggctgttcctcatcttattccttttttttccttttgttccctaaaaaaattattcatataaacaaggaagagaggatccttttactgttcaattagttcttctcaaaaatttatcattttagggcatggttttcttaatctattaaccattttctgaaaaacatcctaagatttataaatcataaaaatgtttatgtttatttgataatatgtagcagaaatagatggacctactgttgaaaattctctctcagtaaaacattagcacctcttaataaagggaataattgagtgatttttttctcagaaaggtgtctaaataagtatacccaacattctggataagaatgttctcatgtagcatcctgtaaatcagtgagaaggaaacagaggcaagataatatatatggagccttggaaatctagatgagcttacagatggatctcttcaatccaaatctgtcaactcagtaaagatgtttataaaaatcagtcaaaacagctgccaggcatctgaatcacttaattaaatgctttatatctcaactagtttttgcatcttgtaataatgtccctaagaagccaacatcatcagaatagatccacaaatattcatttatgcattcaaatatttcttaattgagtatccagtatgtgccacttgctcttctagacatgttctaagaaatatggcctcagttcctgggcttaaggagtatataatacactggggatacaaaacagaaaacaataacccattaaatacataaccagagctcataaaggctttgggagaaaataaatatgttcaacagcagggttaaaaaacaaagtgggcttgttgaaatctaaaggttggcaggcaccatccaggcaggagtgaaggattgttctgggtagaaagaacaacttgtgtgagggaggagcttgcttagtagttctaggaatctgagggagatgcaatgggaaccttgtgggcaaagggcagctgctgctgaaggtgacagtcattaattgtagagaattttgtaagccaagacaaaggctttgcattttatatgaaaggtaatgagaagctacagaagagttttacacttaggaacttagatatgcagtccatttaatgttgcataaagattactctatctacctttgtgaaaacgacataagaatgagagaaaaatagcagagagccagaagaggctgcatctgagcatcaggtggatccagaattgttctcctcaactgtcaagaggtgggggattgagagctgaggctgagtgtctgcttgcttacccctttgccttcaggggtccaccctcattcatcccaggaactaccagagatggtgataaactgctctgcccccactgaattttattggtttgggacacaaaactgactttaaaaggttaattagtattactgctgcaaggaatcagctcatgaaaagttatactgcattaaaaactagcaggcttacattatttatggaaaacagctgttgaaaattgtctgctaaagcttcatttcttcccatttcccttctctctatctggcactttattataatttctagaagttggtgtactttttaactatgatcattatttctgatcatacagttggtgatgtaaacagtggtacctaatgactccctaagcctcaaattatattaaaagacaatgagcaatatctaagggctaccaacaacactaatattccttagaatttttcatttaattatttgaagagaaaaacttgtaattgtgaaggtttgaaatcctctttatataatatttctaagggaaagataagagttgtagtttgctgaaaatctgttcaattagttcttctcaaaaatttatcattttagggcatggttttcttaatctattaaccattttctgaaaaacgtcctaagatttataaatcataaaaatgtttatgtttatttgataatatgtagcagaaatagatggacctactgttgaaaattctctctcagtaaaacattagcacctcttaataaagggaataattgagtgatttttttctcagaaaggtgtctcagataagagttgtagttgctaagaacaatgatgtgctccaacaagtttctcattaccatggtgacttctcttcttttaagttcaacaaatcatcctttatacttgatagatgtttagacagagtcaacacttagaggctgcatctaaaaaataaaaatgcctcacaaaacattgacacaaggaattaaattttataaaactggctaactttgggcccactggggcatgagggggaggatttataggtgtttcagtagtacttagtgattctttattagccatgtggaaatgctaaaagttttacaacccgaattctgtagttttaatttgtggcaaatatccttggactaagtcccactgagattctcaaatatttcaactatgacaagcttcaaatttttttcagaaaatatgacttgttcatatctcactttggaaaactgtttgatttgtttatactacaaatcggagaagcaagtcatctcttattttgtgatgaattgtttttgtcatgtgttctcctatgacttagagatcctagagatttctacaaacaacagcttttagcctaatctaggtgacaatgagacaaacacaataagaattttaaataaattcagtgtctcacaacagaatcacatcaatctagagaaatgagaaaatgggtcaagtagataagaaaatctaacttcctactgttggaaaataaactatttaaagatcatgatataagtaatatgaataccagctcaaccatactctgtatttttctttaacattacatactttattgcttccattaattgaattttctacgattctattgaatttaccagtctatattgttttaattaagcatattggtataaatttgcagtcatttataggtgaccaatacaaatttttttttcacttgttttcgcaaaagatagataattctggactcacagatctctagacactgttcctggtcataacaggtattcaagaaacattggttcccattcctatacctaacaccttctgcacattacaggaagaaaaacatgtgatccttgaaaaacttagtctggagaataaatacatgaaaaggagggaaaatagaaaaattacatgctaagaaatgtgtactgcttgagaactctttaagcaacaaaagtgttgtctctattaaaagcagacaggtgaggttacctgagaagaaacccgtgttttcatgttcatctctttaacatggggcaggtccttaggtacaaaacagatctgaacttcttgctttctgttactcttaatttaactggctaaatcagtaatatgactttgcttttagacagttatactagacagatattttattgagtactctttgaatttagaaaaacaagggtactaaaatatgcccagtgatgtaggaactatgtgcagttggaaggactctttgccaaaactctaaggaatcttgtggattccttacaatgtgtttcataattgctacctgggttacatttgtactaaaatcctttcttcataggaatgatcttagagttaaataattttctattagtcttttaactacctcctctctataaatttttaaagaaaattcacttaaattacttttagtatgggagattgtaagcagaaggccccatagattttggatctgtggtagcatgggaaattttcttttctttctttaaataagccttattttagaaaaacaaatctctagctagctagctacatagatagatagaagtagacagagatatagatataggtatggagtagactctaatatgtctctatgtatatctatgaggaaaagtaattcttagtctaattcctatggaaattagacattagaataaatgctaatatacctagcacagttctctactctgcaggtgcccataagctctttattttttattcattaattcttcactcaaccacccaggatttattaaacattctgtgccaggcactctgctgggtgttagagatataaagataagtaagacttggtccctgtatttaaagactcacaaagcatcctaaggctagctccaattccttaagtcatgcgtatagaagtatagagagatcactatgattatataattaatcagtcctataaaccatattttaaaatcctaacctcataaatgctgacccataacagaggttcctcataactagctgtaaaaccataaaccagtcctttaatttctcaatgcattaagaagtttgatttgtaaaatgtggtactgaaactaagatcccttttatatttgtaggattgatctgaaagtgactactgattgaatgccatgttgatgtggatgaagagaggagttgaaagcttgtcagttaaccaacagaaaaaaattaaagttcggtggaataagaccaaatggacaatgaactgcccactccctaaacctcccacaggcacataaagtgactgccaaaaagtgcactctcagttgtctgggcacatggaaatatctggcacagtctcttatccattaaaatcctaaatatattaattaagaaccttgtctttggaattgcagaaccaacttcatgtgtttcatgtggctttaaactgcaaaattgtcaatttataagcttgcagttgtgccaatggaatacataaagtacataaagtacaatggagtatataaagtacaatgtacataaagtacataaagtacaatggagtacataaagtactctagtttgaaccagaagttttattaaactattggatagaagaaaatggtccaagataagaacatgcaaaatccagaacatgaaaaatgctcattttacccaggataatttaaaacgtatacaatttgttagatataattgttgatgaaattaataaagaatatcaaaaagcccattaggtagatatttgttaatattaaacacagtcttatgacaggaaatatcaagaacaaggactgcattttattcattttttgtttagatgaaacttacataatttaacttttctttattccataactgtcaggaagcttagtgtaagatttgatgctcattcctagtaactggtaactatttgtgctctcctccttttcttacatttgatgttattgtttagtgtttgtcccactttatgaatgaccattttttaagctttcttaagtcatctttgcagaggtcatatttaataaaaaaaaaagtctgcctttgtctcatcatagagctgaacagtgttccttatgtggagtaggagcttaacacatatttgccacattgttaattcattgtgaaggatttcataaataaacctagagaaaaagatatccactaacgtattaaatattttttaaaagcaagttcatctgaaaggagcaactatgtcttattatcttaaaacttcaaaggaagtttttctttaaatgtaaaacatacctcttaattccagaaagactgatccttcatttggcttttgtgcattttagccagtcttggctttctaaatcatgttgaaaacaaacagaccatttgtgccatgtttgctgttaactaagtaataaaccaagaggatttagctaattttttgaggtcattaacatgatgaagttaatcacctgagttaagacatatggacattttaccaaaaaaaaaaaaaaaaaaaaccgctcaaatggtccttgaaataaggttaaatagatctaatttatgttaaactttaattaaccatatgcactactgcgtgataatgtgcatgcatatgttgcttacattaattgctttcataagttaattactgcaacacactttggcttctgttcatttaaaacttaacaaatgttcgcaccagctgtggaagtgattgaaggcaataaatgaacgagtaaaccattggtttacttgtttaaattaaatctgctatctcaagctgtcctgtgtcttaatacattagaaaagacacttgggaatcaatgatcatgtaattcctattttaatcactgttagtcatacttaaagtaatagggacattgaacttttacgtttgttggctgacctctgctttctatagtttactgggccatcattgactatggtttacttttattacagcagaattgagctacagtttcatataattagatatttgtctggtccttgtataaaagcatacagactctgtcatgcctgatgtcttttattgcccactttaactggatactaaagtttgtgtttaaagagatgatttatatagacaaagaacttcttctaaaaaataatagaattctattttattgaaactaaagtttacttttttattacatcatttgtctctctgaatctgtagcatgttggccaatatagtatgataataaattactactagaatacctcatatgaaaacttatatttttcttgactattaatttgaatcacttttttaagaatcaaatttcaggatatctggttaatgatggtgggttgaacacatacattagcctctgagccccttctgaaaccacatcaaaatgaatataaagaggtcttttaaagatcctaaatcactaggacacaagaaataaaagagaacacaaacaaccctggaaagcatatggacaagtggtaactgacttagcagaacctagaaagttaaatcctaagtcagcaggtgggaaagccaagaaacctgatttatattgcagaccaaaaggcgaggaactagtggctccaggcacctctggaagtggaagcgaagtgaggctaaaacaaaagccttcttgtaaatttccttaagaggcatttagacacccagggccccttcccaactctgcatgcgaggtaattgcctcacactttgcctcacactttggcaaaaattggaggacgattctctggaaggcctgccagagagagcttccagattgtagtccccaaaggctagagttgagggaggaatactggactgaaaacaggcaggtaaaatgaaagttaatacattacaggtaagctctccctcacttgactcccaaaaacccaccaggcactggaagagccttctctcaggaatctgcagcccaagaataaacacctgactgcatagaaataagggcagaggggatgtggggagttcctcatgaaaagacccagccagattgccctaaagcccatctagctaacagagcttccaattagcatctactcttctcagtagctggcttatctgaggatggagtttacaaggtcttaataatagaaacattgaatatgaattataaatctgtcgggtgagtgagagctgggacatggaaaatatgtgtgtttgtgtgtgtgtgcgtgtgtgcgtgtgtgtgtgcatgtgtgtgatgagcgtggcagggaaataaggagaaagggagctacatcctcatcttcctaataggaagacaatagatgaggcctaagcctgaataactgagaagcagcaaataggcatcttatttagattttcttttttaaatcagttagacctgaaagcagttgacttgggagcaggaaactatgtgcctctctcaatgatatgcatgtatcactttgacaaaaataaacacttaatttaaaattataatagatgcttacatagttttcattttaaaaacaaactttaaagagagtaagagaaagctgttattctttttttaatcaatttcccatacttgttattttataacttattttcatgtagatcctcctgattatctgctattttaagacctacatagcctaggaattagcatttttggacgccttgtcctacatcatctcatatacggtagcttaaaatgcatctatatcctgcataaattatatgtggtataaaattaaagagagtttttgtaatgttgctttttgaactattatcacttcaagaaactcatctactttatgacttacttgttagcattgtcagcttttctgtgctgtattttatactaaaactgtttctgaaaatgcctgaaaaatgtttcttgaaaattcatttaacattgtctttctcaactaagaatatatctgccaattgactatgatttttataaaacattaattatgttgctttaaaacaggtttgaacataaaaaacaaattcaatgtcattctagagtaataaccctcaagaaaataccaggacaggagaaaaatctgaatttttaataagccaatatattttggagtatgataaattaaaatcaccttcagatgctgagattaaaaaaattctggacagaacttaccatgttaaggatttaaaagttttaattacattaggatttaccttaagagatattatgataactatagataagagccaaaaggagacccatgagattagcctttcctggccggaatgttttatctctctgcatctgattagtttctatcatctgttgaaggattatgcctttgcttctgtcgggatgccatccataattcttacaggatgaacttcccagtctgttggcggtggaggggatgagggaggttaggaggcagcaccctttttcttctggagatttgcaccttgcttctaaccatatcgtgtttgctcagtctctgctctgagtacttattaatgatctgtcatctgtcacaggtaattcattctacttgattgtttcaaattagctctagtgagttgaccattacttatcttccactccataaacctaaatcttgagatccttaaaaaataagtaaaaatcatgctgcaaaaatacaatgtataaatcaattgcatttctttgacttataaattgttactttctttaatttgattacactgaggtcatgtgtctcctcctaataataatagtagccatttggtagaggattttatagtttacctttgcattcacaaatactgatttatcattactatgagccgataattattctagttttaggcaaggtccctgatctcatagaatttttttcttgaaagaggctatacaaacaataaacaagcaaataaatgtaattaaacaagtaaacaaataaatgtacaccatctctgagcccaggagttaaaggctgcaatgagctatgatcatactactacactccagcctgggcaacaaagggagatgctatctgtaaataacaataagaagaagagataaaaactgggtgtttaaggaataaaggcatgtcagaggcatgaagatcctactttagcttgagttacggggtttctctgagaaggtagcatttgaaatgaaggcagataatctgctgaacatacatctagggacagagtgttccatgcagagccaatagaaaggccctaaattaattatggcaacctatatatatcaatgatgatggtgatgatgactgatgatgacaacaatgataatgataaaaaggaagataatgatgttgatgacggtggtggtggtaatgatgataatggtgatgatggtggtgatggtggtgatgacagtggtgatagtgtgataacagtggtggtggtggtgatatcctacatttataagtgtagctcaataaaactaaataaaatgcccacggtcacacaattagtaaattatatagatccctagacaaaattatttagtgacaatgagatttcaaaggtgatctgaactttggccttttggctgttatatcagaagtgctttagataattgccatatctttgcaggaatcccctaatttcaaaattcatctttaagtgtttcctaaattatagggactaatcctatgctgaaggaatcctagtactccatcttggtaacaggaggctctttctcttttgtctgggctctcatagctcagctatgttttttcactccactgatcaacaatgtcagtcaactctgaaagcttggttttaagcatctcacttcttattcttgcaacagtcactttagtgtccccaatcccactaaatctttggcccactgaaacctctaatacagtgacactgacaatacccatcacctcactcaggtacttactttcttcttttaactagtacaaattccatgtaccttcactatgacactcccttgcaatgaatccgctttctcaacaaaacttccaactttaactgaatccatatattggccttgttctatcttttttttttttttttttttttttgagatggagtttcgctcttgtcaccaggctggagtgcaatggcgtgatcttggctcgctgcaacctccacctcccaggttcaagcgattctcctgcctcagcctcccaagtagctgagattacaggtgcccaccaccacgcccagctaatttttgtatttttagtagagatggggtttcaccacgttggccaggctgatctcaaactcctgacctcaggtgatccacccacctcagcctcccaaagtgctgggattacaggcgtgagccacctcaaccaaccagcgttgtcctatctttgtcttgtgcctgagaaactaaacattgggaaaatcacataatcatgctgactggtatccctttaaatttatgaccatatgtctcaaatgggtcctcattcccctgctaagcatactgccggcactcagaagcagctgcatcaaatcttctcttctttgcatgattagttgtttcttttatcttgtatcattctcaccagctttttgacatgatctaatatatccctttaaaaacaaaacaaacaccttggctctgttatccccatccagcttatgcctatttctctgttcctctttatagcaaaacctctcaaagggacggtctccacttccttcatctcccattcactgtaattcattcctactgaggttccactctcatcttttcaatgaaacggtttttgccaaattcaaaatcctcactgtaccaaattcaatgacatctcatctgccctcctctcactctacctcaaagcagtattccatgctttggatccagcattccagatcagcctccttgaaactttcttttcttgcattctaagactcaacactctccaggttttctcttccctcctaggagaacccttctcagccttcttaataatttcccttaaatggtctcagtcaatgctatgtcttcaaatcccatctcttctggtaatgcccttttttatttgcttctctgatctccagactcccaactagaagcctctctgacatttccacttacttgtctgagagtcttctcaaacttggcacagccaaaacagagtcaaccagagtcttgatgtcacccaaaaaatcagagaaataatttccttaatcatctcatctgaaataacctacccacctattctctatcccattattcatttttgttttcttcatgtcactatcagaaatttttactcacttttttattttcttgtgcctgatctactttcccaccagaatgaaagctctgtgggggcaaggacaaggagctcatctgacttattctggctttagtctcagagcacaatacgatgcctgattcatagcaaacactcagtaaatatttattataaaattaattagaaaatgaatgaaagaaaaattaaacacttcaactttaacattaaatttaattcaaagatctaagtgaggggttttcctaaaatgaggaaaggtagcatagaattagatgttgtattaaaatgcatcacatgcaaagttttaaatatataaatgtatcatttttccaatctcttacaactgaaattataaccacagaaaatattatattttgtattctataattcagttatctgatttttaaaattaattaatctacttaactcattaaaatataaatgctgtaacaaattcttggcttttgtcaaaatctgtttcttgcctccgtcttccacatgtaattcaatttctctgagccttggttttctcatctttgggcttgatgacttccagttttcaaattctctgactctgtcttaacattatcatcatacagatgtgttcttgttcatggatttgcttgtctctgtaattttctcacattttcatttgtgtattttgcataattgagatagaactgcggctgtaactgtaactggagctatatgcgtctccagagagctgagagtacaaacaaaatagctaacttataaaaacaactattcatattgataaattacacatatgagctgaggatttaaaagagtaaagtaaaattttattgtagtaatttacaaataatgctctataaaaaggaattagtgctttacgaacccagagatgctttaaaattctttaatagtcactctctcctcaatttttttggatctccagggaaagcaggacttgctcctgtgtgatattctgtaagtcctggacaaattcagctgccaactgaagtccattttacttcaggcaaagaactatgtcttcctttgcttgaaccagcaagaatctgccctgagggacaggataacaaagcttcacaggcatgcacccaccagaaccacatttaaaggaaagttatgcttgcctctaccacagaaccatatgtctgtaaaatatagcacacattaccaaaataaatataattttgatcaagttaaagtatgtttcaataaaaagtaattttcttttcttctataagccttttaataattctttcctatatcagtttggctatgtaaaagcaggtggattgtgcatcctctcccaaaatgaagaacaaaattgaacaatcagccacacaaagaagtcctcagaaagctgcatgctctcaaatttgccaattaacaagagaaaaatgtgtgttactcttttaagttctctgttattatgcatgtgtaaacctcattttaaagtaaaattttttttattttaatacataaaatcaatacagggttaaagataatgggagtttttatttaagttctacataaaggtccaaatatatttatgtagaccccaagttttctcaatagtctatcaccctaatttgaccatgatggagttaatactggctatgtagtcaaaaggctttataacttacaattgggaaatgtgagcatatcactcactctttctaagtctgtttttatcatgttcaagaagtatcaccctgccctgaccaccttacaaggttgttctgatgaaatgagatgatgccagattaaaatacttggcatacaaatgaaaagttggatttcttgagcagagagcactgtgtccctagtaactaattaattcattaattaagacattaatttaataaactaaagcatttcctgaggcactggggcttcaagaataagtaggacaaaaaaatagattcatggttgcctaagcctgggaggtaggaatgggagtggaggcaaatgatcaggggacttctatttggagtgatagaaatgatttcataagatgtggtactagttgcacaattctgtaaatgtactaatatcataaaattgtacgtttatttatttatttttcttgagatggagtctcgctctgtcacccagactggagtgcagtggcatgatctccgcccactgcaacctccaactcctgggttcaagcaattttcctgcctcagcctcccaagtagctgagactacaggcatgcaccaccacacccggctaattcttgtattttttttttagtagagatggggtttcaccatgttggttaggctggtctcaaactcctgacctcaagcaatctccctgccttggcctcccgaagtgctgggattacaggcacgagtcaccacgcccagcaaattgtacatttaaaaccattgaattttatgatatgtatattatacctcaagaaagcttttttaaaaaaataaagcatggttcctaccatcaagaagcttatagtcaaatggggaaaactgacatataaacaaaagaaggctacagtatgctagagaaatgtggatgttgttgttgttggcctaaagttatacataattgaaacttcaagtgatttaagtattttaaaagaaacgttaaatacttctaacattagtaatactgtttcagacctagaacagatttcgtgctctattgtaagacatacaatatctaaaacttgcaaaaactcattaaccctgtaccacacttgtcatatatgagactgtattttaagaaacaaggccttgacatgccttgtctggaaatgttgccaatattgtcaatttgatgttcgttgagcattacagaacgctcagtgcttttggcgagcgggtggaagctgggttgaggaggagcgtctgtgccctggcacacttgattgcttgaacccagtccctcagggacactagctggcagggctcccgggtcatcacaaagcaagcaggacagaaggggtaggcagagcagagactgccaacccaccacagctgggggctctccttccactcggagtaagtctgcaattccagcccatgcgttctttctccagagacacttttctgctttagggaaatgcaaaggacacccttactctgggtttgaaattggatttccaactctgtcaagcatcctttatttccagaagttgtcctagtttaaatcctaagcctccaaactttttcttcaacgtacaaacaggtcctccttggagagacacctctccactaagcacctgcctccctgaacatgtattgtatattgttttcttccagcctattccatacacctcagaggagagaagcctcatgtatgcttccgcactgattaatttatgcagtctttcactcactcaacacatacttgtcaggccttattatctacttaaacttgatgcaagcctgcaaatcagagagtatctctggtatagaccacataaacctacctacacatctcccaactgagctggtatttggcccctggctgccccatgagaacatgttcccttagcagagagtaggcatttctttcttttcacgtctatgaagatgagtaaaatgtaaaaatgggtagaaagattaatagcaaccatcatttacccattggttttctctgttttgtaactaaatgtgaaggcagcacataaaaaacgtttattctccatggtgtctttctctctgagtcattttaaggtttgaaagaaatattcattcttcttaaaatgcctctctgggccctagttttctctcttataaaatgaggttgttgtattcacaacctccaagcactctttaagcttgaacattctttgatgttctgaatcatacccaaaattcagccctttatttcccattgagaggtagagatttgaagcagaaccagaaagggcctgcctattcccaaaaagaagatttaataatttgacaatgtctaccaaaggaaactgaatcattatgcattattatcattatgcattattattgagacggttattatttcagccaaattattaacatttcagcaggaaacttttttgcctggctctgatacttgttttcatgcccaggacaggtgttgcctaacctggcctgaatcatatctgactttagagtctccccagccctactcatgccccagcaagggctgcaacagtcatgtccagtcactggtgatgcgatcactgggacaataggaagacaggcccagtgtgactaggattctgggatgctaccagctgtcagtcaacactaccagatgcggacagagatggctttaatgtgtatgtcctagtaaaccgttttcgtcagaataataaagaccgctaagacaaatcacttcgattgcttaataatctgcttgctctacaaagaagcagtatcaggtagcaattaagcacaaggattctgaatttgagtctacctgtgtttgagtcatggcttctgcacgtactagctctgtaactcttagccttagtgttccctgttggtaaagggggaataacagtaaagttgttttaacgattaaataaggtaatacatgcaaagtatttagagaaatagctggcatatgataacctgcgttaattatctgtatgctgtaactccctgtgggaaaaaaatttaaattaaacttaagtcataaagaaaaaaattagatgactgaaaaaaaatacggcataatatgaaggacattagtgtcgagtggggtcttattaaacaaagattcagaaatccctgttccataagatggtcatcagaccgaaatgtttataaagtacctagactaagatagatctcagtgagtattaatttcctttccctgtctaatatcctcaattttatttcttttgccttctttttaaatttatttttctgtttattttttaaccttgcttccttctatctgcatgcataggatgggtgttgcctaacctggcctgaatcttatctgtctggagagtctccccagccctgctcatcttccttccttccttccttctttccttccttccttccttcctttcttccttccttcttttcttccttccttctttcctccttccttccttcctcctttcctccttccctccctcccttctttccttcctccttccctccctctcttcattccttccttccttcttccttccctccttccctccctcccttctttccttcctttttctctccctcccttccttccttcctccttccctccttcctttccttcttccctccctccttccttcctccttccctccctcccttccttcctcccttaattccttccttcctgacttcctcccctccctcctcccttccccacccgcacctccctccccatctctttctttctttctttctttctttctttctttctttctttctttctttctttctttctttctttctttctttctttctttcttttctccctcaactactgattgctggtttccttctccatgccaggcactctgtggctccttgggataaagttgggaaacaaaccaacattgttctgaccctcttatagtctaatgcggggaaaagttattcatcagattacctcattaatgaatgtgtaaatacaactttagataagtgttctgagcaaacacaatgttgttttgtaagggcatatgtctgaaacaccatgcctgtgagaggctgtgagagagtttacccaacccataagtggggaagggcattttctgctaaagcagtaactcctacagagaacctgtggcctgagctgccattttaagaatgtgactgaagctcagggaggcaggtaacagaggtgctaaggctctctactggagagatttcagagaaatagaacaatatctagcaaaaagttgctttgccttatatataaccaaacagtattttatgatttatttctaaataagagtttattttccatttacagaatcacacattttaaatgttattcactgacctgtagtatccaaattaaacctatttctcttattctgcataaattaatgttaatattatcagtaattgcccccatacataccaaacatgcatcgagaattgtatgattactctatgtaaaaattgagacgtggaatcattcttgacaccttagctccgtacctgccaagtagacataaggaggctcaaaaatatatgctacagataaaaaattaaagagactgacagataaaagaattaaagaaagcataacctcagtggcagagaaattctgctttcagtatactaatttacttttaacttttcagattattttgggaaaatttgaatacagaagtgaagcttcaaaaatatctgagccttctgagcagaaatacaggtttctttagaatagtttttcctcccgtgttcactgtggtgctatggggactctacggtgatatggaatgactgcggtaggggcagtgtctaaacctaacaagtccagtttaatttgccaaaaagtttctcactttgaccttggcctgcatctacctggataagcctatttggctgatttcaggaagaaaaatggctgtagtttttaatgaaaaatcacctttttgaagtttgtctttcactttatgccgtatttggcatacttggctagattacacaaactgtttaaacttacaaagctgaactgctctgaggggagatttggaaattaaataatcgatttttttatccttttcatgatcataccattgatgcaactaaaggcaattcaacattaaaacaaacacaatttctttttatttactacttaaatgtagcctgcactgttagtaatacatgttattttctcacccttttttaaattaaatgtgtggttcaaccatttttcaaaagcatccgcctcttatactgtcgctgaaagatgatcgtgcccttccttgtgccatacagaatctgcataaatatatcctaaactacaagctattgttgaggatctaccacttcagatagggaattgaacataaagaatttgctagtgtcaaatgaatgcaaagctggtctctctgtgatgaggcttatttttagttactaacaatttttgaagcctaaattacagaaaatagcaatcattctctagtgcattggctcttaaaattaatcaggcaactgggttaataatagcatatttttattaataacctacagaaacacctgtacttattcatcagaaatcttcaaaatgatattccagtcaagaagtgtcaaattatcatttgaaaattattgaataaattctaggagtagtttattactaagagtgagttaaataccttttcagcgcattcatttgaggagacacagtggcacagaggttaagagcaaaaggtactcagttagactacctagattgcaaccttagtttcaatagctactaactgcgtgatcttgaggaagttacttctctgggcatcagttttctcatctgtaaaatgggaatgatattagtaacacaaaatgactgctaagatttagctcctactttgcacaaggcactgtgcatgagcaagagagagaatgacagatagatattacatgcctagtactcttctaggatttaaccttcacaacagctgtataaggcagaaagtattatttccccctttttacagataaagacatttagaaaccaagaaggtaaacaacttgcctgaatttatcagagaaagtatcagagcctgaatttagacccagaatgtttagccccaaagtctgtcttcaaccactaatctacaatgcctgattcacacatcaacatatggctgttatttaatgagatgatatagataaaccacttagatcattgcatggttccagtaaatattcaatgagcattcattactattattagtttatgtattgtctcctttattgcattaaatacttaactttccactaagatttttttcttataccctcttttgccacattttgtgagatttggtaagattatcttggggtcaacacataataaaaggcatcacacattttttgtttctaataatttcatgcaccagagtgtcaaacaaatcaaggtcaattctttaaaaagtattcattcatttttttctacaaatacttattgagcacctactacatgcccgatattatttcaggacctattctaaggcattcagcagagaacaagacaaaggcctgtctctcacacaagttacctcctagtgaatcattttgtcattaactgaattcaaacttgagcctttaatcctgggaaatagtgctataaccaaaactgaaatcttccactgttaaacacttgagacattagcaggaagatgtttacacagcccacagccctctgtgtcactggcctttcctcatgggcttaagaaaactgcttcagagaaaacctctgaaaaacctgccaccaacctgtggcagcctacctcaaaccagcagctgaaggacagagcaaagacattccaggatctctgagaactgtatccataaataaagcccattcaaaaaggatgcactgatcatgtttttctccactggaacatgagtggatgtttcacaagtcacccattctcctcattgctgcgtggtgaaagccacaagttccaaaatagatgctgaggctttcaaattcctgaggacagaatttgattcttattcccttaagttatttttctcttgccctcatccttccaaaaaaaaattcatattctgctactatcgatatctcatgtgaaataattatattagtgaaggcttttcatatcagattatgtcctttgaacatacaaggaaaaaactcattgttataacaatatgatcattcaagatgctttttttagtcattttattatttgaagagaaatgagtttataaaaaaatataatttcctacaaatttaagggaaaagcatatgcttcttttttctttttcttttcttttttttattatactttaagttttagggtacatgtgcacaacgtgcacgttagttacatatgtatacatgtgccatgttggtgtgctgcacccagtaactcatcatttaacattaggtatatctccaaatgctatccctccccccaccccccaccccacgacaggccccggtgtgtgatgttccccttcctgtgtccatgttttttttttttttgagacagagtcttgctctgtcacccatgctggagtgcagtggtgcaatcttggctcactgcaacctctgtctcctgggttcaagtggttctcctgcctcagccttctgagtagctgggactacaagtgcaggccaccatgcctggctaatttttaaattttttagtagagacaggtttttgccatgttgacaggctggtctcgaacttctggcctcaagtgatctgcctgcctcggcctcccaaagtgctgggattacaggcatgagccactgctccccacctgatatatgtatacattgtggaatgattatatcaaacaaattaacatatccatttttctttattctgcaatactggtgtagaatattcttaagagactgagggggagaaaagaagtacatatattgaccgctcacaaattttaacatttaatctcatttaattctcataacaacactggaagtaagtacatgtaaccctcatttaaccaagtgaaaacagagattcgggagagccatgtaactgttccactttcactgacacagcagagccaggactagaccagctgtatccaaaggtcacgtcttctcacgaaccacagtattttacttcagcagaggtcatgcagatatccataagaccactgctgttcaagagaaaacagttccaaacggccttttatagaaccaattgctacatacatcacattcatattaacatgaaaaaccatctatatgtgttcctatagttcatcaaaaaactatcacaacaatgttaaagcaattatgcctctcggatgaagtgttacattttaaacaaattacttgatgattctattaaaaggaataaaaataatgtaattgacatagatgagattagcacctttccccattcattttatgatataccttttaaagacatcatcatcatcaaataatatttattacacgctgtaattcctagaagagcaggatttggactgaaaaacataactgagttacaagcaagacgtattgcttatttaatacatcatagactgctatagaagtgttatgtttttatgtaatggttaggaaaacctctgcattaatttgtagaaaaaaatagagaaaaatcaaaagcctacaaaaatttttgtacaactttgaatttaactatttcctctaagaagccaaagacacatttatttcttctctgccttaacattcaatctaattgaaaaagctaggagacaaggaaataaatatggatttgtttaatggtaaagtgcttgatatttctgttaattataacttgactattgaacaacttgcactcagaaatcttaaagtatctcaaatatttatctcatttacaacatatgggagaggaagattcctttctctttttcctcctatgataataaagaccggcaagggaatgtacagagagtttcacaatgagttgtgtaatcatgaccagtccccagacttttgagtctgatggtcttccagtctggcagtctcacaactcttcatattcctagcctttgcacttttaattttccaccagtgattattttaaccatatccctagatgactaacatccatatagcctttgaacctcagtattaaccgcagctgtatcattgagctcacagggccttctatgtaggctttcatggataatatttaataagatgatgtacagggggaaaaggtaaacaatttttctaacattgaaactaatatatatgcttcacttaacatgctatttctcctgagctttgaatatgaaataggcattgtttcacactacaaatttgaggtcaggcagtttttaatttactcttttcatgctaaatttggagtatctaaagttattatcatcatcaaaaaatatttattcaagctatactttatagaagaggggcagagtttggactgataaacataacggagatacaagcaagacttactgcttacttaataggtcattttccattttaactactttagaggtgttaagtccgttcttagccgctggtttgaaatatctaaagctcagcagaatatctctaatgaaataccaatggaagtgttgaagggtttcttactcttagtttgaaattcaattctgatagatataattgactgcaccacatccagaagtattatctgtttatctttgtgcatttcaaaaggcagaaaaaaagttgacttacctcataaagagatctcatggcatgtatctatatctctcagtccatcagtcaacatgtctatcaagaatggccatgtttattctgtcaaatattaaattatgagacttatgattgcagccaaagaggacatatctatttggaaagttatacagataagtgacatgaagatagagagtttatagttcatttttgttttactagaaacaattacagaatactttaactagaacgttggcttctgtacagtttagatacagtaaaaatatttttaaaaaacattttaaaaaacagtttcatgaaattcttagggatccacttataaaatgttgtggagagctactaatatgctgaagttttccagaacaacaagaaatcaattaacgtagcaccacatcagtttaaaaagcaatttatcaacttttcctaccaactcagggtcaaatttcattgtgtcaaaaacttaattttaaaataattgctggagtgaactttgattaacaatagcacaaatttgaaggagatgtgttaaggttccttgaggtcattcttatgagactaagaaagaaaaggaaaatatattggcttcacaaatggccaagatctttttaaaaccagctagcttacaaatccaactgacctgtcgttaccatacttcacagttaagaatcatgagaacaacttgttctgaatcttctggctgactccccaagcagagtgagcattgagtatcttctgtgattaacatataaactgttttattcagttttggcttcctttctctctgttccatgagagaaaggaaaagaaaaaaaaatctttttctttttaatggattcacagtcagtataaatttttcctctcaaggtatgtattataagaaaaaagaaagtggacattgattttatagtatttttctatacttaaacctatacccaagtaatgtatgttttatattttcaaaaaaattttccttaagttattttctatatatttcagtatttaggttatttgttgtactaatagattaacatatgccaagagttcattatcattttctttaaatagattaataaaggaaagcctgaaagagcttgaattttataaagagaagatgaagattttacatatgatgactttaattgatgttgacaatattatctccttgaaatttcttaggataggagggaagcatatttgtggatcaaaggaagttttaaacagcaaacaaatgcacatatactgtcttgttggagccccattctctctgaaaaacactttttttattttttcactcttttttggttagtattgttattggatcaaaatcaaagtagtgttccttgattggcaatgttcgtatttttttatattcattcaggaaacagcagaaaagaacacttatttttaactcattaaaattaaaactcagacacaacatctttggctttctcaaatggatgctgaaggctggaaagttgagtctggcttgcaactaatattaattttctacagcattatataaatcatctgcctgtgctgtctcacagaaaatataaatagtggaaaaataatttcctcttttggagatattgtggcttttggctctcatggtctaggccaaagggtgcaaaatagaattacatgtggcaaatagcatttcccaccatgctaagtggagcaagatccttagatccaccatgttgaaacagagcctcccatgtaaagtggtagacaaggacagctgtaaatatccttgtaatacttttgtgtctctcccatttctttaaagtagattatgaaacatcaacatcaataaatgcaacatttttctgagcttatactccatatgcatattgtagtgccaatattataaactgtagagaaaatttttaactacgtgagtatagctttaaacattttcatattacatgcatttttacatgtacttcaagccaatatttgatcacattcaattttaacatttttgctcgaaagtgccaaaattttgcactgaatgaacacatgaatgaacatttctgcaatagttaataaatcactctttccattctttttcataaatcattatgggaataaaactagctgctgctcccacaaaaattacactggaaagcaagaataacatttcccttgccctttccctcccccaataaactaaattttttttaaatggttatcaatttaatgctatatttaaccatgtaagaagaacaaaagttcttccctttttttcaaaatgctataccctctcaaatagttttttatttaaaactctcttgtacaatctttttattcaaaactctctacccttttcaaatttccaaaagagatgaaaaaaaattgcttttgttccttcaggagcagaattagtatatcacagaaatttctcttgaattatttttcaacaaggatcctggaaagccacatcactaaaaatcaagaatagctaagaaaaactaagaattttgcctgctagaagtttgatctcttgctgctttttaaaaaaatctgtcttgatagcagttttaacataactggtagcgtattcagtatcatttcttcatgacatgccactagcagccaatcttggtaaacaaactgattaaaagattatctgtcacccagggtttcatcatcctctacagtgattcacttgtttggaatcaaggcacagtctgaagtcactgaatggagttgatgaagctaatgcttcacaaatagaaaatgaaaatcatctgaaaaccagggagaaaatcctcactgattatcgccaacttgttggtagaattctaaccgtatggtttccatgcatgaatcacaggaaccattggttgcagcagagcccctcagctgtctcacttcctccagtggcatgagcctgctgctgtaccttgtattcacctggtgacagtgatgaccaagatgtttacacctgctgcagtgatgagcacacaggcatgagcagtccttccacagttgtgtgtgtgtcggagggcattggaggggaagtgaattccaagggctggagcggtagaacaattccaatctagcatgatctgtcttgaattctaagaatatgttttcataacttggaggatggccatatcatggaagggggaaacccaaatattgacgctttttgcctatcatgatgtcataaggattaatcatccaaatgtaactttctgagctctacaaaaggtcatgtgaaatcaaatttctattaataattagattagatatctgatcccaagccctcataacaatcttctctggccttttttgttactgctgcttagagctgagaatccctgttttctgaaaactttaagcctgatttctagttcctcctgccttttcccagatcccaaaaaaatcaatgttaaatcaacttgagtattttcacatgcaaaggaagtatttgaacatggaacaagtgtggatattgtcccaatgatcaggattttcaactttcttgttcttctcagatcctctcttccctcaaaaaattattctgttaaattaatttaacctcttagccttcttttgttgttgttgattttttgttggtttgttttttggtttttgcttgtttgtttgagacggagtcttgctctgtcgaccaggctggagtgcagtggtgcgatctcagctcactgcaacctctgcctcccaggttcaaccaattctccctgcctcagcctcctgagtagctgagattacaggcaccaaccaccacacccagcaaattttttttttttttttttaagtagagaagaggtttcaccctgttggccaggttggtcttgaactcttgacctcaggtgatccacccccttggcctcccaaagtgctgggattacgggtgtgagccactgttcctggcctaaccccttagccttctattaataatacaaaaagatatgtcctcccctaagatacgtaacctttcagtaattataaaagtatatacctgtgctcagtttttatttgatgatgctgtttttattttattttaatccacagctattttccacgaaacatcctatagaagagatactttcttagggatgagaattatgtattacgtacttagaacaagggcaaagtttaactcttagtacatggcaaagctgatctcatccctgaagagtgtaatgtacttctagaacttcatcttctatccaaatccattaaattaaaagagattgagggaactgagtggaatagtcatcaacatttcactaaataaaatgaaatctctctgaaattagtttggcttctacaactctagctagacagaaacatttgtccctgacacactgaagtcattacttaagagcaattgtgcatttggggaaaaaaatggccattgtaagtttgcaaagttgaaggtaagaaggatggatggtgaaatggaagcaaagaaggattcagtaagattagtatttttggataaggatagttgatgtgtcacacaacagagccaacttcaaagtttgacttcaaagaaaactctccaagaaaacacacttgtgcatgtacacagacacacacacagaaagcaaacacaaacacttggtagtttctccctttcatttgtgctaacaacttttccattctacttggtctaggattttcttttcctttttgatatgcttcaaattttgcatccttgaaaataaattttattagacatgatgctaggttcactttagacccttgtgttgtacacttcttaataaacatagctcataacttctccttctagaccacagtagtctagaatctgtcttgccactgtgttaagaagcaccccaaaattttagaaaatatttttatagtggtgtaaaattaccttattaaaatcagaaactctataaaatattttagccttttacaccaatgctaaattctaaacctaatttcatgttgtaaattattttctagcttaagctgaagagtttagaccttgtgacaatcaaagccaactgatcaaattctaccttctttgaggtgccctttcttggatagtaactgcttctttcctcagtaattttctaactagcaaagctcttgaagacctttctcgggaatcttccctaccattcatcccttctttatcatcctgccaaaataatttcttcactgggactttttgctataattacctcaattttgttgttttaacttaaaagtaataaactcatatgctacatctagattacaaattccggaaatagagattgaactctttcctgcatttcctgtttttcctgaggatccagtaatgtgctcttgaatgcaataaatgcttactcaccctctccagtaggctatttccatctgattctgtcattcatcccttcagtgattatttgttaagtacctagtgcattttgagcacactgtgtggttctagatacacaccacatagtgaaacagacttggtccctgccctcgtggaccttacaaccccatgatgaaggccacataacaagaaacttctctggacacacattttatccagtgaagatgtttttaaaatgtgattaattaacattttttcaggtggactttagcctgacttacagccaactagctacaaaccaagatttctttcttgtgaataacaatttaaattggcaacttgtgaatcacaagatctttccagtcctcactgaatgtgataaagccatttatgttgaacccagtgtgtgttttagttgctttctcataatgtaggaaatgacatcaacaaattgtaaaatgtttaatgactgaaacaacaattatacttaaattccttttcaaatccaatgaatcatactaacctgtaacctctgtccctctccctccccacagaataagagctcctctcttaaggcagcccccaccaatccctgctgccccctttaaaatcccttcatgcccatcccttctgtaactaagaaatcttggactgtttgcaccaacttcaagaaacatgaagaggtctcacatttttagttgcctttggagatgggagcaggatagacagagtcaggagtagaatgagacttcctcaagatatgtatgttacagaattttgacttttaaagattgagatgtacaaaaacttaaaagaaaaaatatgaagaaaatgaagagaggcagtatggtgagaaaatgaagtgactggaggagacagcacagccaatatttcactcacaatcattagtctttatctcatctttctgcaccccagattttccctggggtgacttatgaaatttcaattaacgaaccaccaacaaagaacagaggcgaaactgagtcaacaaaaggctcttgatacttaagttcagattccttggcaatctttcaaagtttttctttggcagacctcagcacaaccacgtaagaatatgtctatgtctttgagttcatcttaatgttctttatacagctttcttatctgtgacacagaacaagtttcactaaaaccatatcaagcttctggttccaactataggtctgtgttagagagccacacctgaaaaatcaagcatgtcagatgcagacctgtatgcctttactgctgttcaagaggaaagtgtaagtgctgtgggaggaaggcaggaggaggagccagaggcttggtaggggtgaaggtagatggagaagaatgactaaaagtaagtgcaaaaaatactgcaggaaagcagtttgagataactaaggcagcattccagtgtatccacttaaggaagggttgttaatacagctatacttctgtggataagaaattaacttactgtataattgcattctcggaagatctttcaagacttttctgtgtgtgtgtgtgtgtgtgtgtgtgtgtgtgttgataaaaactctcacttctagtaaacttaggataataggctatgtcttgctaatctatctcactggttattgaaaaactgtcgctctgtagtcaggggtggcaggaatttaagttgaaagcatgatatgactacaaaatgtgcatttctagatacgcagcccttccccaaacagacttggcagaataagttagtttaaatggttggttccatctgtgtggtaaaattgtgtctgacatctgtttaaaatgagcacaagatgcttgaaaaagaagggcaagcctcactgttgaacgtgatggaatctgggggccatggccctcgtgtgtatgtacaagctcacagctcacacggttcaccagtcttgtcagctgttactacctttttatctggatcctgttaacttgagatttgttcttagcttatggaaaaggtctccctgtgttttcttcctccagataggagaagtctcttggcagagttcttcaaaggcagttaagtcagtagcatcatggaaatttggcagcaagttgagtaccagagcagatctaaacgttagtttaggttattttcacaagcaattgttccacaatttttcatccctttattttagcagttagcataatcactcacaacagttcctaaagtgaacctgcttgtccattcttatcattgtgtagtctgaataaccatgaaatttaaatttaaattggatacataaacatggcaaaacatgaataaatcatccaaggccttctgaattgttcagttttcacctgcttaaagttaatgcaaaaagtcaaattgaggcctttgattaaataaaaaattgaacaactagattactttgatatatttcatctctggtaattttgttcttttgccttttaaatcattttaaattgctttgagtgttgccaaaatgcatgctcaccctaatctattataactataagtaggaactttgtgcctctaattaaaaaagaagatgtatattctaggtgatttaatccactctatatttgttgggttacttgggaagtgttgcagattaatatagaaggaattaggacttggtccttgaatagtgtctcaaatattaaagatcttgaaactgaattattttgcattttgtactttgaaaacattgtgatgcaccaaagtaacataaaactgggtcttctaaggttatgttttttaaaggtactatgcaaaaacaataattcttgcctgtagtcccagctactagggaggcagaggtgggaggaatgctcgagcccgggaggaggaagttgcagtgagctgagatagcacaactgcactccaggctgggtgacacagagtgagactccatctcaaaacaaaacaaaacaaaacaaaacaaacccagtaattctcaaaataaggccaaccttaaaatatcccaggtactaaatcatttagcctataatctgatatcactgtttaacagaaacttttccattgctgtcaactaaaaggtaagaaaagggaatgaaactaataaattctgagcacatgcttcgtgttggatacatttagtgctttacatttgctttttgtgctaaatcctttactaagtttatcatttcatgcaatacctgcaacaacccagtgacaacatctttattttacatatgaaagaaacagactcagagaggttgctcaaagccacacaacaagtcagttatcagaagaagaaaagatccaaaccagagccaaaattatttagcagcctcaaaaaaattgacttcagtgtctaaccttccctcgtgtttaaatactctttccaggataggagatgtaattaaaacaatagctaaacaaaaactcaagccattatatcccttgagggctggggggaagatttaaattggttttgttgttatttggttttttcttttttctttttttttttttttttgaagcttctttttaaccctttttttctttctttctttcttttattttttttatttttttattttttattttttatttttggtagaaacagggtcttgctatgttgctcaggctggtctcaaactcctggcctgaaactatcctcccacctccacctcccaaaatgttgagattacagacatgagctgctgtacccagcctttgcttttttcttgacatgaaatcttacatgcaaaacctatgtattcaacagattaaaactgagatactcttgttggaggagaaaaggggcaaggtaagctgaactcctgaaactctggctttcccccctcccaccaagatgggcttctgacatctcagaaggaccactggtttaagttatgttaggcaatctgaatgtataatagagttactgttaatagactatttaaaggttcctgaaaagtaagcatggatgaaaacagatgtttagagcactaggtgttcaggcccgttgcattacagtgcccagacactagcagccaggctgggctttgcctctactttagagcacagccttgagtgcttcacttcgccttgtgggtctgggttttctaagcttcataatgagtaagggtggacctagagcagtagatctcacccctggctgtacatatgtaggaagcttttttttttttttttttgagatagggtcttgctccgttgcccaggctggagtgcagtggcacaatctcagctcattgcaacctccacctcccaggtttaagcaattatccagcctcagcctccctagtagctgggattacaggcgcgcaccaccacacttggctaatttttgtgtttttagtagagacggggtttcaccatgttggccaggctggtcttgaactcttgagctcaaatgatctgcctgccttggcctcccaaagtgctggtattacaggcatgagtccctgcacccagccgtaggaagctttttaaaatgccaataccaaggcctcgctcccagggattccaatttactttcatctttggagcaagcctgaacatgatcatttttaaaatacgcccctgatgattctaatatgcagccagaacggagagccactggtcagggtgatctccctgtttccttccatgtctacactgattgttttcatcgaaatgctaatgaggatatttttaaatgcctccgttccatagcatcgggagcttaaggaaagttcattcttatgtcactctcctagtgtccatattattcatggactgaatttaatcacatcatggtcctttttcatagaaaacctgagaaaaaggtgggtagcttaaggagttccccaggaaaagatttcattcttgttctcatcttttttttccaggtcttttcaatgttttctataaatcactcttaaatgttaagtcttacaaattataaaaaagaaaaattctgagccctccttcagaatgactacattattttctagattccttagagcaagtgctgtgccttatgaactgatgtgtccctggagcctaatatagtgggtgcctggcacataataggtgctccatcttttttttttctttttatgaatgaaaggcatccaagctttcaaaattctgactcatgttacatggaaagggttcccttatgaagctcaaactgcccattacaagagaacagtttgaacatgatataaaacaaatgggcagtagagaggtagtcaatgtgatagcctccccatccccatcccaaggttaccagttgggaagatgagtggttgatttgatagggattgtttcacataacctctttataacatatagttagtggaagcacaacttactgttgtgttcaatttataaacactgtttcacaattgtttttcatgtgaggtttaatatcctgcctgtctagccccagacacccattctacacatccctccatcatatccatgggcacaatcacagccactcccttcatcaaacatgtgctcactttctaggctctcactttaagtgtctatctgtaagctattaaagtcaaacatttctgctatattgatatggttatgggatttagattattttgtgcaggtatattaaggtaaaacagaatatgaaaaccatatgaggcctaacatatgaggtacataataaatatgtgttcaattaatgttatcaggccttacactaaggtcaagaatcaggtaacaatcccagtggcataaatggaagaattgccctagtaagtacaatggaaacataatttcttacattttcaaagtgcaatacattatctgaaaacaggaaaaaatgtggtaaccatccatagtaacacattagggagagatgttaatgttcctataccacagccaggatctatttcactaacagcaccaatgaatgcaaaactttatggaagcctatatatatgctacctgtttatggcagtaaacgtgaagagaagaggtgtttatctttctcttttctcctgaatacttctgaattatatctcaacacttagaatattagcagccagccagtactctttgttttccctctcgaaaatatgaactttaaatcagatatttttgcaggagaaaataagtttagtaatctggggtcttgttatgaggcagaatatgcatcaataagcagaataaaatgcattcagctttcaggctaggcctggacaataacgaccctgcaaatcagagctagaattctaaatgctgtgcctgggaatctgcccagggccttttgggctctcatttttgctgttttgtatttgatatttcatttatatgcatcaaactaataccaactttcatatttgggcaaggaaaggaagagagaatggttgctagaattaaagaactccaaggaactctctaaggaacatagctcctaataaaggtttcagagttccatatttttagaaaacatgtatgtattgattatctacaaagacattcaacacacctccttaattctagaaataatgctaccagttgtggatatcatgaaaatattttaggaggcataatttactacagcatatctgagttgaaagagtagcgaacaatattcttttggttatgtaatatgctgggcagccctgagattcagaaatgttgaggaaaacaagaattcttccccataaataaatcacactgtctcattttagagtttacagtataaaatgatagtttttatcactttttaagttgctttggggaaaactcaaactgaaactgttggtgaatgaaattttataaacttgagaatccgggagattcacgacacaattcaaacctacttacaggaattatatcccaaagcacagaagtgtgaaaagtgtcttgagtgtgtttaatttcttaactaagctttcaacaatagctcttttcatctaagacttgaaaacaaataaatgtagagagattttatgctgctaaggatttttgaaaacatgccaagctgtaggccagaagggaaaggaatgctttgatacacgctattttgcgtatgctgagtttttatctctaacagagtaggatcatactgaaagaagcctgacaacacacccttactgacattattatgacatcagagcccctcaaataatgggaattactaacataaaactaagtaaggaggagaaagtgaccaaatgatcccatggccattccatcacagtatcactagcacaaatgatccagatctatcaataagcaactaattaagacaaactttacactgcccatgatgtcaatttataaaaatatttatttgtgaaataaacatctccagtcccttattttcttaactttttaataaatatttaagtgtttccctcaatattctatttctatttcagtgtccccaaatacatttgttgttgttgttgttgttgttttgttttgtttttattttttgagatggagtctcacgctgtcacccaggctggagtgcaatggggcgatctcggctcactgcaacctccgcctcctgagttcaagtgattctcctgcctcggcctcccgagtagctgggattacaggcacccaccaccatacctggctaatttgtatttttagtagagacggtgtttcactatgttggccaggctggtctcgaagtcctgaccttgtgatctgcctgcctcagtctcccaaagtgctgggattacaggtgtgagccactgtgcccaacccagataagttacttttatacagaactgttatctaatgaaacaaaaaaagactcttctatccaggcatggtggcctgtgcccgtagttcccaccactcaggaccctcttgtcttctgagtagctggaactacaggtgcaggccaccatacttcagaggtgggaggatcatttaagcccaggaattcgaggctgcagtgagctgtgatcacatcaatacactccagcctgaggaacagctcatctctttaaaaaaaatgcagttagagccagggatggcgggcttgtgcctgtagtttccactagtgagcctgaggtagaaggatagcttgagcccaggagtttgagaccagcctgggcaacatagtgagaccctgtctccaaagttactattctaaatggttaataatttattcacttctgaagctgatgaaatttaagaaactgaaaagtaaatataatgtggaccctcattatatactgtggataagagtgatataaaagaaaaattagataatgacacaaaatacacatttataatcacatgccaaactaggcaagaccacaagcattttttggaaatgatttcaggttaaagtggagtggactggaggccgggtgcggtggctcacgcctgtaatcccagcactttgggaggccgaaggcgggcggatcacgaggtcaggagatcaagaccatcctggctaacacggtgaaaccccgtctctactaaaaaaatagaaaaaaaaattagccgggcgtggtggcgggcgcctgtagtcccagctactctggaggctgaggcaggagaatggcgtgaacccgggaggcggagcttgcagtgagctgagatcgcgccactgcactccagcctgggtgacagagcgagactccgtctcaaaaaaaaaaaaaaaaaaaaaaagttgggtggactggggaaggcagggttggtggggatttggacgggctgagacgagaagataaagcatttcaggtgtggacttcagaaaggatgaacaaatgagcttgaaaatgatgaaatccattcaggtaattgtgcatgtggagaaaagaggttgacagaggagaacagagagattatatctgtaagtgaagtaactcaggaatggaaaacctaaaaccacatgttctcacttgtaagtgggagccaaggccaggtgggttggctcacacttgtaatcccagaactttgggaggccaaggcgggcagatcccttgagtccaggagtttgagatcagcctgggcaacatggtgaaaccccgtatcaacaaaaagtacaaaaaattaactgggtatggtggtgtgcacctgtagtcccagctacttgggagactgaggcaggaggatcgcttgagcctgggagacagagtttgcagcgagccaagatcatgccactgcactctaacctgggtgacagagtgagaccttgtttctctaaatatatatatatatatatacatatatatatatatacacacatatatatatatatacacatatatatatacacacatatatatatacatatatatatatatgggagctaagctataggtatgcaaaggcatacagagtgataaaatagacatcagagactcagatgcaggagagagaggactgagggatgaaaaactacccactgagcacaacatacattactcaagtgatgggtgcactaaaatcccagacttcactaccatacaattcatccatataactgaaaaccacctgtacacctaaagctactgaaattttttaaaattaataagtaaaataaatcactaagctcagaacagagagagaagccatgtctgggtcatgcatggtggccttgaaaggcagctgaaactctgtttagtccagagggacatagagaatcactgaaggttgttagagatggaaaccgaactgaaataaggaggaattcaggagtaatttatagactgtgtggcagcagagaaaaagtggagccagagagactaatagggaaccaatggcagcatccagttgtgaggccactggagccaggactggatggagacaatttacttgcttctcaaggccacacactgtccctctgcaaaggaccttatgcttgctattatgcaatgcccagctacaatcaacacctatctttcatttaggaattttgttacctgaggatttagatgcatttaaagacactcttgattctttatttcctctaaattaatgagatttatatctcatacttctcagaggaaaaaaatggtttaatcctagttctaatgtttataagctgaaagagcctcatttctcaaaaaataaataaataaataaagcactaagttaatttacatatttacaaaagaaaaaacattctgcagttggttgagtttatgtgacaagtattttcagacattttagagtgagtttcctttgaaggcagtgataagagtttaaacttcaggtctaaagtaaaatattttaaatggctccttagctttgcttgctaaaaagtagaacattatccaatggagatggaaaaaaaccctctttgcttggccagtgcaatacatgggctgcatatacggaattcatacttgcaaatgttctattttaagcttgagtcaaaatatgatttggctaatatattttagcacctgtttttcactgaacaaacctcagtcttactggaattaagtgtattatttattttaatttatgactattttatcttactaaatgccatagaaaatcaattgatatctgcatttctaatacatgaaaatgcctaaaatctggaaaggagtattgtttagcaaataaatatacattgcttaaatgatagtataatagaaaacattcatgttaaaaactgagttggaaaccttcatttagattgctatagctattaatcacagcttttattttatttatttatttatttatttattgagatagaatctcactctgttgcccacactggagtgcagtggtgtgatcttggctcactgcaacctccacctcccagattcaagcaattctcgtgcctcagcctcctgagtagctgggaccacaggcgcacaccaccacatctggctaattgttagtattttttagtagagaagggtttcaccatgttgaccagcctggtcttgaactcctggcctacctgccttggcctcccaaaatgctgcaattacaggtaagagccaactcactcagtccacagattttatttttaagatggtgagcttcgtatatttttttgtgaagtcagtcatgatgagtttcagtgccttgtttgaggtctcacaattttcttttgcttgagaaaattttttaaaaatgaatatttacttaaatgaatcatagcaatgctgtcttgaccacttttacaacattagttctcaagccagtgagtttcttggcagctttgtatttattcaatcagtgtactcagtaaacgtaattgtgccctgatagacttttaaatgtaagttatcaaacattaaaaatgatggcatcatttaagctgctcactttactcctctggatgacccttgcaatttcatgtggattattatagagatctggtcaaatgttttgtattaatcaatagtaggaacaagcctcattactctcaagtttctaagaatatttgcagccttcataggttttcatgttgtaattctgtttatttgttgattctaaaacaaaccacctttattcatagtgaaaatatgccttagggtacagaaagacattatttgtatatgaactataaataccttattgatttcctatccttggtgattacaagaaaatattcatttaagatcatctcttatataatttaataacagcaataccattctttgctttttaaataaaaaagttatgatacttagaattttacatattttgaaatttatatgtaatttatacagagttgatcctcaatattattagtgtattccatgtttgcaaatttgctaacccactaaaaatgtatttatgaggtgaaataacacctatggcacctttgtggccctttacagagcaacaaaaaaattttagtctcccaacattcgggttctcaactgagtttgaacaaactgacactcttgtcttcttgtttcagcactcacactgtaaacatgtgtcccttgcaagacctattttctgctgtttttcacattttcgtgctttttttaaaaaaaaattcttttttggtttacgttttatttatctatttgtttattttgtagaaattgggtctcactacgtttcctaggctggtctcaaactcctggtctcaagtgatcctcccacctcggcctcgagtgctggggttacaggcatgctcagccttttgtgctttttgttgataatttcaccacttaaaattggccccaagagtagtgctgaagtgctgtctactgttccaaagcacaagaaggctgtgatgagcctcttggagaaaacacagttggttagataagcttctttcaggcatgagttacagtgctcttggctgtgagttcaacattagtgaatcaacaatattaaataacgtatcattaaatggaagcacaggtaaaacaataatatgtattgataagttgataaaactgatgagaccagaggctcctggggacttagtcctgtatatccctacgagcaatggcttggtatttactaattcagtgtttgtagtgactttacagaacataactgccactgcaaataatgagaaatggctgtatctccttctgtttttttctttcctagaagccattttctcaacatttcatcgtgaactattatggcctcatcgggaatgtgaagtgtgtcatctgagcagatgttcttattgttttcctatccactgacccacagcatcaaacaatttagaggagaaaagtggtcctgtcatctccagagttattatctattttatttttaaatccaaacttccacaatcaagttgctattaaggtttatcttattagcatttaaatttttaggaaatgctcattactgggttaagcacaaaaaagtcacattgcttgaaaagtgctatttgtaaaacagaatggcccactttgtctatgtgtaagaggatctgctgcacatttttacctggaataatattgtcatggatttggacatatgtggaagtgctatttgtgtttatgcagatcaacctcttggttttacagaagagagatgccagtcccagggaggttaaagtgcctgcccaaggccgtgtgctggagcagaaggggaggtgctgcctccagtcgagttagagcacttcccaccatccaccaccatcaggtcctgaagccaaatacagaagatagcatatatttttattactttgagatatcatcctgagcccaagaagaatttcttgttgctgtctcataaatatattactttgttatttattagtttaggcagtttatgactagcagtcaaatattcccaataaggttcgaatcaaaaatgttattttgtttttgtattataaaaagaaaagcaggctaggtgtggtggctcatgcctgtaatcccagaactttgggaggccaaggcgggcggatcacctgaagttaggagttcgaaactagcctggccaacatggtgaaaccctgtctctattaaaaataacaaaaaaaaaaaaaatagttgggcatggtggcaggcgcctgtaatcccagctactcaggaggctgaggaaggagaatctcttgaacccgggaggcagaggttgcagtgaggcaagatcaccacactgcacttcagcctcggtgacaagagtgaaactccatcaaagaaagaaagaaagaaaaagagagagagaaaaaaaagaaaagcatattttgaaaggtatcctcttaaatttgtggtgaccctcaaatatttatgctaaaacttaactttcagtatggaaacagaaacatgggttcaatttaaaatccatgactggatcatgagcagggcaaagtgagaggcattgtgagatagggccaaatgcttcgagaatttactccatacagactgtgttcaggaacccagcacttcctctgtgactcaataactggcacatatggttgccagggactaccaacagctgatttcaataaaagttacccaattacaccttgaagacctgttgtttctggagggagttggaggaattaaggaatgtggactgagtttttaaaatatatcttacagaagtcagaggaagatatagaaggacaggaatatactcaagatacaatattttcttctactgtactttttgttacatggaacagaattttagcattggatcccttcagctgtgacaaaggagaaggtccatggttataaagttttccattagactctcctcacacacaggaaatgaacttccataaatttaatgatatgactcttagggttttatttctcccattttataaccctctttaggatagaaacacatttcttgcactataaaaattttagtcagcaaatttttcatattctcactgggatttcataatcagtctgtacacccttcctatgcaataacttttgatcagtatagtgaaatataatggtattatgtaattttaagatgtacatcttaaagacaaaaaaatatccctttatttaattcaagataaataaatcagtgaggaaaatgtatggtgaaaagtttgggcatatattagttatctttcaatatatttttcatttttttctttttatttccttcaaccatatgatgcaatcaacggatatttgttgggtgctttgatgttttcagatctatgctatgcactacaagggtctcaaaaaggaatgaagaacaaagtccctgctctcaagaatgtagagttttccatacaaggttctaaaaaccattaaggtcacttaagatatcagtcagaaggtgaataggatgatgttcctggatgcaaattttagaaatgtggcatactaaaatcttcccctggaacttcaccattcacacctaagaagttaaagatgtctcagtaggttctcactatgttgtctaggcaggtctcaaacttctggcctcaagagatccctataccttggcctcccaacgtgtggaggttacaggcataagccactgcacctgacccattttctccttctgaaaactcttttggattttaggataccatgttctttggattcttccctgcttactctgaccttccttcttgaccctcactgtctcttcctcattcgcagggccacttctccttagcgaccccaacacaaccaagtctcaaaattggacatctgatatatgtgacaaagatatgttttcatttatataaaatgtgaatagaaacttacatacacacacacaaacatacaaacacacacacactcacagtgtctcagaagttctgcaacaaagaaatacagttattgtcattgaacccagaactccctaagtgtttttgacagagcaactttttcttgagacagatctataaaaatctcttgggatagtggtgttctatggaaaacagtctggggaatactgaattagagaaccgtgtgagacattttattattaacatgcaaactcaaagtactgaaagtgtagagaagagaaatatcattatgatctagacgggtgaagaaaagaatctcaaaggaggatagacttttaaagaaataagtgaaaaaaaaaacagaacatgtgatgaggagggggaaattcagattatatctcccaaattgatgatattgattatttgaaagaggaaggcaaaggtgtagacaatgattattagggactttgactttctaagttatacatttctatattgtttatgtacttgtttttacaaagttttacaaatgttttatgaagtggcttattcttataatccagagatattctcctaaaactaactaaagtttatttatcagattaactaatgatgtgtatagctcttacttccacaattatccatatatacatatatgcaatatttacaaacatagagatgtacaaatataatatctcggccaaaaataattgaagcatcaaagtcaacctacattgtaatcttgggcagcacctgttgtttattcatctctcaagtgtggctgacttcagggatgagaataaacaatgtgatctcttactaagcttccctttggactagtcatccaattggtatgtgatgactttatacctgaaactaaggagttgaggaataagctgaaaatagccaacttgggtttcctaagtacagtttggcttctgtaagaactgtttggttgctcctcaatttcagtgtattcattttttaaagtatatttattttaaaagtggcaaattcaggtattacttaataattaagaagcatttatgcccaaacacaatatatgtttacaaccaaatttgaaagtaattgaactgataaccctttagacaaaggagatgtgttataataaatattattgtcagctttccttcatcttaagattttttgaatcttggaagaagatatgcatgaactttgtgttgggtatttataaatgtatacacatatatacatagcaaaatgtaagcacaatacaggtataacatgtaaggttagaccatgtaaacttgctgaaattcagttgtttctgacctacaataatggcaatttcatatggttgaacctaatggtttgtctcagtcattagttagtggtgcctcctcccctaggtagagttttccaattgtgttgggatggtattttcactcttgtaacattcccaacttgtatcagaattcccttcatcttccctcctctacttttatattattctattccgtcatttttctcctagatacgactggacagattgtttacttatagcagtccctatatgttaatccatttctttggtcaacaaattctcaaacatcagaccttaaaggtcaaagaaaatccctgtgttgaattcagtaccatgtatacagaattagtcaactattgcggctctttccctattatctatccctatttctgttactgttgatgttgtctgggagtatctaaacactcccaggaattcaggtacttaagaggactgtctggataacaacgtctggttatctgatgtcaacttctgaacctcttggcaggagtcctaaggcctgcatagaagattggctctaggacaaatgctatcaagaaaatattcccattgggtgcaggtggctcatccttttaatccaaatcactcaggaggctgaggtgggaggattccttgaggccaggagtttgagacctgcttgggcaacatagcaagaccctatctctaaaaaaataaaataaattagcagggcatggtggtgtgcactagaagttccaattactccagaggctgaggtgaggggatcacttgagcccaggagttcaaggctgcagtgagctgtaatcacaccactgcactctagcttggatgacagagcaagaccccatctctaaaaatataataaaagacaaataagaaactagtcccccataattcaaacatgcttattactcactatgattacagatcaaaataactaccagcttcagtggattaagtatctaaaccttgatgtgattggccaatagtttgattactaccatgtgtgtattacatatgcacatgtattcaatgctgatacaataatctgtaaatagaaaagtgcaatagttttctatatgcagtttcagtagtaccaaagctaattaccagttgagaagaatttggctttataagaggtaagccaaaagaacaaagctggaggcatcacgctacctaacttcaaactatactacaaggccacagtaaccaaaacagcatggtactggtaccaaaacagagatatagactaatggaacagaacagagccctcagaaataataccacacatctacaactatctgatctttgacaaacctgacaaaaaacaagaaatggggaaaggattccctatttaacagatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcagggcataggcatgggcaaggacttcatgtctaaaacaccaaaagcaatggcaacaaaaaccaaaattgacaaatgggatctacttaaactaaagagcttctgcacagcaaaagaaactaccatcagagtgaacaggcaacctacaaaatgggagaaaatttttgcaatctactcatctgacaaagggctaatatccagaatctacaaagaactcaaacaaatttacaagaaaaaaacaaccccatcaacatgtgggtgaaggatatgaacagacacttctcaaaagaagacatttatgcagccaaaagacacatgaaaaaatgctcattatcactggccatcagagaaatgcaaatcaaaaccacaatgagataccatctcacaccagttagaatggcaatcattaaaaagtcaggaaacaaccggtgctggagaggatgtggaaaaacaggaacacttttacactgttggtgggactgtaaactagttcaaccattgtggaagacagtgtggctattcctcagggatctagaactagaaataccatttgacccagccatcccattactgggtatatacccaaaggattataaatcatgctgctataaagacacatgcacacgtatgtttactgcagcactattcacaatagcaaagacctggaaccaactcaaatgcccaacaatgatagactgaaatgtggcacatatacaccatggaatactttgcagccatataaaatgatgagttcatgtcctttgtagggacatggatgaagctggaaaccatcattcttagcaaactatcgcaaggacagaaaaccaaacatcacatgttctcactcataggtgggaattgaacaatgagaacacttggacacaggaagggggacatcacacaccagggcctgttgtggggtgggaggagaggggagggatagcattaggagatatacctaatgtaaatgacgagttaatgagtgtagcacaccaacatggcacatgtatacatatgtaacaaacctgcacattgtgcacatataccctagaacttaaagtataattttaaaaaagaggtgctaaatatgatctagtgagttctgtggcagacatttttaagtagaaacagggacaatgtcttgttatggcttcttgatggggtcaaaggctgtattgccttctagctaccggtaaagaaattctctaaccctaaccaacaagtgcctcagcccctacctctgcaaactgcagtcagtctgaaggcaatctgccatgccagaaagccagttttcagaatctccctttcagaaatctaatatggaaatagacagtcttgtaaagacttgcattatctatttactagtgaatagatgaatatctacttgccattaaatatagcaattaaccaataccagtcaacaatcattgagctgcttctttttttttctttatttcttctgaaaaaacaaatggaatacatgtgcagaacatgcagttttgttacataggtatatgtgtgccatggtggtttgctgcatctattgacccatcccctaagttttctcccctcaccccctaccccccaacaagccctggtgtgtgctgttcccctctctgtgttcatgtgttctcaatgttcaactcccacttatgagtgagaacatatggtgtttggttttctgttcctgtgttagtttgctgaggatgatggcttccagcttcattcatgtccctgcaaaggacatgatctcattcctttttaagagctgcttctttgtataagtgcctggtggttaacacaagtgcctagtaggtgttcaataaattgttcttccactaaattaaaaagagtaaaataaaggcctaatctcaggggcactataatcttctcataagaatacaatgtgtttgtataatgtttttatttcatcacctacataatcaaatcctatctacacacagcatgtattagacttcattttaccaatgaataaaattgaagctaacagtacatcagagatttgtccaacagttacaacctaggaagtagtgaaactaaactaaactctaggccttctaatgtgtaattcaatgatagttctaccaaatctccctggttcactaaatcaaactgaaaaggaaacgcttttggtaacagaggaaaaccatagccacattcactgatgtcccaaatgggttgaaaaatgagtcccactttctgcaataaatggccctcaattaataatttattggtcataggttacaggttatcatagtcatatcatattgataggcctataaatgttttaccattagtaaaaagaaaatttcaagatttgggagtcatgggaaatctttgcaccttcctctcaatttactgtgaacataaacttctctaaaaaaacctaagtcactcaaaagaaaaatatgggtcaacaatacttttttagagatgccatggatttttttgtcaagcattttgcaattttttttttactggagggaaaggattttgtagaaatcctttgaaaggctgaattattatggaaaataattttgaactttgagaacattaaattcctttgtttcccaaagctttgtggcaaaaaagagatgctctggaaaacttttcaagcacttagaattttacagtgatgtaaaagttgtctgatacctattatgagtaatagtacctggttagttttctattgcttttctttgaattacggttttccaccaagcaacattaaacaggaaagacaaagatcaaatactcttccgatcaactgatgctcattttatctaatacaaatgacaaaaagggaatagtaaagaacagaaacagtttttctgtcacttgcaaaatagtattgggaacttagttctgccaaagaaattaagaaatatgtgacatctctatctgcctttatttttcctttggttatttttgtatttaacgagacaaaaacattcaacagtgtacataaacttttcccacattttaaatttatttttgaatgataacctttaaattcacaataagttctgacataaaggtacatttatgatgggccctttatcatgagtacctgagtaggaggagacatacactgaaaactttgctgggggagaagtaacattgtcttgccagatgagagtggaaatcacattttagccctttgtaatactctaaaccgagggttagtaacctatggaccaaatccagctttccacttgtttttgtaaataaagtttaattagaacataattacacctattcatttacagtttgtagctgcttttgcactacaactgcagtgctgagtagctcctagagagaccatatggctcacaaaatctaaaatatttactatctggtcatttacagaaaaagtttgtccacccctgctataaatctttctctcttcccttcctctcctacagatggcaataactagtggcaaaaaaaaaaaaaaggcctagactctcttatggcaagaagtggaaaataacgcattttttctggattgtgcaggtgatacttctgggtccctgccagcctcgtgcattttcaagggcctaggaatcagaaaccatttctgactctttgacagcatagccctcctcccactactctctaaatagaagcattgacatcagagtatcctaaaacaaccaaatatgggacatgtttatttagtgcatccctgtcagcttactaattagaaaactgagttatgtttctcttttaaaaaataggacaggtgcccatgaaaactgaaaatttaggccaaactatctatgctaataacactttctacttttttttttttttagatggagtcttgctctgtcatccaggctggagtgcagtggcaccatctcggctcactgcaacctccgcctcccgggttcaagcaattctcctgcctcagcctcccaagtagctgggactacaggtgcacggcacacccggctaattttttgtattttagtagagacagggtttcactgtgttgcccaggctggtctcaaactcctgagttcaggcaatctactcgcctcggcctcccaaagtgctaggattacaggcgtgaaccaccactcccgaccctaacactttctacttttacatctcccagcgccatttaatatgttttagtttcaactatgcacctaaaacagtaataacaaaatttaagtaaacatctctagaactttcagtgaaggataaaatatgttaggtaaagccacatttttgtctttcttcttatcctcctaatgtgtttctacctacataaaatcatcaacttcaatttttttttttggtcacaaaaaaaagcttgatgcttatatacatagcagcagcaagaaaaaaaacataccttttttctttacttaccagaccccagaggagtgactacagctttaaagctgactgtgaatatatttttggagagaggaagtttgtgttgtctagtgtccatcgcttgccaacttttctgatctataaaatacttcagtgacttcacacactgatgctggctttcagctttcttttagctctggtcaccaagagcaacaagtgccattgtaggtcaatccctagagaaacatctgtcttctctattccttgggcaggtactttcatgtgtagtagtttcagagtttatggttatttctctctggagaccatctgtctgctgggtttattttttcctgatgttgtaccacatcataaagtctactgccaagagtactttactcaagaagattttgttttctgctgttttagtcacttcactgctttatttctgtaagccaaatcaagtggacaaaatcagtagcaattccccactccacggccctgtagcataacctggctcagtttggttgcaagttcttatgactgctttaaaacattctcctcacacaataagtgatgggtcctcttgtatatacgtgtaacaaagagctgcactgagattttccatgaaatgtgaatgcgctcagaaagcctttccaagttttttaaaacaagtgaatcatgtaggtctaatcagttgaaagtaaccaaattcataattgatttttattagcaaatatagtactttgaaatagctttttatgctgcatgacccaaggttaacaaaaaaatagctttttgtttccagggaaaaataagtttaagcttatttttatcctttcttactttagttcccaataatcatacttaaataaatgtactccagagtttctatttttcattttcagataatgtaatggttattatcatatagtcatagaaaattgcaatggttaagtcattatttgcctaataaatttacaacctttttacggaaaaatgattccggccagacaaatgttgtcaaacaccttttaatgtgttttcaacctttgtcatagctcactttcttgcataaacagagccttccaaacaaagcatggaaaatttaaaccacatagattcgtattatcaaaactattacaccggattattttccatagtgtcagcattgacattaatttcttgagaagataactttaaaaggaacactcacatggattttacaatgtctcttcctcacccttacaaataacttttattcattcacggctataattagcacttcctgtaaggcagcccttttctcggttgtggatgggcacactgtgaattcattagcatggtagccaggtcagcagagtcattagtggtcattttaatgatgacttggaaaccctgcctggtcaatttaagtgaggctcattcccatgtactgactgcagccaagcagcttcacaatattacccatttatttaggcagcttcaaatagtttcccaggaactggagtaacaagaagctgaatgcagaggtctgtgtgtcaagaagtttccatgactagtgaaccctgagcacttctctgtacacattcaaacccaactcttacattcattcttcaaatgggtttgcttagaccaagccagattacttgagcaccttaaattttgctgggtattgtttcatgttttacatttataagtgttttgcattttaagcagggattttatataataaaccaatataattcattgtcatcattgttatccatgttagcgaaaacttgtaaaattatgtagcaattatgtgtcaactggcatttttaactctctttggtatttatttatttattatgttaaaacacagattctcattttgaggctatctcattttattctcaaaacaatactagaggagaagtagtgaggatgtggaaaggaagccatgtacctgggacacaaagagtatgagcttggggatcagctgacatctgacttgcagactgtggctgcaggcaggggaagtagcacacaaaagcatcaagtttcattattatatcatgttattatgttacagcatgatattgtgcaggaaacagaaaccagccggacctgcctagaaggtctatctggagaaatggaagaattaatgttcttgtgaggatcttaaaagccagatgaatgagtctggatgtgatagcaagggaaaggaaccataagttttaaaacaaggaattggcatgataaaagcagttccatagaaagcaggggccggaagacctatgcaggctgaattccaaatgcaccattgctttggcttgatgactttaggggtttgggggtttcacttacaaattcagtaaatgtcaccttttcagtgagagagaccttccctgaccactttgtccatacgttcaactctccccgcttctgcatcctatctatcctctttctctgctatttttttctccttagcagttatcactttcaaacacagtatgcattttatgtaataatacgttgtttatggcccatctttcccgctataatgtaagttctgtaagggcagtgattcttgtctatttattcactattataccttcagcacctagaacactgcctggcacatagtagcccctgaatactacatgttgaatgcgtcaatgaattgattagtacctgtaccaagtcctattcttgatactagaaataaagtagttaataagatacacaagttttctgttctcatggaggatacattttagtagtggataccaaaataaacagagttgtaattccaagtggtgctgtttgctcagaggaaaatataacagagttaacaagaatatcaaatatcaaataaatgctctcctgttgcacacattgaatatataacagtcgaaaaggctgtttttgtttccagttttgaattcattattcctgaacaatctacactggttttttatcacagttatttttcctggaaaagacacagaaacagcttgcaaaagcaagaacctgactgtgatagatttctaaattgtagatcttattccattcagcaagatcattcccagtcattccattcagccatgaactgcatgtcccatctactatgatggaaaacatccttttcaactgctatcaagaagcagagcctttttatttattttgacaggccaatatctatttggttctttccacactgaatgagtatcttcaagaaactcagacttctgatagggactcagtgatgagacaacaattaagaagaatctggactttcccattccaaagcctcttctcaaggcagttgtgatccttttaaaaaacacagactaaagtaagtggacagaataagtacatagataaagaaacacagaagttaggaacacaatttttttattatactttgagttctagggtacatgtgcacaacgtgcaggtttgttacatatgtatacatgtgccgtgttggtttgctgcacccattaactcgtcatttacattacatatttctcctaatgctatccctcccccatcccctgaccccacaacaggccccagtgtgtgatgttccccttcctgtgtccaagtgttctcattgttcagttcccgcctgtgagtgagaacatgcagtgtttggttttctgtccttgtgatagtttgctcagaatgatggtttccagcttcatccatgtccctacaaaggatatgaactcaaccttttttatggcagcatagtattccatggtgtatatgtgccacattttcttaatccagtctatcattgatgaatatttgggttggttccaagtctttgctattgtgaatagtgccgcagtaaacatacgtgtgtatgtatctttatagtagcatgattataatcctttgggtatatacccagtaatgggaatgctgggtgaaatggtatttctagttctagatccttgtggaatcgccacactgtcttccacaatggttgaactaatttactcccaccaacagtgtaaaagtattcctatttctccacatcctctccagcatctgttctttcctgactttttaatgatctccattctaactggtgtgagatggtatctcattgtggttttgatttgcatttctttgatgaccagtgatgatgagcattttttcatgtgtctgttggctgcataaatatcttcttttgagaagtgtctgttcatatcctttgcccacttcttgatggggttgtttgatttttttcttgtaaatttgtttaagttctttgtggactctggatattagccctttgttagatgggtagattgcaaaaattttctcccattctgtaggttgcctgttcactctgatggtagtttcttttgccatgcagaagctcttagtttaattagattccatttgtcaattttggcttctgttgccattgcttttgatgttttagtcatgaagtcctcgcctgtgcctatgtcctgaatggtaatgcctaggttttcttctagggtttttatggttttaggtctaacatttaagtctttgatccatcttgaattaatttttgtataaggtgtaaggaagggatccagtttcagctttctacatatggctagccagttttcccagcaccatttattaaatagggaattctttccccatttcttgtttttgtcaggtttgccaaagctcagatggttgtagatgtgtggtgttatttctgaggcctctgttctgttccattggtctctatctctgttttggtaccagtaccatgctgttttggttactgtagccttgtagtatagtttcaagccaggtagcatcatgcctccagctttattctttttgcttaggattgacttggcaatgtgggctctttttttggttccatatgaactttaaagtagttttttccaattctctaaagaaagtcactggtagcttaatggggatggcattgaatctataaattaccttgggcggtatggccattttcacaatattgattcttcctatccatgagcatggaatgttcttccatttgtttgtgtcctcttttatttcattgagcagtggtttgtacttctccttgaaaaggtccttcacatccttgtaagttggattcctaggtatttcattctctttgtagcaattttgaatgggagttcactcatgatttggctctgtttgtctgttattggtgtataggaatgcttgtgatttttgcacatggatttgtatcctgagactttgctgaacttgcttattagcttaaggagattttgggctgagagggtagggttttctaaatatacaatcatgtcatctacaaacagcgacaatttgacttcctcttttcctaattgaataccttttattgctttctcttgcctgattgccctggccagaacttccaacactatgttcaataggagtggtgagagagggcatccctgtcttgtgccagttttcaaaggaaatgcttccagtttttgcccattcagtatgatattggttgtgggtttgtcataaatagctcttattattttgagatacgttccatcaatacctagtttattgagagggctgttgaattttgtcaaaggccttttctgcatctgttgagataatcaagtggtttttgtctttgattctgtttatgtgatggattacatttattgatttgcatatgttgaaccagccttgcatcccagggatgaagccaacttggtcttggtggataagctttttgatgtgctgctgatttggtttgccagtattttattgaggattttctcatcgatattcctcgggatattggtctaaaattctctttttttgttgtgtctctgccaggctttggtatcagaatgatgctggcctcataaaatgagttagggaggattccctctttttctattgattggaatagtttcagaagaaatggtaccagctcctctttgtaccgctggtagaattcagctgtgaatccttctggtcctggactttttttggttggtaggctattaattattgcctcaatttcagagcctgttattggtctattcagggattcaacttcttcctggtttagtcttgggagggtgtatatgtataggaatttatctatttcttctagattttttagtttatttgcagagaggtgtttatagtattctctgatggtagtttgtatttctgtgggatcggtggtgatatccccttttcattttttattgcatctatttgattcttctctcttctcttctttattagtcttgctagtggtctatcaattttgttgatcttttcaaaaagccagctcctggattcactgatttttttgaagggttttttgtgtctctaactccttcagttctgctctgatcttagttattccttgccttctgctagcttttgaatgtgtttgctcttgcttctctacttcttttaattgtgatgttaaggtgttgattttagatctttcctgctttctcttgtgggcatttagtgctataaatttccctctacacactgctttaaatgtgtcccagagattctggttgtgtctttgttctcattgctttcaaagaacatctttatttctgccttcatttcgttatttacccagtagtcgttcaggagcaggttgttcagtttccacacagtcatgcgattttgagtgagtttcttattcctgagttctaatttgattgcactgtggtctaagagacagtttgttgtgatttctgtccttttacatttgcagaggagtgctttacttccaactctgtggtcaattttggaataagtgtgatgtggtgctgagaagaatgtatattctgttgatttgggttggaaagttctgtagatgtctattaggtctgcttggtgcagagctgagttcaagtcttgtatattcttgttaaccttctgtctcgttatctgtctaatattgacagtgggatgttaaagtctcccattattattgtgtgggagtctaagtctctttgtaagtctctaaggacttgctttatgaatctgggtgctcctgtattgggtacatatatatttaggacagttagctcttcttgttgaattgatccctttaccattatgtaatggccttgtgttctttgtctcttttgatctttgttggtttaaagtctgttttatcagagactaggattgcaacccctgcttttttttttttttttttttttgctttccatttgctttgtagatcttcctccatctctttatcttgagcctatgtgtgtctctgcatgtgagatgggtctcctgaatacagcacactgatgggtcttgactctttatccaatttgccagtctgtgtcttttaattggggcatttatcccatttacatttaaggttaatattgttatgtgtgaatttgatctgtcattatgatgttagctggttattttgcccattagttgatgcagtttcttcctagcatcaatggtcttcacaatttgacgtttttgcagtgtctggtaccggttgttgctttccatgtttagtgcttcctttaggagctcttgtcaggcaggcctggtggtaacaaaatctctcagcatttgcttgtctgtaaaggattttatttctccttcacttatgaagcttggtttggctggatatgaaattctgggttgaaaattcttttctttaagaatattgaatatttgcccccactctcttctggcttgttgagtttctgccgagagatccgctgttagtctgatgggcttccctttgtgggtaacccgacctttctctctggctgcccttaatattttttccttcatttcaaccttggtgaatctgacaattatgtgtcttggggttgttcttctcaaggaatatctttgtggtgttctctgtatttcctgagtttgaatgttggcctgccttgctaggttggggaagttctcctggataatatcctgaagagtgttttccaacttggttccattcgccctgtcactttcaggtacaccaatcaaatgtagattttgtcttttcacatagtctcacatttcttggaggctttgttcatttctttttactcttttttctctaaacttctcttctcacttcatttcattaatttgatcttcaatcactgataccctttcttccacttgatcgataaggctgttgaagcttgtgcatgtatcacatagttctcatgccatggttttcagctccatcaggtcatttaaggtcttctctacactgtttattctagttaaccattcatctaatcttttttcaaggtttttagcttccttgtgatgggctcgaacatcctcctttagctcggagaattttgttattaccaaccttctgaagcctacttctgccaacttgtcaaagtcattctctgtccagttttgttccattgctggtgaggcgctgcgatcctttggaggagaagaggcactctgctttttagaattttcagcttttctgttcttgtttctccccatcttcgtggttttatctacctttggtctttgatgatggtgatctacagatggggttttggtgtggatgtcctttttgtggatgttcatgctattcctttctgtttgttaattttccttctaacagtcaggtccctcagctgcagatctattggagtttgctggcggtccactcctggcggtccactccagaccctgttttcctgggtgtcaccagtggaggctgcagaacagcaaatattgcagactagcaaatattgctgcctgacccttcctctggaagcttcgtcccagaggggcatcgggctgtatgaggtgtcagtcggcccctactgggagctgtctcccagttaggctacatgggggtcagggacccacttgaggaggcagtgtgtccattctcagatctcgaacaccatgctgggagaaccactgctctcttcagagctgtcagacagggacgtttaaatctgcagtggtttctgctgccctttgttcagctatgccctgcccccagaggtggagtctacaaaggcaggcaggccttgttgagctgcgtgggctccacccagtttgagcttccaggctgctttgtttacctactcaagcctcagcaatggtggatgcccctcccgcagccaggctgccgcctcacagtttgatcttggactgctgtgctagcagtgagcaaggctccataggcgtgagacccatcgagccagacatgggatatactctcctggtttgctgtttgctaagaccattggaaaagcctagtattggggtggcagtgtcccgattttccaggtacagtctgtcacggcttcccttggctaggaaacggaaatccccccaccccttgtgcttcctgggtgaggcaataccccgccctgcttcagctcaccctccatgggctgcacccactgtccaactggtcccagtgagatgaaccaggtacctcagttggaaatgcagaaatcacccgtcttctgtgtcgatcacactgggagctgcagaccagagctgttgctattcggccattttggaaccaatcccaacaattttttttaataacagtaaaaacaagaaattcgaagccctggagagggcctataagaaaagcaagaagtcaggcacagtggctcacacctgtaaccccagcactttgtgagggcaatgcaggaagatcacatgaaatcagtagttagaccagcctgggcaacaaagtgagactgtcactacaaaaatttttgtctaaattaacctggcatagtggcatgtgctggtagtcctagatacttgggaggctgaagcaggaggattgcgtgagcccagatgttcaaggctgcagtgagctatgatctggccactgtacaccagtgtgggcgacagcgcaatatgttgtgacacatgcaccaaaaaaaagagaagcaagaaagaacgtaggaagaaatcaatcttgttcacccagaaattctccaaagaactcagattttttactctgtgtttttaaatattgagaaaatggaaggcatgtaactaacagcatatttttaacagtttaaaaaaccacagtcatcaagagtaatttcagatgagctgaaaaccagataaaccacaacattcccctgtccccaaaaaggacttttttaaattacaggaatagaaaagaaataatcctacttgttggtggtcagtattgttacagtaacaccaagagatcagagctatgaaaatcctaacctcttcctaattttccatcaaaaagcctgattttccaccacagaatgcaaatgaaaaccacaatgatatttcatctcacactagtcagaatggctagtattgaaaagtcaaaaacaacagatgctggtgaggctgtggagaaaacggacaacttatatcctgttagtgggaaggtaaattagttcaactactttggaaagcagtttagagatttcttaaagaacttaaagcagaaaactaccatttgacccagcaataccattactggctatatacccaaaggaaaatagatcattacaccaaaaagacatatgtactcctgtgttcattgctgcactattcacaacagcaaaaatatggagtcaactagctgcccatcaatggtggatcggataaagaaaatgtggaggctaggtatggtggctcatgcctgtaatcccagcactttgggaggccaaggcaggtgaatcatgaggtcaggagttcgagaccagcctggccaacatggtgaaagcccgtctctactaaaaatacaaaaaattagccgggccttgtggtgggcacctgtaatcctagctactcgggaggctgagacaggagaatcgcttgaacccagcaggcagaagttgcagtgagccgagatcgcaccattgcactccagcctgggtgacagtgtgagactccatctcaaaagaaagaaagaaaatgtggaacatatacaccacggaatactacacagtcataaaaaagaatgaaattggggtcacagtggagcaggctctcatgtggaggtggggaagtttggtccatcagaatgatcaccaagaaacacaaagcagacctgggccctgggctcccagagaagaaaaagaagaagaaagtggtcaaagaaccagagactcaatactcaattttaaacaatgatgattactttgccaatgtttctcctataagagccacatccccctctaagagtgtggtccatgggaaggcacctgagatgcctctagtgaagaaaacaagtaaaagaagggtgtcagcaccctttgtgaggagcacgtagaacctgacaccacgctgcgtgccagacggtcagagaagtcacccaatcccaggaagcaggtgcttggccatttggagttcctctgtggggagaagaaaaagaagaagtcacctccagccatgtcccatgcctctggggtgaaaacctccccagaccccagacagggtgaagaggaaaccagagttggcaagaagctcaaataacacaagaaggaaacaaagggggcccaggaccccacagccctctcagtccagaacccttggttctgcgaggctggggatgctgcggacacttgctcagtggggaagaagggtgaggaacaggcagccttggggcagataacggaagcagaagagccccagggagcacagtgggaaggtgaagaagaagaaaacaaaaatccaccaggagggagatgccctcccaggccactccaagcccttcaggtccatggagagcagccctaggaaaggaagtaaaacgaagccaaagttgaggctccggaatacatccatccccaaaggagatggccctaaggcccccgagaagaaaaagatgaagtccaagaaggtagagcagccaatcattgaggagccggctctgaaaaggaagaaaaagaacaagaggaaagagagtggggcagcaagagacccttggaaggaggaaacagagacggacttagaggtggtgttggaaaagaaaggcaacatggacgaggcgcacatagaccaggtgaggcgaaaggccttgcaaggagagatcgatcgagagtcaggcaaaacggaagcttgtgaaaccaggaagtggacgggaacctagtttggccagtgggatactgctggttttgacaacgaggaacagaaactgaagtttctcaaacttactggtggcttcaaaaacctgtccccttcgttcagccgccaccccctccaagccccgcagcacgattgcaaggtccaacatagccctcagcaagaaggcggccgacagcctgcagcagaacctgcagcagaacctgcagcaggactgtgaccgggccatgagctggaagtacagccgcggagcccgtctctgcttctccaccgcccccaacaagatcttttatattcataggaacgcttccaagttagccaagctggaagattaaactctagagttttgtcccctcaaaactgccacaattgctttgattatcccatttatgctggagattacaagttttttttggtgaaaaatcagatcttggtgatgaccttgagcagtaggatataaataactcccataaacttagcgttccaataatggaacactaggcataagtgggttattcagttgtgctgatgaaagccatctgacagttggctcacattgaacacctgtggagactaaggacaaggacaaggacaactatcttgatgggcttggatgaactggggagaggcagctcatgtttggggagccaggagaacaagtgagtggctaaaacctcctgttttctgtgttaaacattccgtccctgtttgagacatcaatgtgtacagatgacctttgttgagtgtttagcaggtgctaggcacatactagtgttttccttaatgtatttaatcttcataattatgaaatgggtgctattattatccgcatcttatagatgaggcaaaggaagttcagggataaagtaataaaatgccctgggatcacccaaccactaaaaacaaacaaacaaaagaatgaaatcatgtcctttgtcccaacatggatgaaactggaggccaaagtcctaagcaaattagtacaggaacaaaaaaacaaataccagatgttcttacttataagtggatgctaaatgttgagtacccacggtcgtaaacatgggaacaatagacactgcagactactagaggggaggggaaggagaagggcgtaggtcaaaaaactacctactgggtactgtgatgactaccagagtgtaatacccatgtaacaaatctgtacatgtaccccctctatctaaaataaaacttggggaaaaaaagcatgattttcttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcgttgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagtcctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatgatagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtgtggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgactttctcttttcctaattgaataccctttatttccttcttctgcctgattgccctggccagaacttccaacactatgttgaataggagcggtgagagagggcatccctgtcttgtgccagttttcaaagggaatgcttccagtttttgcccattcagtatgatattggcggtgggtttgtcatagatagctcttattattttgagatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatccatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgagtttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctggagatgtctattaggtctgcttggtgcagagctgagttcaattcctgggtatctttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacatgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcatcagttgatgcagtttcttcctagtctcgatggtctttacattttggcatgattttgcagcggctggtaccggttgttcctttccatgtttagcgcttccttcaagagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggttgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggttcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagctgcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgctttggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctcccatgattttctttttttaaactaaaagggatttttaaaaatatgattaagaaacagtgaaaatatgagatgggaaaattgttggctattaataagttcatatttttgcatctagctttgtatcataaggtatcaaagtatttgaagatgaaactgaagaactttcattaatagtttctcataatattttagcttttatttatgtacaggagtatgataaattttaaaaaatcttgaaaaaatgtgatgaatgccaaatgaccagagagagaaaaaatatcctgagtgccaaaaaggagtaaaataggaggccctgggctttgtatattgataagctcaataacaattcctagaaatattctagatagaatattaagcaaatgatttataataaatttgagggccaggcacagtggctcatgcctgtaatcccagcactttgggaagccaaggcgagtggatcacttcaggtcaggagttcaagaccagcctgaccaacatggtgaagccccatctctactaaaaatgcaaaattagccaggcatggtggtgcacgcctggagtcccagttacttgggaggctgaggcaggagaatcgcttgaacccaggaggtggactttgcagtgagctgagattgcgccattgcactccagcctaggcaacaagagcgaaactctgtctcaaaaaaaaaaaaaaaaagggaaagaacaactatcattcctagaaaataacataagttcatcaagagtaaaaaaattacattaaataatgcttatttcttattttgataggttaaccagattgctacatcaggggaatagagtagataaaatgtcttgatttcagcaaagcactgataagtgctttataatatctttgagggaaacaaagagaaattcaggtaagatgatagtcgtgggagaagaggtacctgataggggtgctccaaagtcaagatatggtgtttgtaaagaaattcggaagataagggtaaaacattaggaggttcttgtttagggagtgggtagttcatgctaggaataaatgaatcaagattaccatagtaatatgtaaatgtaacaaatataaagactttccagaaatccaagtgagcaaaatctattcattttcatttaagttcaatttgaatcaatggcgtcatttagttcttttaaaaaaaatgcaactttagattgaatactcccatttcaaagaaagagtagtaatagacaaaaacacatctttacggcttttgttacttggtcaaatatatcctgaataccttgtaacgtgcagaaaacatctgtggctgcttacataatatatgcggtacaagtggataaaaataagcaaaagtttgtcttcccatttaactgaaagccctgatgaggacacagactatgcctgagttcccagttcctggtacaatgtctgtaaatatttgtgattgatataatacagtgaaagtaagataatgatagaacagtgcaaagaaattgggaatgaagttaatccataaaaatgtataccagaaggatctgggacactattactatttgtaatgtgggtcccaaattcacctttgagcctcttggcatccaaggcaaggaaacaaatatgttaaaagatcacagtctccgaaacctaaaacttcatcccttttgccagaagcaacgtgttaatagatttttcttgcaataaaatcctgagagaaatttctcacaggatgcctcattgagcaaatacaatgtgaaatagggagaaattcttaaaatacggtaagctggttaaatgctttttactcctagttaaagtaattcctttagggaccaaagaagtagggtccaagtacacagattgccagtggtcagctttgctccaggccctgtggtgtggtaggaaaagtacaacaaattaagtgattgcatatacttgagacagtcttttttgaaaccaaacttttgctgtagctgggcagtatccagtttgaatctgtattccccagcaagaatggacaatgcagatatttactgttggtgattaaatgccaattcttttgcttacactgaagaatgagaatgagtctcagtcccactttgagggatgtaacaacaaactgggcaaacgtaaagaacagtgacaaggagaatgacacgtcaggacataatttcatatacaaagtaggcagcaaactgggctcggtatattgaatctgaagaccaacagggaagtcatgataaaaccaacctcaaacatctgaagaactctcttagggaggaaggagcacacgtcttctgtggtccagatcctgaccaaggagtaaaggtcccagacaaggagagcgaactcaggagaaaatcaatttccaacggtagagctgtctgtaacagggctatgccgccgtaaaatgatgggagggtcctggatgctggaggggtttagagagacactgcacaactgtctatcagtgatgtttcaaaaataatccctgtcctcaaagggagactgaatcagaaatccttctggccacacgaatttcctgatcctgaggtgagaaggcatgctccatgtctgtctacgcggagtccactgactgctctgagggaaacctcttgaactgtttatgggttctgttgccatctcctagcttttttacattagccatagtcctttaaagaaatactctaagcaagcagaaaccacagtttcccataccctccaatttcctcttaacatcccacatgtaaaatgcaatatttcattctttaaaaactgctcgctgatgacgatatttttaaaacttcacaggccgggcacagtagctcatgcctgtaatcctagcactttgggaggtagaggcgggcggatcacgaggtcagaagatcgagaccatcctggctaaagtggtgaaaccccatctctactaaaaatacaaaaaaaaaaaaaattagccaagcatggtgatgggcacctgtagtcccagctactcaggaggctgagaaaggagaatggcgtgaatccggaagggggagcttgcagtgagccgagattgcgtcactgcactccagcctgggtgacagagcaagactctgtctcaaaaaaaaaaaaaaaaaaaaaaaaaaaaattcacagagatttcagtgatagtatttattgattagggtctttgttaatatttaaggttcattgcacttgaaaagcagaatcgtgcagtgttctaatcaattattccaaatcaccgttaaagacactaaaaatgtcatatttaatttttattgctttgcagtggaagctgaggcatgctctgagtagatcccaggtgccaaatgcacttctcttatggaaacattatgcataaaggatattttgcaaagtaccaagtttagaaagaaaggtaaatttaggatgctggaagaaagaaatgactccagtgcttccctctgctgatgaagttttgatttcattaggtggcctgtcctccaggcaaagtgctgtgccagccagtggggtcagctatagtctctaatgtcagcaggcatactccagtcatcataattcatgaaatgctctcaaggtcccctgtcaaatgcactgaagatcatacttcatcaaagcaatacttaaagtttatgaaaagtcagaagcagggttgaatttcctttggaagttatttctgaagaattgttttcttaaaatattctatatcttcttcctgttagcatcttttatttcaatcctatggttccattccatttaaaacatttaagggccaggcacggtggctcatgcctgtaattccagcactttgggaggccgatgcgggcggattatgaggtcaggagatcgagaccatcctggctaacacagtgaaaccccatctctactaaaaatacaaaaagcattagccgggcttggtggtgggtgcctgtagtcccagctactcaggaggctgaggcaggagaatggcgtgaacccgggagaaggagcttgcagtaggtcaagatcacgccactgcactccagcctgggcgacagagtgagactccatctcaaaaaaaaaaaaaatttaagatctcccctccctcaaaactttcttaatgagtataactaacttacatgggccattatgccatggaacacttacagtctgccaaaatgcttgcagagagcacctgctaggtggaaatgtgtggttgcttcaatcagcaaagcctactctgttgatttgactgttgtatcatgctaagttcagggagatgtctactttaaacctcagctccatttctcctttcttcattgcatcattcacaattgtttgtgagtacctggggattgtgtgtttgtgtgaatgccaatagggtaacttgccatggttcgttcagtagagcttttctgaatgttttattttcacatcattttcattcttgctaaatgaatctgtgcttgatgcactagttctggaagctagacattatctgttatacaagcacccatgagattcccaagtcaagctttttgtcaaattaaatctaacaaattgattcttaattaacccacaagaaaggctgatgatagttttcttgagtaaacatagagtcctttgagttggtaatatttaaattttttataaatttccttctttttctcttacaataatcagtgccttccaaataagttttggataaaagatctagatcaaaatgaatttcctcagaaacaaaatataaatgactgtttcaggcaaaataaaggccaatagctgttccagactaattttgaaggaatatccatcttatgatacctcaggattaacgtatacatggaaaaacattcatatattttaaactcatcataaagctgacaggtgcaaaactgggccctcttccagccccgtcttaccaattctcaattacagatgtcttaatttttatgtgtgccatgggcccttcagcaatcttgtggaaactatgaaccattcctcaaatatatgtgactacaaaaggaaaaattatgatgaaatctattattaaaacattacacaaatttgcaatatggcaatgcatatgcttctttattaaaaacaacccctagcagtagggctaatagctacataatcttgaaatgatgagcaaaatcaatattcaagatgaaacaattatggtttcatctacaactgtaaaatgagattttaaaatctgtgatttttgtgagcaacaaattcacaagtacggctaataccatcatgatctattgccatggttagcgaaagataaacacataaatatcccccctctatgttcactaccccctaaattttacacacagatcccctggaggaccgtggactctacattaggatagcctgagcccagtgactcttgccaccgcttctacttgtattcaaccactagagaggtgcgttggggtcatggtcagtaatcagcatgcatacatgcgcacaggatcctcagaagcaatagagtcagcaaaaccacacacacaaacctcactatgtcactgccaatcagcccaacatctgaacactgtcaccttacgggggtcactctgtgtcagttcagtgttttctccagccagaaagtctgcctctggcaatgataccaagagctaattcagagcagaatgtgttcattgttctccatgatgtcatttgccaaatgaaagaaatggttctagaatatcctctatgcttatttaccaaaactttatatgcttggtctgcactgtcaggataacatgttccatacatttactttttctagggggaaaaaaatacttccatatctccagctagaatttatagccgagatttaaatccacatttccacgtggatgtctaaaactggatttatcctcttctccccaaaaccagtttctccttctgactttgacttttcttctcctgacttgtacagtcatctcagactttccagccaccacacccgcttcccagactccactccccaatttacagcatcccttcagtctccctgtttattccattctcatttctactatgttcatttacagcctaacctagattcactgttacccttgttcctgcctctcactactcagatccattctatacacactgctgccaacttaattttcccagaaggcaactctgatgacccttttatcctgtccagaaatcttcaatggctccccattttctactgaactaaatgcagactctgccctacaagcctctcctccacttagctccagactcccaattcagccacctgtttcatcctgttctgcaaactttgataattctcgttccatgaaacaaaaggcaaatagtttgcctcattcattttctgacttgctgccttccacattttgtaccctccttctaggatgtgtttctccagaaatttctcttgttgaaaccttactcttccttcaaagaccatctcaaacaccatcttttttttggaacacttcttgatgtgctcccacctttcccaactaaatagaatccctccccactttcagcctctgtagcatttttcttagcacttatctgcctctgcctttcattctgatccaatgtgttcactttgcccacctcactagattttaattcctagtggtaagaatttgtagaccattcctgaaaatccatttttggcataggaattatttcaacacaattgaaaacatgtattgagtacccattgtagaaggcactgtaccaaaggctaccagctgtacaaggctaaattaaaacagcattcaaatattgatgaagaaggaactagcaataagatgtgtttcgagcacagacatagattataaaactgccattgggatgctcttgaaggaggaaagcatcttaatgattaaataatcccctgctcgcttttccaagtgttttctgggaaacctggacttggtggggaaagggagggaatatccagataagggctcctcaccagaggaggacatctatcactgtcatctgatgccacatcatcctcccaactaccttagtaatccctgtattttactttctcatttatagtttgggggtcaggtaggtgcactggattttgaccactagtttgcaaattttagtccattaggaccaacttaaaatataatccacagtatcctgaatcattagatgcatgaatcaaaagtaggatgatgccagacacactttgggaggctgaggtgggaggatcccttgaggccaggagttcgagaccagcctgagcaacatggtgagaccctgtctctacaaaaaattttaaaaaaaattagccaggcctgctggcctgcgcctatagtcccagctctcaggaggctgaggtgggaggatagcttgaaccctaggagttcaaggttaaagttacaatgagctatgaatgcaccactgcactctagcctggtcaacagaggaagaccctatttctaaaaaaataaaaatgaaaaataaaaaagcatgatgaatcattaacatcgtgtactaggttttttcactagcaggctctttcctcttggagccttctgtttagaatggcaacccctttcccctcagtttgaggagatagagaagtgtcttcctgagccgagaataccaccaccattctcatctctgatgcttattcagcacactgcatagaggcttagactacacagtgcttaggttctctttctgctacacaaccttggaagagctacaaatgttaattctcagttttcatatctgtaaaatggggattataataattttattccataaatttctggggataacatagagataattgataatgtaagaatgaggagaatgcatttaaaagggacttagcacagtgtccagcttgtaggaacccctctatgaatgttagtcattattatcagcatagaaaacatgttgggataaatataaagaaacaaggaataaatgtggtggggtcatctattgacccctgaatagtcaggggtcaacaaacatttctgtgggccttactgaccctgttataactactcagttctgcaatcatagcatgaaagcagccatagacaatacataaatgaatgactgtgactgtgtgctgataaaactttatttacacaaacaggcattaggagccagatttgtcctgtaggcataattaggcaaactctggctatactgcccaaaccctggcctttgggaacttccaatcaagtgtggtggtaagacttgtaagacttttcaggggaagcaaggaggagtcagggactaacttcaccatcatccagaggagcatagaaacttggtattttaagacagcttactatatgaatttcccagagaggaacacaagtaaaaaatatgacctagagcaaatagctcaggttttttttttaacactgcctttcaaaataagtaacttcaactttgaaacagagccttcccttttagtagacattttccttggaaactcagctcccgccttgatcctagaagttacacatttgtaggaataaaaatatctgtagattaattggtagacaatgcctgatcctgaattctgtttcttatccttatatatgaatagacagagctgagaagtcatttatccagcagtttgactagaaggaaatggaaagtgtatgggtagcagaggaaatcattcacttccttttctattcttattattaatatatgatcttattattaataatataaaggaatagcaaatgagaatccatgagcaatatcagaccatgaaaatgagccagtggctgagtaacaaccaattaggacacttgatagtttagcaaagttgccaaacaggagacagactcggctcctttgaacgaagagtgactgcagtgtggattccccagataggagagcaagaacatactttctgggcctctctcaggatcgttgtttgggaaggaagttgtatgggaaattcacaaactcttagatgctaacatttaaatgcagcatgccacacacacaaacccacaaacacaacctttttttcatcaataaaattgcagaggagccccatttgcacagtatatcacattgtattttaatatccaaaatggctagtcccttccagagtttttatgagttaatgtgtgctaatttaatgggcctggtgctttattcatttgaagcaagaaattaagtctgtgataataaggtaaggttcttatcagatttctctttttgttgttttacagttttctccttgtctttggttgcttgattttgtcagtgttttctaccatccctgagcacacaaaattggcctcaagttgcctcttgatcctggtaagtgaaacatgaacaagaacgtacatgaatgttgtataagaactgcctataacatttatactatgcatcttatcctacaaaaaaatcctatctaaaaaagagttactgagaaatataaaaatgtcaaagattactgaaacatttgcccaccaatttaacatgtagtcaatccttagaaatatatagaaatgttcaggattgctattacacagcaatatcttgtgttgtagatatatcataaatagaaggcaatattagaaagcagttttaagtatgtttatctatgctaataaacaaattatataagaagaatcagtatctatgaggcctctcattatattgtgaaagactatagagtagagagcattttccaataactgtaatttggcagtagctaaatataattggccaagaactatgaacatatggcacctcataagaaaatagaaggctccttcatgctcttttcaaccaacagactgcattatgagttttgctgctaatgcagttacctggtgataaattctgcagtttgctctgtttccattatgctgtcaatcctcaaccacacagaattgctcaattcactttaaaatggaaaaagaccccaagatatttttatcagaattattctgagccttttaagctctcatactttctattacaactaaactatagcactgtacactctaatcacatctgattgaaagtttggttcattttcaactattttgacccactcactttgtccaaaattatcagatttgacagtcttagagctatttgaatgaactacaaactggaacagctcactgtttctgtaaagcctaggggtatacagaagcagggggaggaaaacggtaagatggtttatgtgccctaataagcagaggttggttatgttacagcaataaatattgaatatgaaaaaattgttactaccacgaaggtggaaactgaaagatttcaactcatataacctgagagagggggcagatgcttttcctacctttgctttcagatggctagtttgtactcaaggttgctaagacatcatcaagtctttctgtgcaatatcagggagacctcattttgaatctgtaataaatctctctcaattcatttgcatacaaattgtgctccagcagcatattgctcatgttaaggttaccgtttcaaagcccaaggtagagaacagatagaccaaagagcacatcagagatctgttccatttgcaagctttccctttgggtagaaagtaggcttttaaccttgtctgcccttttgataacacaaatgatctgagcccaagggctaaggtatagctggcttttaggtccacatatggaactacaaccaggaattttagactgaaaatataaatctgatttttaaacttggaaacaaaaaactggatctactgcatgaccaatattaggaataaatcaatcattaggaatctcatgaaaagatttcttccagagccaggtcaaaaatccaaaatgttagatttatatcctccaaacctctgaaatataaattctgtcattgctaatgaatttctaaatagtccaaagaaacccatgtaatcacaaagtctaaaactgattagtatcttgacttttaaaacctgttaaatagtgaacaatggatcagagtttagtaactagagtgcatttagtagaaaataaaaatgtagatgtcagtcttgaatgctttctgatttagcaaggtggaaatgagttcctctatgcagatgaggcctttgttttgagcaatgtggttagtgctacagatatatattcgcagaaacctgttgcaacaaggctttccatagggagagggtttgttaatcctactatctttgtactatagtgatacattgtcaaagtatattctcaaaacctacctagaaatatgcagactgcattgcagagctaagattcacagatgaaattcttcaccaatgttttctccaaaatctttttatctggacacaaaaattcaaatactgtcttttactttttctttagcaatgaataaattaggaaagcattaatattttaattatttttcacaatgagttaacatagtatattataaaagttcaatcatttgtagaagatttggaaaagtcaatcattaagatgacaaatcttaatgatttaagtaatgtctcatttattaccttttaacatgtatttttgagacagttactatgatttcaaagtcacagaactcatagaacacgattctgattagcagtaaagttcccaagatgagacatatcgaaggaattaccatccaaaggaagaagaaggattatcattgaaatagtaaaaagcaatggcttttaaaatgcttgcaagaccaggcacagtgactcatgcatgtaatcccagcactttgggaggccaagacaggcagatcacttgaggtcaggagtttgataccagcctggccaacacagtgaaagcctgtctctactaaaaaacacaaaaattatctgggtgtggtggcatacacctgtaatcccagctatttgtgaggctgaggcaagagaatagcttgaacccaggaggcggaggttgcagtgaaccgggatcgcaccactgcactccagcctgggcaacagagcaagactccatctcaaatatgaataaaataaaataaaatgtttgcaaaaatgtacaataaatccacatttgtacacttttcgtgtacactgttgatgtataaagacaacaccagaggtgtacatttagaactatgtgtaaatcctatatcaagattgtgtattttttcataacttccatcccttttggtttttttaacattttaaaatatgttcagatatttcctacaattctatttctgtgcaagtgaaaggcaccgacacttgtgacagggagcacactacaggcaaacctggcttgtagacagagccctctttgacactcactcttttccacctaattgttcccttgagggcaccagcgtgttaggtgcaggccatccctttagacatctcttgcttgcctcctgggggcccccataaggactttcgctgtccatcccacatccaaaaaggaagtctcccctcatttccatccagaatggcactgccaacgctcttgtaaacttgtaacttcacaaacttgccttggttacaagccaaatgaatacctgtgttaatttgctcatttattcttttcagttgtgggaactgagatttcagcctatacaaccaggttccttatttctctccatagaagcagtggagcatagacttaagaatgtgatacagactatagtcgggctccatgaattcaaatttcactcctgtccaattttagctgtgcgacttggaaaatcactccactgtgccttagttgtcttatctgttaaaagtgaataggaggattctagaagaaagacagagtaggaatcaccaggattctgtctccccacctaaacaacaattgcactggcagaatttgatgtaattcaatggatggaactctggaatctattgaatgtttgcaacttacagaggaaggcttagatggtaagttgcagttaattttgtccatttcagctcttagcacagtgatagctacccatcccctacgcccaggcccattgcaggcagctgtgcacatgttccaggagggacctgaacacagcttataagagccaggatgggcaaaaagaactctgtcctccaaatatcagaaatctgacctcggatcactaattgctgcttctgatcacagaggcgcagacaaaaaatgtggcagccattgctgttgcaccttcacccattgctgtaagcccctcccctaccagcaaaagtgacttctaggggattaaaacgatcctccccacatccttcatttttcttttttccttttttggaatacagtgtataaagatgtaattatgtgacattaataactgaaaggtgtagggctagagatgtaaaggagcagagtttttgtatgccattaaagttaaactggtataaattcaaattagagtgttataactttaggatgttaatttaattcccatggcaaccacaaagaaaatagctatagaatatacacaaggagaagtgagaaaggaattcaaacatttcactacaaaaaaaaaatgaactaaacacaaaagaaggtagcaattcaggaaatgagagacaaaaaaagctatgaagtatatgtaaaacaaagagcaaaatgatgaaagcgtctccttatcattaattactttaaatgtaagtggataaaagtttctagtaaaagacagagattggcagaattgataaaaatacatcattcaactgtgtatatgcttagtacaagagacttactttagattcaaagacacaaatacattgacagtaaaagggtggaaaagatattttatgcaaatagtaaacaaaagagagcagaggtggctatactaataacatacaaaatagactttaaatcaaaaaagttataagagataaagaagggcattatatattaataaaaggtttaatacaacaagaagatgtaataattataaacatttatgcacctaataacaggtaataaaatacatgaagcaaaactgacaaaattaaagggagaaatggatagttctacaacaatagttgtagacttcaataccctactctcaataatggatagaacaaccaaacagaagataagtaagaaaacagaagacttaacacaataaaccaactaggactaacagacataatacagaacactgtacccaataacaataacataaacattcttatgttattcatatgccattatgttagcccgcaagttaagtctcaacaattttaaaagatggataccacacaaagatggataccacacaaagtattttttccaaccacaatgggatgaagttaaatatcaataacagaagtaaaactggaatattcaaaaattaaacagcatgcctttgttttatttttttttcttgagacagagcctcactttgtcacccaggctggagtacagtggtgggatcttggctcattgcaacctcgacctcctaggttcaagagattctcctgcctctcagcctcctgagtagctgggactacaggcacgcaccaccactcccagctaatttttgcatttttagtagaggcagggtttcaccatattagccaggctggtcttgaactcctgacctcaagtgatctaccaacctcagcctcccaaagtgctgggattacaggtgtgagccactgtgcccagcctaaacagcatacttttaaacaaccaatgggtcaaaaaataagtcttagaaattaatgaaaacaaaacgcaacctgccaaaacctatgggacacagtgaaagttgtgctaagattaaaaattatagctataaatgcttacattaaaaaaagaaatatctcaaatcagcaacttcattttacaacttaaggagctaaaaaagaatacagtagacccaagctagccagaacaaaggaaacagtaaacatggataaatgaaataaagactagaaaaacaataaagaaaatcaatgaaaccaaaagttggctgttagaaaaggttgacaaaacagacaaacctttagatagatgaactaagaaaaaagaatactcgaattaatagaatcagaaatggaaatgggaatattgctactgattctacagaaataaaaaggacaataagagagtactgtgaacaattgtatgccaacacattggaaatctagatgaaatggacaaattcgtgaaaacacaaaacctaccaagactaaatcacaaagaaatagaaaccgaatagtgctataactagtaaggagattgaatcagtaataaaaaatctttcaacaacaacaaagaagcccaggatctgatggcttcactagtgaattctaacaaacatttaaagaactaatatcaatccttctgaaactattccaaaaatataaaaaagaagcaacacttcctaactaattctatgaggcattactttgatgccaaagacacaagaaaaagaaaaccatagaccattatttcttatgaacattagtgtaaaaatcatcaacaaaatgctcgtatatttaccagaatattaagaggattatacaccttggtcaaaggggatttagtccttcaatgaaagaataattcaacacacaaaaattgatcagtgttataggccacattaacagaatgaagggaagatgccacataattatctcaattgaagccagaaaaaacatttgaaaaaattcagtacccttctatgattaaaatatatatatatactccacaaactaggaatggaagaaaactacctcaacatgataaaagccacatatgaaaaacctacagccaacatcatacacaaaggtgaaagactaaaacttttcctctaagatcaggaagaaggcaaggatgtctgtgtttgccatccctattcaacaaagtactagacggctgtactaattgctagctagagcaattaggcaactattaaataaaagaaacaaaaggcatcccaactgaaaaagtaagtaaaattatccctgtatacagatgatgtgatcttatatgtaggaacccctgaagatttaaaaaaaaaaaaaagactgtaagaaataataaatgaattcagcaaagtagcaggatgcaaagtcaatatacaaaaatgagttgcattttaccaacaatgaagaatttagaaaggaaactatgaaaacaattccatttataataatatcaaaaaatacttaggaattaacttaaccaaggagatgaagaacttgtacaatgaaaactacaataacattgctgaaataaattaataagacataaataaatggaaactcattccctgtccatagttttgagaacttaatattgttaacatgtccaaagtgatctacagattcaatgcaattcctatcaaaatcccaatgatgtttcttgcagaaatagaaaaacccatcctagaattcatatagaattttaaaggacccccaaattgcccaaactattttgaaagtaaagaacaaagctggaggacttataattttttattttaaaacttactactacaaagctacagtaatcaatcatgaggtagtttcctataacattatgaatgtatttaagctacagtaatcaatcatgatgtagtttcctgtaacattatgaatgtatttaatacactgaactataaaatgattaagctgtaaattttatgttatatataggcataaagaccaacatttagacccatggaatagaatagaaagtccagaaataaacccacacacttacggtcaaatgatttttgaccattcagtggggaaagggcagtcttttcaacaaatggtgatggaaatattagatatccacatgtgaaagaatgaagctggacccttacctaagacaatacacaaaaattaacttgaaatgccttaaagacctaaaactataacattgttagaagaaaacataaggcaaaaacttcatgacattggatttgtcagtgatttcttggacataacaccaaaggtgtaggcaacaaaagaaaaaaacagagaaactgaacttcataaaaatttaaaatgtttgtgcatcagaagacagtatcaacagagaaaaaaggcaacacacagaatgagagaaaatatctgcaaataacatacctgagaaggggttaatatctggactatgtagagaatttctgaaactcaacaacaaaaacaacctaattcaaaaaatgagcaaaggacttgaataaacatttctcaaaaaaaaaagaggtacaagtggccaataagcacatgaaaagatgctcaacattattaatcattagggaagtgcaaatcaaaactacactgagtaccacctcacacccgttaggatggctactatcacagaaacagaaaataacaaatgttggtgaggatgtgggaaaatggaatccttgttcacaattggtgggactgtgaaatgctatagccactatggaaaacaatacagctttttttcctcaaaaaaataaaaaatagaattacatgatgcagcaattccacttctggatgtatgccaaaaacactgacggcaaggtctcaaagagatgtgtacacccatgttcatagcagcattgttcacaatagccagaatgtggaaacgacccaagtgtatactgacaagtgaacggataagcaaaatatggcatatacatacaaaaaaagtattcacccttaaaaagaaggaaattttgacatatgcttcaacatggattaatgttggggacattatgccaagtgaaataagccagccacaaaaagaaaaataatgtatgattccacttatatgagtgagatacctagaatagtcaaaaaagtatagagacaaagtggaatggttgttgccaggggctgtagggatcagggaatagtgagttattgtttaatagatgaagagtttcagcattacaagaagaaaagagttagggagatgggtggtggggatggttctgtaacattacgaatgtatttaataccacactgaaccatactttaaaatggttaaactgtaaattttatattacatatattttaccacaataaaaaaattgagaaaaatcttttaaaagattaaatgagcattaggaaaaatagctaatacacgctgggcttaatacctaagtgatgggttgatagatgcagcaaaccaccatggcacacatttacctatgtaacaaacctgcacatcctgcacgtgtaccccggaacttaaaataaaactaaaaattaaaaaaaattaaatgaaatttaaaactcaaaaaaaaagtggttaatgatatagcctacttcataaggctgatgtgaaaattagataaattcaagtgcttaggactgggcccaacagaaagaaaactcttggaaagatagcaaatatgatcatcatgggatcttccatgtttaatggagacctcatagggacacaagtacaggtgaactgtggaacatttgaaaatgctacacttaaggaaatattatattttataatagaaaacaagtatctgtgtaagagttttctcaccgcaatcactgttaattatggaagcttgctacataaacatgttctctaaaagtgactcagtggtacacattcggcatgcagcatgtgttcacaatagccacttatttctggtggctaatgaaactgatttcaattgttgaagcattttagtaaatacgtctgatgacagtgcttgtggctttatatctcttctctcgatgtctgcatctactgagtgaaacattgggcaggaataactccagatctgatggacttgcttgctctgccatcaccctggtgataaaatttgtgaactcaagaacgtgtatgaaactgtgtgtccacattccagggacagttaaaagctggtgttaatttcctatatttggtgattccatcaaaaatgaaagggagccagcattttttaagtacccttcatttattaggctcattgatttcttactagaaaaataaaactggcaatgtaagtatcccctcccattttcacaaatagctaaataagttgtgcaagataacacaccaagtgtaaaatagccaagattccagcttaggcctggctgaggaaaagactgggctgtcttcagagcatcccgctgcctctcattctcttgcttctttcaaggctgacaagtctaccaaaatgcatttgccagtacccaatgaagtgctcatgtctaaggcttctttttgttccatatatgccaaataaggcttacaacacttttacttaggatgctgtgctttcataaagagttccacttaccaagttatcacaaatgggtatatcaattcagaccactagaagttctttgtactgagaattctaaattctgttttgcaaatattcaagagcctgattcatggggtaaatagtcaagtgtaaaagttcatcttctagccccagttcactttgctcaggtgagtatcatgctgttgaagtgagttctcctatttccaggttagactattgtggtaagttttgtttggtttgttttgatttcattagccaaaggttgtaggttttagcattgtatttcccacctttttgagaacaatactgtctggagtgcatttcctctctgttaaagaacttcttgccatccagattaattttaaagtatttattttaagtttttagatgaaaattgtccatcatgttgagaaaagagaactccatttgatgaaagtgatgcatattatttgcaaaattcttattgcaggttatcatttctaaaagtgcccacccataagcagtaaaaggaatgccactatcaattttagcaagacagagcctgtctcagtatatttgctcctgtaccctcctgctgtgttagaaagactccaaactacaaatggatcgtgctcagcatctggatgagtactctatccaggctttcccaaacatccagatgtttgacagcttctacatatgcatattttctccttatgcttcaggtagcaaagtaaacatgggtttattgtttccctgcacagtgactctgctcctgaattgtgtacaaactcaatttaggcaggtctaattatatcttaaatgtactagtggagcttactatttaaagaaaatctatagggaattcttttgtaaagtgaagcatccccttggaaaggtaataacagctacataatttgttacatgtttgttttctttttaatgcgggcacatgcatttttaattgctatataaatattcactatatatatataacatggtattgaagaattagagacatcattgccacttcctatataccagtattaacgggggagggaaaaatcagccacaagcacatttactggtccttgcaaagtagaaaggtttgcacatgaaattgtaagggtttgatacagaatgagatgacagtagtctttacatttaaaacttctggtattaaatattgtaagagaggataacagagtgtaaggataagaatccattcgaggatattaaatcttatgtttgtaaaggcagtaacgcagtatgagatatgaagcaatcagatgtgaggaatgagcaatgcttctttagatttatcacatccctataatttactgcagaaagctctcagaatatcccaatgaacattgaaaactgcagttattttcctttgcttttctttcatcaaggaaaaatgcaaataaactctaaaatgattcacagagactaacgaccctcatcaatctgccgatgactgaaaagaaaaaagcaggaatagttaaacacctacactgaaccttaacagaaggataataacatagtaagttgccccataaaaagtatttcagatattagaggaaagaatttttgaagctaaagataatgattgtgcctgaaaaagaccatgcctctatctacaattaaggaaggaaagaattttccatatttttatgcaaacattgatgtctaaccaagtggtccaggctatgctaccaaactctgtacaactttgtttcaagacttgacaggctacccagcagacatccttagagctataaatgagccatattcaaccaggtccacactgatgtttagctcttatgcccttttgagcttcacaaaagtatatctgatggagagagaaagagaaacaaggtagtatgataaattttacagggttactggaaaataagtcaaaatgtttgtcagtagaaggaaaaacacccttcccttactatctttccatgctgtgatcatttccatcatttgaaacctggaccaaatacctcctccttcctgaaataaactttctttcctctaactttcctcagtcctgtctacttgacattgtatcttctccattattcatttattcaacaagatgtatgcagtacccaataaggatgaggcattcttttttaagagctgaggagatagcaatgaacaaaacagccaaaatctctgttctcatggagctaatgtttttgtggaagacctagaataaacaaacaggaaaatcaatatattagatattacaaataaaaggaaagcaagaaaaaggaataggtaatgaaggaaagtttagatagtatgtttagagaagtccactgaaatgggtggcagagacttgaatggaatgaggcgatgaggcatgcaaagattagggaaaagaaaatgccaggcagatagagcttcaaggacataagctttagacaggagcatacctggtgagacaaggaagggcaagaagatgagcaactgaaggagggtaagccagggttgggagaagtggagaaaatgaggcaccagttgaactgtaaatttcctgagaagagaatccaaagctgactcagtgacaccacttaatacagtaatagttggtggcaaatcatcagtaaatgaaaggagatggcccatttaattatataacactaatattgacatgttcatggaatcatggatatggcaccaaaattcagacaatatgcaggacctgactttagaatggactagagcagagagtaataggatgggggacatttaggaagcaggtgaagttattcaagtaaaacacaatagagccctaaaccaaacagaggcagcatgaatagcgaaagggcatggactagaacaatatagagaacttacaggttaaaccaaaactgtaagtcctgtataattggtttgtgcctcacagaaatttctgggagggctttcctcagcagattagaagtattctgccccttcagttactacatagctgcaggttacctgcctcctgccagacatggtttgctttgtctgtggttcccatttgcttactgcctctctgattgattgagacctgccatcttgctctggcctacatatcccaactctggatttcccacttggtctctgatcctgtggatttctatagattttcatatatttccctgggttctgcttacttcctcttctaatttctccagctccagtcccttaactcatgcaattttaactcaaatatatattaaatgcttcctacattttagcccctgtgctggggtctggagtcccaaaaatgaataaggcatcgccctgccctggaagaattcattgtccacagtatggtattttctacaacctctgactgattccagaagaaaataaccttgaaatcatggtgaaattactaaattagaagatgagagagaaataggttaattcatcattttttaagttcccactttaggacatatccacacaagaaaataggtctatctctaagtcatttttttatcttggagattacaaatgagatgatcaaaaactattttcaatataggttactactgatcatgcccatttattgagtattgctttggtactgcacaaaaccaaaagctggaagcaatagggtaggtcccactgttccccatgcaggtatacacaccaggggttacaactaaagtgagaagacacatcatgcctctgcaaagtagattagagaaaaattttccaagctgtaaatggcagcttgacaaacaacattacaggctggattcaatgaaaacgctgcagacctggctccctccagggctataaatcacaatgaatacacagaacattactggaaaatgcagaacagaaaagagactgtgcaagtgttacaggccctccagccttggctcactgaagactaatttagggagattcagtgccgcaaggtctcagcatcatgggaaaacctggaaagccctcctcatgaaagaacactgcagaagagtcttaacaaagaaatggaaactccagaccaaaacagctctcaggggagaccagaagggtagaaagtaaaagaggaccacccctaggagtgcagggcagtagggaggactcactctggttctcactccccaccccttactctcctgaacgttattttttaaatcaggtgaaatcaagtatgaataacatcaaatgcaacctcaaaagaaagagaaatcccaacatattatgttggaggagtgttatgcagaaatagagaagggccggggggcattcctgcctctttgacttaatgataataatgactggagaatttgtgagttaattacacctctataagtctggaggtttctctgcctgtcagttagcccatctgtttctcttccataggctcctttctgagtcactttctggtcttgacctatagcctacagcggtggagaattggatgcccagggtcactgtagccaggcagggatgcgcatacaactgggtgaggcaagtgggctgtgtgatgagtttgggaagcttgtcagtttgtagagtccaagaaagagctatggagacctctaggatagaggtcgagctgtgtccttcgaaaccccaacactgtgaggacaaacatttccttaagtcacttctgcagttttttttttaatcttgagctgttcattgattcattaattcatttattcactcatcaaatattcactaaggacctaccaggtatgctgtgagccagaggcatggcatacattatataacagctgtacactgagatactcatatagtccccatcgctgtctgtgatgattctttaaaattattttcctagttaaatcaggtggagaatgtggagcattatgcaaatacagtcaatctgctaccttaagtttccctaatgcaagttacctcatccacaatttatgaaattgtacatacagtaatgatgtcaatgtaacacagaagttagagattatttttctcatataatagcagctcagcatacaacacattggcctatctgaatgcaccaagcttgaaggaatgcagtactgccatgtctaccttctttattttggatactcgctcttccttggaagttacttagacagatcttcccagtcttgtgcagaagacacaaacatagatgatgaacagaagtaatccatcattagcatcaccacattgtatgcaaagccaacacctctgtctacctgtgatatatgacagggtgaccttatctccataatgcagcagcctgaatatttaccagcatcccagtccatcaagctctcttcacctacatgttaagtgaaggccaagattactccagcatttccttattagaatttgacatgcctttttaattgtacttctatcttattagaattgttttcgttaggtctctgtttacaacgtttcctaggtttagagtggtttggttgaattctatttttatcataagccctgttctttttagtgtgaaatcttgccccaaactatgttttccagcaatgtatatatggcattgtggcaggaaagcccatatttcagtggatagagtttacccattctgcctattcaaaagcacactatattctgattgataatgcagtcctttccagtgaaagacatcaacaacacaaactaagtttggcgggtatcatccttaggtcccataaatcaaaaggataaaaggataaaacctgcatcaggacatggtttggagtattcttcatccaatcaaacttttctactctcctttatccagctatattaaagaaatctttaagctttacaaacctatttatcaaaagttcaaatttttaaaattagcctaaattttaataaagggaactatcaggcagtttagattgaaaaacaatgttatatggtgttaaagttagaaacaaattttacagctattactatagcacaaacaatattttgttaaaaatataagacagtctgatttaataattataagctttctttttcacttatttatgtattttgacattttctcagtgcatagcacctataacattgggatcattctgtcttttcctatttttaacccagagtaaaattccaaatattttttagaattaaaagatttaattctttaccttatcagagaggaaaaaacaaagtcttttatctgtccactcacaatacagaacacttcttacaccagatgtgtgggggtttttccctacacgcaaagcaagcgatcagttttagagtggacaccagctgggtgtcctctaattcaattcagttctgataccacctacctggagatagagtcagatcccacagatcttgtggctcagtcccatgagactgccccaactttcagatgccaattgcaagctttagatttgctttcttacctatgcttccaaccaatcaactatagatcagcgttctcgtgaccttctccttgggctcaattaatttgctggaatggctcacagaactcagggaaacacttatttcatttaccagcttattataaaggatattacaaaggatacagatgaagagatgcatagggcaaggttatgtaggaaggggtgccaagattctatgcccttcctgggcacaccatccttcaggaacctccagatgttcagctatacagaaattcttcaaaccttgtccttttttatttttatggagggtgcttcattacatagacatgattgacattgtccactgatcatcaacttaacattcagcccctttcccgtccttggaggttgggtggtgggattaaaagtcccaaccctctaaccctgtcttggtctttctggtgaccagcctccatcctgaagctgcctaggggtttccagctaccagtcaattcatacaaaaagacacttatcactttgaagattctaaggattttaagagttgtatgccaggaaacaaggaggaagaccaaatatactgtgtatttcacagtatcacaccttgctacacacaggcttctcacatcctgatctttcctacatctctaggctaattgctgcaccaatttcccttaaaggtgcccacacatgcacacacacacacacagtcatgtgctacatgccagcaatactaaaccattcatatttttcatgcacactgtctctgtgcctttaaaaataatgttccttctatttgaaaaacccagttctaccacttcccttcaccatcttggtaattcctatcaatttattaattctcagctcgctctcttcttgaaagtttaccctgactctccaggagttgttacattccctacccttgtgttctggggttcaacacagctcagagggaatggtctgtagcagtggatggtctataacggtgttcatcacactctgctacagttgttggtttccatacatacttttatttctgttagattgaaaactatataagaataggaactatttgttagtagtctatgtatttcctagtatgtatcacagtacttatcatacaagaggtgctcaatacctatgtgaataacctgaccattcaatctaaggaagccagcagtgattctccacatgtattcctgttttattgtctttatagaatttataactatttgatgtttgctggcttatttgttattgtctttcattattggttttattatacataagaacataagctccctaagagtggacccttattgttttgttcatcactttagccccagtgcctagaacaaaataggtattcagtgcctggagcaaaagagatgcaagataaaactgtcaacttcatgtaatgaatgagtagattcaggtttttctctcctgtactaatagcaagctttttaataaattagtatataggttcaatgcctccatggagacattaaaatactctggtttcaattaatcttgcaattttagcagtattaaattccaaaaacaatttttcactcatttggaagatctataaaggcaactgtaattaagtaatgtggaacacaagtttcaaagtctaaaataaagtgattattcgctcattttgtgcctcttttttttcactcttcctcatttttttctgagattcacttacccttctgagtctgggctaatcaatcatttatgttattaaagcaaatatgcttatctaatatcaaagcagtataatcatgcacattaaagaataatagtataacatgagtctgtagccaacattaaaaatgcataagatcatgtaacaagaattactgcaaagacctagccagttattcaacactaacatattttaattaaaaactaatttagtaataaccgaatgattcactagtgatctctagatgcaaaaaaaaagactagtgtcttcaaacagcttcctataacattttagatcaactgagcctagtcaaactaaaacatagttaccaatccctcctcagacctcacatgatacttttgtttttcacttttaacacatattttgcttttaaagcactgtgtccagtttaaatataaactggacacagtggcttatgcctataatcccagcaacttggaatgctgaggaaaggggaacacttaaagccaagagcccgagaccagcctgagcaacacagtaagtcctcatctagcacatgcctatagtcctagctactcagaaggctaaagtgggaggattgcttgagcccagaagttcaaggctgcagtgagctatgatcatgccactgcacaccagcctgggtgacagaatgagtttctgtctctgaaaaaaaaatgcattaaccaagcatttcttgagtgcccactagttctaagttaagtgccctagctcattcctgacttcattcatgcttaaatgagaggacctaagtaagtagaatgaaagcctaattggttacaagagaggaagggactcatttccactggcaattgaaggaagcttccatagatggagacatttgaggtggttctagcatcacaaaggtcttggtcagtctggctagattttatgggggtcaggtagatgaacagaagctcaaaggaagattgaaacagagaagaacctactcttctgagtacagtcatttgaattttatgttgtaagtgattggaaatggaaaggaggtccttaagtagcacaatgacctgatctgatcaaatttggttttgagaaagataattttgactatgtcttgaggaataactggaatggagaaggaatagtggagggcaggaagaaatggaggctgctgcattgcccagaagctacatgagcatcaggactaaaatagaggcagaaaagatggagaagaaaaactgaattcatagaacattcctgaggccaagccatcaaggggtggtgtttgaggtgagaggctggaggtgaggatttctgcactttctgactttggggcatggtcagatagtgatgacatcagccaagactaagaacacatggtgttcgacaatttcagaggagagataggctggttttaaatatattacatttgattcatttggggaccatcagaaggtactggaaatatttatctatagtccaggagatacgggagtctggatttggagatcatggctatgtagagaaaaagaagggaactcgtgaggtggagagtgaaaaaaaatggataaggaaatagtagccaccattatgatgagcaaaacactctggaaacagacccaatattaacacacttcattttcgtattaagcccctaggaaccttcatttaaagcagtgcttctgtcaaaatttagacttgaggcatttcatcagatgccttcccaggacatggcctaacacctgcatcattttcaatgctagcatttaacttgttagagtattagcttacagcagtcttcatccaaagtcctggtgctctgggatgatggaagcaaaattggggatggcgtcttcttcctttgaaagagctatggattaacattgcattgaggacttattgatattaattattttaaagagctcactgggaaccattcttaaacctaatctaggataaaaaaccagaaatctttagggtaattgcagtaacctgctactgccaattttttcaaaggacaaagggatggaattctccaagaaatggagcaccttggaaggtttaggttttttatctacataaatatcattgtttgcaggatactagcatcactcccaaatgtcaattctctttccaataattactgggccaatcataattgcctcttaacgcatcaaagggaatgtcttgctcttgacaaccacacacctaagctattatgaactgtaagcagtcagtccttacccttaagcctctggcataaataatcctggccaaatacctgagcagcaaatatcaatataggagttcaaccactgacacaagcacctgcatcattaggacagaatgatttcaaaggacaaggtaattaaacaaaaaaaaataaccttaggttacccacatatgtgaacctcccttgatatgccatcaactgaaagcgatagatagatagatagatgatagatagatagatagatagatagatagatagatagttgatagacaggtagatctcaaagtttggggtttgcagcagatgagggcaggaaggcaaaagagaagaattaattgcttgggaaaatctccaagaaaaaaaaaattcatctgaaatgagggattgctctttctcttgactcagtaatcttcagaaatagaggaataaaataaaatcttcacataatttgactctagccagagccagaattcagttttatgtttctttcaactgccaacaactttgttttaattataagatggaaatttctaaccactatagtgactagcagctttttataagactgacatttcagatgaacaaaaacattattcaaggagattcactttccaacagacaaaatgtgaccaaagcaaataacgacattcaagttgtatgaatcaggccctagcctataaatgttcagtgcattctgcatgacaatagtcatcccactgcccaccttcccaccagcacagtgtctctcctcaatactcaaagatttcaattaagtaatagtatcaattataagccacatgcttttcttaatattttgaacactcaacatttgattgagaggcacgggaagataggtattatgtccctaacttccttattaatattctcacttcatggccactcctttacacgcagtgctaaagtcagaaaataagataaattcaaagtctctactccccagctttggcttacatgccagaaaaagtgaaaagtgatctaattctctctattgtcatattctaaagacatccgagccagacatttgtcaaaattggagaaaaggatggcaattttaccaaaactgttgcaacataattgatgctctagattttccagcaagaagaaattgagcagctgaacaagataagcaagcattctacaaacttataaataaaaacacttcagccgggagaggtggctcacgcctgtaatcccagaactttgggaggctgaggtgggcggatcacctgaagtcaggagttcaaaaaaagcctgcctaacatggcgaaaccccatctctactaaaaatacaaaaaaattagctgggcatggtggcacacacttgtaatcccagctactcaggaggctgaggcaggagaatcacttgagccgggaggcaaaggttgcagtgagccgagattgcaccactgtactccagcctgggcgacaagagcaaaactccatctcaaaaaaaaaaaaaaaaaaaaaaaaaaaaaaaaaaaattcaagtgttccgaattcccatttaaatgtattttggaaagtatataaaaatcaaatataagatggttcttcccatatctgctgtttttctttcctttattgccagtaaacaataccaaatctcacattgtttctcatctcctcaaagacattcttggaaacttgtccgttcatggccacgttgaggaccagggctgagtagctgtgggttggcacttggcagtgagcagaatagtattcacttgaaagttctcataattatggaaaatcgtctaatgaggatatgatatatttatattttcaagcttctgcttttagcatgcatcagggaatgccttgttcttagcttagattctcattcctattcccttgcctagaatagacacacttatgagtcttgtcccagtttccatgccctgatcctcggatcatctccaggtgcccagttcctttcagaaggatcttctgtctctaccaaaacctggtgagggatgagagcagctgtggtcagagcacaaatccaaacttctgcccaaggcctttgtcctggaatgtactccccatttcttgcagagtaaaagccaaagttcttacagtgacctaaaaactatgtagggacacagtctagtcagccattcccagatatcctcacctcctatccctctccttttacccagtctacttcagccagcccggtctccttgttcctcattcacactcagagtttttgcaccaactgatccttctgtctcgaaacttctttcatcagatatctgcttgactcccttaataacttagagtttgctccaaaaggcctaccctgctcctatttaaagctggaaaccttccatctcttcccagcaccttcatcctcttttatcactctctatagcacttatcttccaatgctctatctttctgtatcccaatgtacttgttcattatattatctgcttgcttccactagaaacatcaaatggacatggatatgtttactctgttcagttctgtattccagcatttagaagagcacctggctcagcaaatatttaatgagtgggcttattttatttaacagagttaaagcgatttctgtgtatcaggcactgttctaagcactgtaaaaatattaattcatttaaagtctggtgacaaccctattaagaatggatttttcattccaattttatagaaaaaaaaaactgaggcacagagaggttaagttaaattgcacacattccataaatggcagacccctccatgcttctatcccctgggctctgctgaatgaatgaatgagacatagtggaaaccaccttttctgcactttgttctgagcgtcccactctgaccaaattaatgatcccagtgtttgacattgacccattgaagtcaatgtgctggccctttgcttccccaaaacttgtagcttattagttatttagaagccagtatcaaggagaaagaggcaagtaggccttatctactgggataggtctaccttttagtagaagtatgaaaaggatcaaaacagaatatgcaaatacagatcaaggaactagtgaagatagggctgtggaaatgaatctcaagccccttggatcagcagtagacccttccttctggtccagcttgtcatgctttgctaggctaagggctgcctccacagattgcaggaacctggaacttacctgtgggacagaccgacacgtatttgcatagtaatttgtacagctagctgtagcttattggaatgattacttcaatgtttgggaaacatttaagatgattgaaagggggtaattagcatttgggaggaggcatatctcctatcaattttcctttgagtcgatacttagagaatctctgctaacaaactgttgccaaataaagatcctgctgggttttctttaattaatgagatggcttgattgtaattattccattaattgtttaaatgcaaataagtgctattaagggtcttgaaaagtgtttcctcttaactatgctaaatcttcccccttgtcctctcatttctgttctgaatttgcctagtatatcctcttttaataaataatacaaaaataagcatcaaccaaactctagtggtataatcacaaattctgaattaatggagtctgaatagaagtgatgaattgtattagtgttctggaagaagataagattccactgaatccatatttaccatgcaaacaagcagggtaataaaacagaagaagttgtaaaaatgggaactttcaacagtgtaaacaatttatagtctctgatgagataccaatcttggatatataaacctagtctttgaatactgtactttcagtgactctagatactctttattatgggggaaaaaaattcttgccttaatacaattctattccctgcctgccaagatatggggctgggggatactgtactttcagtgactttagaaactctttattatgggggaaaaatgcttgctttaatacaattctattccctgcttgccaaaatatggagcagcagagtctccccagctcccacacctgcagagagattcttggggcttcaccacggcaagacggtgtgaacaacacagctgcatagtcaggctacctgtagggaggtgtgagagcatttcctccctcgaggcttcatggctggcctggaatgtaagcacggatgaaaaaggggatgcaaacgagagaggcaagagttgtttcctttacagcttaggaaatttttcagagctctccttgtttcaagaggagaatccactgctgtgggttccttgttcctttttccttcagcccagccaccccgttcactctgacccaggctgtaaatttacttcctgtgcacgttgctctaggacttcttttatctagattttacaaaaggtcaacttgacaccgctctatcactttacatctattcaggcatgccatgctgcttaggaaagagtaagaagtgcactttctctctccaatacattcttttctgggcagactcttagttctgaatagacagttatttttgcccagagcttatttcttgttaatgtcctgtaaattcaatatatgggtctatatttccatggctttggtcactagttgtgtacaggatgctttattagttaaaattgtgaatcagtcctctcatatatcattaaagtactaccatggtctccaaatcaagtgtcgtgttgccaggtaggaataagtctacaaccaaataaaggagcaggagagtagaggagggtttcaagttactgtggcagatcagttccctcctatactaagtgattttccaaatcaattcaagcaatggcaattcatcctgctgtggatagaggccgtcacccatcagaggttgtttggtaagtgtgtgtgcataatgggtggcaagcaggcagtgatgtattaattaagacatattgatgatgtgagcagaggtgtatgacagcaataatattccaaacactactgtgggcaaataagagtgatggcttatgtacagtaggagtcatctctatcagagataaaagttacacttggcaagcaaggcattttctctccagcagggaaactttagaaaaacaaatgggaatcagaatgtagcttggtaaataacacaacagagaaacggattgtgacagaaacaaaggatactcccatgaattcctggattcagctgtcaggataattcaccattaaatctaactgctaaatatttgccatgtgctatgtgttatgcttagggagcattaaaaaaaatgcattctaaaacacttggaaattgcccaggtagttctcttgtttttatcctcaactcagtttttttttttaagccggtatagaaacatattgattcttaatctattgtttaatggttcaattgaacaacaagcagaagagattattaaattagttcaagattatctctgatcaggcccttcatcttactcaatttaaaagtatacttgatttggccgggcgcggtggctcacgcttgtaatcccagcactttgggaggccgaggcaggtggatcacgaggtcaggagatcgagaccatcctgcctaacacggtgaaaccccgcctctactaaaaatacaaaaaattagctgggcgtagctactcaggaggctgaggcaggagaatggcgtgaacctgggaggcggagcttgcagtgagccgagattgcgtcactgcactccagcgacagagccagactccgtctcaaaaaaaaaaaaaaaaaaaaaagagtatacttgatttatggcatgagtggtcttgaatgattttgatggatgactggaaacaattagagatataaataaatagcacagaatcatgacagatttcatgaagaatacactgtgaagattcacatggttaataacattgaaattattaaaataaaagagactgcatatattagatttttctttgtgatctagttgttcaaagcagcagaaaactttaaattttccttaattttgaaagtgtgattaatggaatattgttacaatgccattgatttatatactttgaggatagttaacttctttatgtttattagaaattgcactgagagctaatatgcagtttctattggtggtgatatgttctgttaacagggcctcctgtcagtttttattctgagatttctgcctttcctgttcttttgcatgagcctaactgactgagtttcaatatcaagttctgaaagcaagtgagcatactagtgtgcatgcaatgtgcacagaaagatgtgttttcctacctctcaaagctcaccaaaggatattactcatattgccacaaagtacatttacaccaataacacatactttggtaatgggaaaaataaataatcttaggtaataaaatgcactttggtgcttataaaggaaaataatcatcataggtagaagaggaggaaggcaagactaggttttgattcaaaatgttttctgttttgctaggaagtctagaaggaatttggtcaaatgacctgaggaggcaaggagatttctcccagtggcacatggcagtccacaagaagactaggggcagggaaacaaagcaagattgtatctgatttctacaggactccaacactaccctgccaatacccttttctcctctgaaagccatgatcccaaaggtttccatttcttccgggtttttcacattctaccaacaagcagaatgtcttccccactgacagctcaacagttgagcttttcggggttctaccccttcatcaacacagcctttgctttcctggttactgagtaaataaaacacactggccacttctgcttagccttcaggagccactctggctccaccctgaagttccatttcctccaagaactaagacatttggagattctgcctaaaatatgcttaaataaaagggataaactgtctctcactttctttcccccacagcttgtcttaagaacaacggtgtaaccattagtgaaaaatcctttcaggctagtaaaatgtaaaaagagaagaggtatcgggtaacaacaaatgaaaataaaatcattcagtggtagaaaccataggagtgaaattaggtagttactgtcctccagcttacattaatcaaaataagcccacactgtcactaagacatcttgcagtaagaagccattcaccctctcattgcaattagtgtcataaagctgaatagacaggtcagaaatgaaaatcataggccaattaagttattctcatttttccacctccagctagctctttttgagaattttgattttaatagataataaaacagtatgctaattgggtggtgctgagcctgaagccgtgaactgaaggaaacttcaacaaacatttggctagggcctgctctaagcagaggggctacgacaatgggtaaggcatttctctagaaaccagcactcagcagaatttctggcacgagattttgtgagttttctagtggtgtgtcttatcttcccccaatagattataaactcctcgagggtgacagaacacattgctgatctttatatcctgcatgtttatggtattcggtagacatttataaaatgaattcatgaaaagcagaacatctagaaatgaagtcaacattgcagagaagttagctatatgaaactctgtaaataccctcaaggaagaaggaagaagcagattttctggaaatcaagggacctcccagtataagagcaattcctttggtccaaagaagggcagctataagaacagagacataactcctccgtaagaaaagataaaaattctgaaagttctctaagaacatgcccagccctgacctgcctctcactctcagtagcatggaagccgtactatctcttatcttgacacaagcatccacttcaatccacaggacaaatatcaccaatatgagaagataagatctgttttatagtcaacttggctgacatgtactaatttctcaaggtcaggatagctctctaaatagaaatacttgtttgttttaaggaattttatttaaatttgtgtatcttaaattttaattttgatctcggctcactgcaacctccacctcccaggttcaagcaattctcctgcctcagcctcctgagtagctgggattacaggcacctgtcaccatgcctggccaatttttgtatttttagtagagaccggatttcaccatgttaaccaggctggtctcaaactcctgacctcaagtgatctgcttaccaaggtctcccagagtgctgagattatgggcatgaaccactgctcccagcctcatgtagttcttaagaggaagaaaagcctatagattagtgagaagtagacaaattagcaatttgaatcaaatgaaaacttggtttgatttcattcattttggagacactttcggtgtttccattttgatctgattcaggacattgatcttcgattctaagttgcactggttaatttgtgattattttacaaaatcataacagaatacatatctgggtccagttcaaggtacagcaagccattttcaatgtttccagcttggtgtttatgattcatacatgaatcatttgggcatgcagacacacccaaatagaaacctcaaaccaattaaggtataaataggtttaggatgggggaggatggacaacaaaaaaaacctcagtaaggctcctccacaaagggcaccacttcagcttggtcccatgggcagacttcacctgtggcaggtgaaggggaaagcctaagacatcctgtgccctgatgcagatgtgacttacagaacataaaacgtaaaggcagaagggatcatctgggtggctgctcatactaggcaggcattatagctgctgacaagagccaacccatccctaaggatctaaaatcactacaagagaggacggaagtcctctcatcatggcatcccaactagtaactgggatgcatagggccactccaggtaggcagcgaggggtaaaccaggaatgtcctgctgttcccacctcttttccccaagcagggggcacccacttcctgcctccagcccatatggtctcaatttatggcctcaatacctgataaaaaaccagccgtgatccttccttagtaacaaagtgtcaatcagtcatttggaatggggcattttcaaactattgcctccctatgatcttctgaagaacctctgggataaatgaacattgttatttaggtatggttaaatgaattacttttcaggagcagatttatatattaacaggtgtgaaaaacttgaatggataaatcatttataaagaaatttcaggaatcaactaatcccaaggggaaagacccactaagacactagattttgctggagctactcaaacaaattcatctatcatatctacctaagccttccaatcaatgagactagccgcagtgacactgtctgtcaaaactacctcagtcatttttttccaaggcaggaagcatccataccccttcacaccttaatctaatttcccctatctccaccccactcccacttctatgacccccttccccccatacccacccccgaagcatctactagccaacttagtgaagttctgtcacgctctcacaaccacctctgtgcagcaatgattctgtaaatatccatgtgtcctcaacaccaggtcaaattagtccctttggtaaaaacattcattccctcaaattctcttccaatacactaatataccttcccaaaaagtaaggagaagcttgaaagctagctggattgatgatggtatgtgatgttctataagttatagttagtaagcatgtttttaggatatttttctgctctccaaagagacacaattccggaagatatttacttttgtgtatttccacattttggtttaagtttggagccatctctagatcttaatttcattcccctaatatgtgttatactagtagaattttccaaattacatagaattataactgcaactcttctgactgatgccttttttttgcattttatgatgcagtttacatcacaaattctttccctgcagggattatgtaaagaggcatgttgacctgctagccctatgttactttaagtatatgcacacacacaaaaaggaacaaaaacagctgggaattgattatgttgatattctgaataaaagcaatagttctaattatgtatgtctaattagccacagctcttcaagaattgctgcaaatgtcacagggtttataatgtcggcatttcatcttcacgaaaatgctatttgatggcataaaaccagaaaaaactaatggtcacagaagacagcttgtagattagacaaaggtcactgtgttttaatgaacagtgctgttaattaatgagaaaacaactggtacatgagcttttaagcattgtgaatttgtacccaaaaaatcaatctgcctaaaacaattttaagtagctaaaaaacaaaataacggcaagaacataatttaaacctcaaatggtacagcagagttatatgtatcaattaaattgaatcacagttctcaggtgtgacatatgaagaggcttctttaatgcctggaaaagagggttaatatggattggtattctcaatacatattgtagataaaattcaagactagctctaccactgcctcttttcttttttttttttttttttttttttgagacagtatctcgctctgttgcccaagctggagtgcagtggcatgatctcggctcactgcaagctccgcctcccgggttcacgccattctcctgcctcagcctcctgagtagctgggactacaggcgcccgccaccacacccagctaattttttgtatttttagtagagacggggtttcaccttattagccaggatggtctcgatctcctgacctcgtgacccacccgcctcggcttccgaaagcgctgggattacaggtgtgaaccaccgcgcccggccaccactgcctcttaggcttcttaatttccttatcatttaagaagaataagaaaattcttctatgttttaccaaaattctgtgaggacaaatgaggaaccattgtaactcctacaaggtgagtgataaaaataatacacatttattgtctttgcttttgtaaagagttatccaagccaagcttctaggggcttaaataaggaaggacaggaccattgttaataacatcaagtttccactacagctttcctccaaacaagtcaaatattctgaatattattcactaatctctttagctgccatttcagtaaatagcgagcattttatttcaactaaaaccaagcaagagaaaatgaactgctttatcctgaggtacagcagcaaaggcaccagaacttgtctcatggcttacccagcaagggtcagaagaaccatccctaatttaaatcatctcgactgaatgtaacagatttttgtattttcaactcatatgaaaataaaacaatgagacctcatccaaagggtgatttagagagtacctctaaacaaaacacagtgaaaatagacccagcatctggatttgaagaacacatttcctcttacgagtctatcccattgtctagattgctggcaatggcttttttaaatttaaattgttattgagataattgtagattcacatgcagttgtaagatatagtagacataccctgtgtatactttacccaatttccgcaaaatgtaacattttgtaaaactatagtataatatcacaaccaggataataatattgatacagctcacaaatctcattcagatttctccagttttacttgaatacatttgtgtgtgtgtgtgtgtgtgtgtgtgtgtgtgtgtgtgtgtgtgtattggctctgtacagttttatcacttgcagagattagtatatctaaaacaacaatcaagatattggacagttccggccgggcacggtggctcactcctgtaatcccagcactttgggaggccgaggcaggcagatcacgaggtcaggagatcaagaccatcctggctaacacggtgaaaccacgtctctactaaaaatgcaaaaaattagctgggcgtggtggtgggcgcctgtagtcccagctactcgggaggctgaggcaggcgaatggcattaaccagggaggtggagcttgcagtgagccgagatcgcaccactgcactccattctgggcaacagcgcgagactctgtctcaaaaaaaaaaaaaaaaaaaaaaaaaaagatatcggacagttccattgtcacaaggatctctcaagttaccccttgctaaccacatccaccttctccttcacacttgcacaccccttcccttctccagcctgaccccagcagccactaatctgttctccatttctgaaatgtttttatttcaaaaatgttatataaatggaataatacagtgtataactttttaagactgacttttcttgcactcaatataattccctggcaattcatttatgttactctgtgtatcaatagttcattcatttttattattgagtagcattccatggtatggaggcaccagagcttgtttaaccatcctcatggtgaaggacatctgggctgtttttggggtctggtcattatgaatacttcttctgtgaacattcatgtacaggtttttgtacaaacataagttttcatgtctctgacacgaatgcccaagagtacaattgctgagtcatatggtaactatatgtccagttttataagaaacgaccatgctcagaaggaccatactgttttacattcccatcagcagtgtttgaatgatccagcttctccgcatcctccccagcattttgtgttgtcactattttttgccactattttttattttagccattctgctagctgtgtagtgataccattgcgatctaatttgcatttttctgatggctaatgatgtcaaataacttttcatgtgcttctttgccatatgtgtaacttcttttatgtatgtcctcttttatgaatatcctatttatacctttgccaattttctaattgagtttttggttttttactgttgagttttaaggtttctttacatattttagatattagtcctttgtcagatatgtggtttacaaacattttctcccagtctatggcttgtcttttcatccttagtacctgggctctcacagagtaagtttttacttttgatggagtccaatttctcattttttccttttataacttctgcttttgatgtcaagattaagaactctttgcttagtccaaatcccaaaaatatctccatttttttcctaaaagttttattattttatgtttaatttttaaacccgtggtccatttttaaatgattatcataagataggaagtatagattaaggtccacttttttgcctatagatgtccaatttttccagcatcatttgttgagggcccttcttcctccattgaaatgcttttgcacctttaaaacaaatcaattgagcatatttgtgtgggtctagttctgaattctctattctgttcactgttctatatgtctgtatgttccatatgtctatccctccaccaatccacagtcttgattactggagctataatagtaggctttaatatcaggtaaagtgattgatctcgttttattcttctttgtcagcattgttttagctattccaggtcctgtgcatttccatataaattttaaaataagtttgtatctaccccccaaaaaaaactttgctgagattttgacaggaattttattagacctgtagatcaatttgggaagaattgacatctttgctatgatcagtcttccaattcataaacacggtatttctcctcacttatttaggtcttttctgatttcttttatctgcatttcataatctcaatgcacataaaccgtatgtgtttttctaagtggatatttaagttatttttatttggaattattataaataataattttgtgtttctaattttcatttccacatgatcattgttagtataaagaaatatgattaatttttatattgatcatacatcgtgcagccttagtgaactcacttgtttcaagagtgtcttcgtagatttcttgggatttttctgtagaccatcatgccatttgtaaatagagaccattttatgtttacctttccaaactgcatgttttttttttcttttatttggcttattgcagcaactattaatataacttacaatactatgttgaataagagtgatgaaagtatacatcttggttgttcttaatgttggggaaaagcattcagtctttcactattaagtatgatgttaagtttgttgtaaatgctatttatcgaattaaactgttaaacctcttttcctaacttgccaagagttttttttaatcataaatgggtgttggattttgtcaaatgctatttcttcatcaatttatatgatttttttttagctttattatataatgcattatattgattgatttcaaccattgagctagccttgcatacctggaataaatcctacttgcctatatattgactgattgactgtttgctaatattttgctgaggattttttgtgtctaagtttatgataaatatgggtatgtagtttttgttttgctttgttttattgtctttgtctggttttggtgtcaggataatactgacttcataaaatcattgagaaagttttttctcctctattttctgggagaaattgtgtgaaaatgatatattcttatttaaatgtctggttgattttgccagtgaaaccatttgacctggacatttctgtttggggagattttaaactatgagttcaattgctttagcggttatagggctacctagattgtctatttcttctttgttgagttttggtagcttgtagttttaaaggatttggtccatttcttctaagttatcaagtgtatgtgcgtaaagttaccatagtactccttcattttttcagtggcgtagaatctatactgatatcccctattacattcctgacattggggattttcatcagctttcaagaaagagatttatcaactttattgattttctcaaggaaccacttttttgtttcatggattttccatattgttttcctcttttcagtttcattagtttttgctcttttctatgttatttccttctatctgcttcctttgggtttattttacccttctttttccaatttcttgaggtaggtactcagattattaatatgagaactttcttcatctataatgtaagcatttagtgctataaattttcctctcagcactgcttttactgcatcctacatattttgttatgtcatttttttattttcattcagttcaattttttaaaaatttttgagactttctctttgaccaatggactactgggaatattgtttaatttccacatgtttagagatttgcttgttgtctttctgttattgatttctagttttattccattgtggcttgagaacacattctgtctgattttattcttttaaacttgttgaaatttgtttatgacccggaatataatctatcttaataaatgtgcatgggtgctttttaaaaatgtgtattctgctgatgttgggtgaaatgtctcatatcagtcagatcctgcaggttgaatgtgttgttcaaatagttcacatacttgttaattttcattctagtagtgctatgcccatagttctgagcaaggataaggtgggttgatgaagttcccaaatacgacttaacatttgtctatttttcctttcagccctattggttttgctttatgaattttgagactgtcttgtcattttcccctcaccttcttaaaaaaaaaagcagcaagcaatatttctgaacaatagggcttgaataaagaacttgtaaatgtactttatcctgccttactgcagcagaggaatagtgcagtgaccttggcatacctaagaacaatgggcatatatctgtcatttgttaagaacaatggacatattggtgtcatctgtttccatgaaaaagaaaaattactacacggtagtgttcgggggctcaggccacatttgggattttcttgggatcccttataatatgagtactcacaactggagtgccaaatgtcctggcataagcaggaattaggggcagggattaaaaagtggatctgccattcaacctaggttgggcacaggcacaactacatgggcattttgggcctgagtatgttttccatatttggaaagatgtgctggattaacaagaaatgatctggcactttagataccttaataaatgaacagactcaactacccagatatacattcaaaaccaaaacaaagccaaaatcaaacaaaaccttcggattattaatgaatgtatgttgaccctaattttggttatctgtgcataaagtcatctttgaaggtttatcctataagtaattttgaataactgtgagtaagcagtgatgatattgggtatttatttcccatcatgagaaatatttgtggattacttagtgcaaaataagagaaggatagaatgatatagctctactaggcatttcaaaagtgcagcatatcatcacatgctctaattaaagaaacagacatttgcctgaaatttgcaacaaaaatgccacttttataaatttggtaacagtttttatcctgcgagtaagaatgggagaatggggagtaggttagaatgtttactttctctgctttgtatttctgtgatgtttggaagttttaataaagacaatatattacttttacaattaagctattataacaacaatctataaatgttgttctacattataaatcttgaatcaaccctcgttttaaaacaagaaagtgaattattttttaaaggaaaaacaattttgataaataaagtgcctgtccctatagagacagcaaggtgactgtgctaagcttgctccagaaatgctttcgttttacaaattccatttggtttttcattctatcatcgactgtttaatgagccactctagctggcctttccccagggttaactcacaactcttcctaaataatctcagtcattttcctggagcaggtgttgttttctaggcagctcttgccaaagggcagcataataattaacaagcttcagatctggaggattcagggtctcatttctggcaaaggatatgtgtgtcacactgtaatgcttttgaaacttactgttttataaggagattttgacactgtaacgaaagaattcagtatacttcgaaatatttgcttctttttctctaagaacaactctcgaagatttagagattatgtcactccttgcagcaaaatgaagctctattttctgtaaaacttgccattatatttcaggatcgctattttatttcagatatttcacatgttactgggtagctaaagtcagctacactataaattccagacgagacagatccattattcagcctgcacatttagtattgaaactgactcccaaatttacgaagcattaatgacttgaaaaggaatagcattccatgataggaaatgcagacagtatgaggttcaaatgctgtccagatttagtttgatctggagaaaggaaatgttcttaactttagatattaacaactagatcctttagacaaagtgcctaaatgtccaaaaatatgcatagagcttcttactgtggtttgctccataatgcttctctctgatatgtcttatctgatattttaggagttcgtgatgattgtcgtctttggtttggagttcatcattcgaatctggtctgcgggttgctgttgtcgatatagaggatggcaaggaagactgaggtttgctcgaaagcccttctgtgttataggtgaatatcagagtctcagatacctggactatgacaccaacattcttgtcttctatctcctgttttgcaatatttgattaatattaaaagctaacatccatggagtacttatcatggaccgggcactcttgtgtcttgaaaatgttgactcatttgatgttgtctccacagcattatgaggtagatatttttattatccccattttacagttgaagaatttgaggcaaagagagacggagttagttgctgaatgtcatacagctactaagtggtagagcttgaattttagccaggcaatctggctctagaatacccacttatatcaattaacttatatggaaatacatgtttctccagtgttgccctaatttaggggaacattgatttcagtgagtataaaaaaccctttttgctctacaatatgacaccagtttatgctctggatcagctggaatagatagccatacattggtactggtaatgcatatcaattaacattcttcaagaatgattataagtatggtttgcttaatgcattggtaactgtagactggacaaagtgctctacactctgaaatatgaatcccccaccctccaatccaaaatacccaaatacatagcacatctctgcacctccctagctgccattgtttctgagagacatcattcacctgggttctagcttgaaattgtacttcctaatgaagatgccatagagcattctggaattaagatctagcatttcccagtaatatttaaaagtattataaaatggaaaagtctatatataaaagctattattattattatttagtagctaaatttggctctcttgcttttttgtctttctcacttcctaggcagccattcaaatccaaatactgaaaattcttgatgaggcttatttatttcaactattttcaacctgaaaaagtaggtttttaatttacaaaatagtttaggctatcttctacagctaccacaggttttctgttttgttttaggagtcaggaattgttgcgtaatcttctcagtttcctcccttactcctgttccctatggtgggggcagagtggatttaaggaagaaagtgtatcaccatccatgggcactgttaagaagaatcctttattccatacttctttcatagtatgcacatctcaaaagtctccacttattaaaccagaatttatggaaatgtggctgtgtgtgaggcactggtgttacaatagtgaatctagtggaattctcagttaaatctatcttaaaataccttgtttggccctcacgaatgcagtctgtttgtctgtcttctccaataataggctttactgctttttggaagccatcatgctaaggtatggagcaaagtcggtggtaactccaagccttgcaggttcataaagccccaaggcatattagtgaaggcattagatttttctccctggagatgcttttttctctctgaattctctactcaggcagcattacaaaggactgtaacctgatgtgaaactactgcacaacaagtactttctgtcccataaggggcccaaacaaaacaattcacaaggcagatggttagccaagattcactcaacttctacaggataaggtcagttcatggatgactggaaaaatgtttcattccagattttaaaaccaattaaaaattggttttgttccaatttcagaagcaatgccaatgtatctctggcctccatgcgaaaaagaaagctttttcccagatgtctgctgccttttgatagctgttttcagctacggatacatcaacacatcttagtcctttagtctttctcttcctgcctcagatccttgcaggtcttgatataatatgtagttctaaaaatgatgttatgttatctataatcttacttgcctttggatgtatcaatagtgaccttaaaaatttagtatgatgcctggcgcagtcactcctgcctgtaatcccagccctttggaaggctgaggaaggcagatcacttgagcccaggagtttaagaccagcctgggatggaaagacctgtctctacaaaaatttaaaaattagctgggcatggtggcatacacctgtagtcccagctactcagaaggctgagactggaggatcatttgagcccaggagtttgaggctgcagtgagccatgttcctgccactacactccagcctgagtaaaaagagtaagaccctgtctcaaaaaaatactagtatgacatggtttaggcataattgcagttttgttaacccttcagaccttttctttatttagatattttacctctaggaaattaattgctttggaagaaaatttcatggataaatatataatgaatccccattagaacaaagtctagatttgtacttacagttaggataattatgaattttttagtcttttattaaatgtacatgtttgacccatggtccagctgaatggatgttatagtgaagcatgttcaaatgtggcttatcagtatgaggtcagtaaaatttaacctacacaaaggaatcaaacatcaccttcctgaaggcagcaagctgtaccagatgactgttgagactatttctaggcccgttcaacaggttcataaaaacgcttgatgtaactggtaaaatactaaagtgaacactgtagtcgccttgttcaacctaatttactgtgacaaaatgaaaaaagaaatagcatctcttatctgtccctgataactgttctgaatgggtgtttggaaatatagctaaaacctcccaaaacttcatgtatttgtaagatttgattactctgaacattccaagtacacacccaaatatttttagaagtgttgagcattcgagaaaagaacatagaaaagattgtggtagactggctgtgccttcaacctgggaaatgctttctgtaagcacaccaatgtttttctttccagttggaaatacactgaagctgctagagtggtcagctaacaagccccatgtactattgcaccctattgacaaaggcccaattgatagaggttttatgggctaattactgaaggttttagcatgtccccttctgaactgcccaccttccttacccctgcactctagccaaaaccaagagcatttcaaaagcccactgatctcacaaatcctaaaatcattacatatttgtgtttggaaaacatattttaaacaattataacataagggaagaaataaatctatttaactttttttaattaggtactttgtttcattactactgtacattgatgtatgtctgcttggttttaagcatttgctttgaaaattagtaaaatcttatctagaacataaaattcttcctcatatctatgtgttcaatttttatctctcccctaagactcttctgtcataataacattctatagctatgagcactaattgctgtattgctgatgtggatagtcaagtgtgttttgggatgaccacccaagctgcccttcatttacccagactggctgctttatgatttctctatgtgaaaacacaaaacactcacccaataacatcggcataaagaatttgtgaataacctctaagactgatttcatagtcattcttttttctagctttcattactgacctacccaaaaattgcaaatagacctaaggctgaaacttgggtcacaataatgagcctgatgtgtcaggaagccaacaaattacttctcacagtggctttttttagattccttggtgacgctttccaaaggcagatataacagggccatatttttcagtcttgcagggagtctcagtgagaaaataccagcctgttgttagtcttggatctgcatttgatgctaagtgtaagttgatttcttattgttattttaacagtttattttcagtgtaattatttccacaagaggacaaaagaggaataaaataaaattttattttatcctacgtggataaaataaaattgaagcctttattaaaatcgaccacatggctgagactactctaatatatctatgatttcatcttattaaaaggcaacttaagttgctaatgtgttcaaaagttagatcagactcccaaaactgccactgtgttctaaattgattttgagacatcatttttctgtttctctgtcttctctatcttttgttctaagagacttactcttcaatggcattattttctataccttctactcccttttccctttagtagaaattatattatttcacttattttctgttagtcatacactcttctgcaacttattacttctaagtgttcaaactccctcagtgcatgtagattccttccatgtgattaactggaccatctgaggacaattaaaacctgttggattggctgatcacaaaacattaaaacaattttaatccctctagttagtaatagctgatatttattgagaactactatatattaggtactactttaagcactttataaatatggtcttatttaattctacataagtactataatgtccttatttattttattttattttactttactttattttattctattttattttattttattttattttattttattttattttattttttgaggcagagtttccctctatcacccaggctggagtccaaatggcatagtctcagctcactacaacctccgcctcctgggttcaagccattctcatgcctcagcctcccgagtagctgggactacaggcacacgccaccacacccagctaatttttgcatttttagtagagataggatttcaccgtgttggccaggctggtcttgaactcctggcctcaagtaatccacccgcctcagcgtcccaaagtgctggtattacaagtgtgagccaccacgcctggcctttataatgtcccattttatagatgaggaagtaagacaagactgaagactttatagatgaggaagcaagacaaacttaaaaagatgataggtgaaagaacctggatttatttctcatgatttcactctagaaaaatatacatacccaactggaaaattgtctttactgtttattagcattttaaaattaaatttaattgaaccttatctattgtcatcaacttgtaaacagaagaacatgatactattatgcttatcattagtaattcaagatctttaaagaaaagccaggctttatagaacattaattgcagtatcagccttaattatatcaactaaattatgttacctattgctgctctctaacctgaatgggaaattaggacctaaaatagacttacttacctgtatcaaacttgcatatactcttcagttgttgttatcatgaggctccctgtgtatttccaaattggagacctctggagagcaagtaacattactcgcaggactaccttcaaatgttttttaacattaataaactatcggtaatttagataattgttgacctggtacacaaacttgaaagttgaacttacaagacagcttgattagctgatatggttggaccacatgaagaaaatttatttccgaagaggaaaatgaataaggattatttcccactctttctataaactttagtagagcactatgatatactgtattaacattctgtactatcacatgttacataagaaaattcattcacagacagggtatttattatgtgtcaaacataatcttaagtataaaggatacaaaagcgactaaaacacggtccctgcctgtaagaatagaatctcctgtgcccttagagaatggcaaaacttaaaggaggtatactataattatggtgttacagagcaaaggtgatggaaattgaagtagtcctagaaagaaggctatggaatatcatgagtgattgtataaaacaaagaagcaaaggactacccccaggttttcaaattatgtttgagtcatccactgaacatttatacaatttctaccatgtccaagcatgcttatggatgctggagaggctgtatggcaccaaatgggcaaggtcttccttcttatagagataatattcgtgtggacgaagaaaaacaatacacaaatatgtttttgaaaaacaagataatgtcatctacagataagcacaatgaagaaaataaaacagaaagagtagaggctaccttagcttgggtggtctgagaaagtctttctaagtagttgacacttgagttgacctgaatattaagaagaagccagccatgaggaggtttagacacagatctttccaggccagggaatagtaattgcaaggattattaacacttgatgagcttgggttgtacaaggtggagacataaggtctcgtggctggagctcaatgagcagtggggagaatagcagaaggtgataggggagacaggcagaggtcacaccctgaaggccatgtagcctctgctaccctgaatcaaggttccttctaaagacaggccaccaggcaaaggtcctacgggttgctggcaggcctaatatgaatactattcaggttatgaacagcagcattaatcaggcaacaaaaagtatggctgtttaatgccctgggttttttagtcatgtatgcctgttggaacttcatatcagcaatatacaaattattacccatttatgtttataaaaaacataaacataagtttataaggaaataatcctctgaattttgtttctatatttctgcccttagaaacatgaaattttacattgttttttaaaatgttatttttctatgaggaactggaattagaatgtgatggaaacttttttacagccccagtggtatcaccagtaagcagttcctaagatcctccttgccaagggactctattccatactcttagttatgatgattgcagtgcagaattatttcattaaagattgtttatttcttttgagaaattgtccctttttgccttgagatgttatctgaaactgtatgatcaataagaagcattaaactgtcactatggggtaaattttcaaagtggtgcctgcaatttgccagtatgagtcccattaacttctgtggaagtcctgcagttaaacccctgcacatggctttgaaaatgttctacaagtttgtctttgtggtgccttttttatttttaataaatatcacagagcaactcagtgcatagttgattgcagtatttaagaacgtggataatgtactgtgcaggaggagacttttaaaattagattttaaagcttcatttctattaagagtcacaacaacaatataaatacatctttagttcttcaaagagcacctttctataaaggaatttggagctcaattagaatatagagcttataaagcagcaccatgtccctctgagacattgtttacttcactctatagatggaaaagtcgaggcactgtgaagtgggggtgctttgtccttagcccataaatcagcagtaaagctaggaatagcatgctggcctcccaatagctcattgctctaaagcactgcctcttgttagagtcaaatttaattatagtataatccgtttaatctacatgtggagaaataatgaaggagcaggaaaaatgaatttcttaacagatcagtggaaaaccatattacatagattagcaactgtcttttcaagatccgtattttcagcatgtactagatggtatctgatgccatgaaagcaaatattctaattccactggccagaactggcaaagaacttcttattttcctcactttgaaacataagtaaaggggttccacttgaaaattaataagccatgtgatatgattcgattcctgtccccaaatctccctccttctaggggccattgtctaaagtctaaaagaaaacataccaggcacagtggctcatgcctgtaatcccagcactttaaagggagagcaaggtaggaggatcacttgagcctaggagttcaaaatcatcaacctgggcaacataatgagaccctatctctacaaaaaaaacaaacaaaaacaaaaacaaacaaaaaaaactgtaatagctgggtgtggtggaacacactggtagtctcagctactcaggaggctgataggagaaggtaacttctgcccaggaattcaaggctgcagtgaattatgattgcaccactgtactgcagcctgggcaacagagtaagacagagagagagagagacaaagagaaaggaaggaaggaaagaaggaaggagggaaggaaggaaggaaggaaggaaggaaggaaggaaggaaggaaggaaggaagggagggaagaaggaaggaagggagggagggaaggagggagggaaagaaaggaaaggaaagaaaataaatgtaactattataaaagatgttcaatgttttattttggaataactttagacttacttagaagttgcaaaaatagtacagaatttccatgttcaaatgtactctttacctaactttccccaaaatattttacctacgtatactgcaattatcaaaaccaggatatgaatacatactattagctatagtctttatttgaatttcaccagtttttacatgcgctcaatttttatatacactcctataaaattttctcacatgtatatatgcatttaaccaccaccacaatcaaaatacagaacttttccatcaccctaaataaacttggaatgatatactttgtattattcctttacaggtactccctctcttcaatcctaacctctgggaaccactatatctgttctgtttcactgtaattttgtcatttttataatgttatataaatgaaattgtaaagtagtaatcttttgaaattggctttttcttacacagcatgatgctcttgagatccatccaagtgcatcaatagtgcattcctgtttattgcttaatagaattccatgatctagatgtaacacaatttgtatattcatttacctaatcaaggtcatttgggctgcttctagtttttggctattacaaataaggcagctatgtacattcatgtgtaggtttgtgtatgaacgtaagtttttatttctctagggtcatatagtgctagttcacctttatcagaaactgccaaactatttccttttaaaatatagaaatgccaatgcaaacatgtgcatggaggtcagcagccccaccccctgccccacgctgccactgctgccagtgtgaacatatgcatggaggctggcagccccacgctcaccactagcctgcccctgcactgacactgctaccagcatgagcgtgcacatggaggccggcagccccatggccaccagcactctgccccagttgatgagcattcaccccaccacactgccacttgctcttggcactgctcttggcacttacaaatgagcacagatcctgctgccaccaccccaacaaagtggtttggctggcaccacccatcagagtattgtggccagaggtgcaggaacaccttagcgcctccactttagcagtttcctaacctcaaggggccagagaataaagtcagagatccagtaacagcctcccaaagttgcagcatacagcccaaaagttctgagctgagccttaccccctaaattcttccagaaatgaagccagtcaactgaacccaccttatatgagattcaaaccttccagggcatcaaagaagatagaggcaaaaaaaaaaaaaaaaaaaaaaaaaaaaaaaaaaactatccaaaggacagcaatttcaaagactgaaggaaaatcagcccacacagatgataaagaaccagtgcaagagctctggcaactcaaaagtcagagtactttcttacctccaaacaactgcagtagttccccagcaatggttcttaaccaggctgaaatgacaaaaagagaaatcagaatgtggataggaacagagatcactgagattcaggagacagtgaaaacctaatccagggattctaaggattacaacaaagtgatacaggagatgaaagacgaaatggccactttaagaaagaacagaactgatctgatagagctgaaaaactcacttcaagaattccagaatacaatcacaaatataacagcagaatcgatcaagctgaggaaagaatctcagagcttgaatatcacttctctgaaataactcagtcagacaaaaataaagaaaaaaagattaaagaagaatgaacaaaatctccaaagtatgggattatgtaaagacaccaaatctatgactcactgatgtccctgaaagagagggagagaaagcaagcaacttggagaacatatttcaggatatcatccatgaaaattcccccaacttcactagagaggccaacattcaaattgagaaaatgcagagaacccttgtgagatactatacagataaccatccccaagacacatacttgtcagattctctaaggtcaaaacaaaacaaaaaatgttaacagcagctaaagagaaggggcaggccacctcccaaggaaaccccatcaggctaacagcacacctttcagcagaaactctataagccagcagagattgaggacctatattcagcattattaaagaaaagaaattccaaacaagaatttcatatccagccaaactaagcttcataaatgaaggagaaataagattcttttcaggcgagcaaatgctaagggaattcattaccatcagacctgccttataagaggtcctaaagagagtgttaaatatggaaaggaaagattattactggcaactacaaaaacgtgcttaagtacacacaccattgatgccaaaaagcaaccacacaaacagatctgcataataaccaattaacaacacaaaacaggatttgatccttcaaatccacacatatcaatattaaccttaaatgtaaatgggctaaatgcccaattaaaaggcacagagtggcaagttggacaaagaagcaagacccaacagtatgctgtcttgaatagacccatttcacatgcagtgacacacataggatcaaactaaagggatggagaaaaatctaccaagcaaatggaaaacagaaaaaagcaggagttgctattctacattcaaacaaaacagactttaaaccaacaaaaatcaaaaaagataaagaaaggcattacataatggtaaagggttcacctcaaaaggccagacttaactatcctaaatagatatgcatccaaaacaggagcacccaaattcatagagcaagtttttagacacccacaaagagatttagataaccacacaataatagtgggagactttaacatcccactggcagtattagacaggtcattgaggcagaaaactaacaaagaaattcaggacctgaatttgacacttgactaaatagacctaatagacatctacagaaatctccacccaaaaacaggagtgtatatattcttctcatctgcacatggcccataatctaaaattgactaatcagccataaaacaatccttagcaaataaaaaaaaatcataccaaccacactctcagactacagtgcaataaaaatagaaattaatggaaattaacctgcttctgaatgacttttgggtaaacaatgaaattaaggtagaaattcagaaattatttgaaactaattagaacaaagatactacataccagaatctctgggacacagctaaagcaatattaagagggaagtttatagagctgaatgcctacatcaaaaagttagaaagatcttaagttaacaaccgaacatcacacctagaggaaatagagaaacaagagcagatcgaccccaaagctagtagaacacaagaaatcaaaatctgcactaaactgaaggaaattgagacgcaaaaaaacatacagaagatcaatgaatccaggacttggttcttcgaaagaataaataagatagataaaatgctagctagactaataaggaaaaaaagagagatcaaaataaacacaatcagaaatgacaaagggatgttaccacctaccccacaaaaatttaaaaaaccctcagagactactaaaaacacctctatgcacacaaactagaaaacctagaagaaatggataaattccttgaaacatacaaccttccaagattgaaccaggaagaaattgaatcctggacagagaccaataatgagttccaaaattgaatcagtaataaaaagcctaccaaccagaaaaagcccgggaccagagggattcacagctgaatattacaagaagtataaagaagagctggtaccattcctactgaaactattccaaaaaacagaggaggagggactcctccctaactatgaaaccagcatcatcctgataccaaaacctggcagggacacaacaacaacaaaaaacaaaacttcaggccaaatccttgatgaacatagatgcaaaaattctcaataaaatcctagtgaaatgaatccagcagcacatgaaaaagctaatccaccactatcaaggaggcttcgtccctgggacacaagtttggttcaacatatacaaatgaataaatgtgattcatcacataaacagaattaaaaacaaaaaccacatgatcatctcaataaatgcagaaaaggcttttgataaagttcaacatcccttcacgttaaaaaccctcaacaaactaggcactgaaggaacatacttcaaaataataagagccatctataagaaactcacagccaacatcacagtgaatgagcaaaagctggaagcattcttattaaacaccagaacaaaacaaggatgtcctctctcaccagtccttttcaacatagtactggaagtcctggccagagcaatcaggcaagagaaagatataaaagccatctgaatagaggggaagtcaaactgtccctgattccagtcagtatgattctatgcccagaaaaccccataatctctgctccaaagctccttggtttgataaacaacttcagcaaagcttcaggatacaaagtcaatgtacaaaaatcagtagaatccctgtgcaccaacaacatccaagctgagagccaaatcaagaatgctatcccccaagcctgccaccatggccacctacaaactggtgcagatccagcacagcgagagtgagtggaacctggagaaccacttcagcggctggtacgacgccatcctgagcccagcgggccatgaggcggcaaagcaggcacggcgagatgctggctatgagtttgacatctgcttcacctcattgcagaagagagcgatcccgaccttctggacagtgctagatgccattgatcagatgtagctgccaatagtgaggacttggcgcctcaatgagcagcactatggggctctagccggtctcaataaagcagaaactgctgcaaaacatagtgaagcccaggtgaagatctgcaggtgctcctatgatgtcccaccacctccgatggagccctaccatcctttctacagcaacatcagtaaggatcacaggtatgcagacctcacagaaaatcacctaccctcctgtgagagtctgaaggacactattgccagagctctgcccttctggaatgaagaagtatttccccagatcaaggaggggaaatgggtactgactgcagcccatggcaacagcctctggggcactgacaagcatctgaagggtctctctgaagaggctatcatggagctgaacctgccaactggcattctcattgtctatgaattggacaagaacttgaagcccatcaagcccagcccacgcagttcctaggggatgaagagaccatgtgcaaagccatggaagttgtggctgcccagggcaaagccaagaagtgaaggccagcaaacaggcaccctccctgcccattgcatccatctgtccctccctcctgaacatgtcacactgaccacatctatagacatcttgagttgcagctgcagatggggaccggtggctcccattttcattttagccattttgtcttctgcacccactcccttcatacattctagtcagaatagcacttctagggcacaggttctcagtctaagctgtggaaaagccccccttatccaagagagttcaaagatagtgacttgggtttttgcaagtgctttgtttactaaggacttgtgaggaggagccatgctgagctacgaccaatgaggagaagcaagagagcctgtctgcccccaggagctagtcctgtgcttgtctgtagtcaggccactgcctgggggctctagtcatcccagtggaagatgaatgtaacctgcatggtgatgtgacaactgtttcctccctgaccccagaggaactggctctagaaggttgggatcaatcctgaatttagtttatgtgttacatttacttttatttaaaaaaaaaaaagtatagtgtatataaataatacaaaacaataacccttctaagggtttctcgtggtggttgaaatagtcccacatgtggtcatcagaacataagccattcctcataccaatatggggtaagctccttgacctttgaggggcaggagtgcttcatgctgtgtgttttagaatccctccctgccttgtttcatggcagtgaaatgcctcttggtcctctccaagtgtgtttttcactgatttctgaatcatgttgcagttgcttggccctgccacataggtctagtgttcatttgagcataactgtactaaatcctttttccagatcagtataataaaggagtgatgtgcaataaaaaaaagaatgccatcccatgcacaccagttagaatggtgatcattaaaaagtcaggaaacaacaggtgctggagaggatgtggagaaataggaacatttttacactcttggtgggactgtaaactagttcaaccattgtggaagacagtgtggtgattccttaaggatctagaactagaaataccatttgacccagccatcccattactgggtatatactcaaaggattataaatcatgctgctataaagacacatgcacatgtatgtttattgcagcactattcacaatagcaaagacttagaaccaacccaaaagtccatcaatgatagactggattaagaaaatgtggcacgtatacaccatggaatactatgcagccataaaaaaggatgagttcatgtcctttgcagggacatggatgaagctggaaaccatcattctcagcaaactatcacaaggacagaaaaccaaacaccacatgttctcactcataggtgggaattgaacaatgagaacacttggatgcagggtggggaacatcacacactggggcctgtcatggggtggggggaagggggggagggatagcattaggagatatacctaatgtaaatgacaagttaatgggtgcagcacaccaacatggcacatgtatacatgtgtaacaaatctgcacattgtgcacatgtaccttagaacttaaagtatagtaaaaaaataaataaataaataaaaatttaaaaaatgaataaaatacatagaaatacagctaaccaggtaggtgaaagatctctacaacaagcattataaaacactgctcaaagtaatctgagatgatataaataaaaggaaaagcattccatgctcatggataggaagaagcaatattgttaaaatggccatattgcccaaagcaatttacagattcagtgctattcctatcaaactaccagttcttcacagaattagaaaaaaaaattatttaaaaatttgtatgaaaccaaaaaaaagcctgaatagccaaggcaattctaagcaaaaacaacaaagccagaagtatcacattgtgtgacttcaatctatattacaaggctacagtaaccacaacagcatggtactggtacaaaacacatagaccaatggaacagaagagatagcccagaaataatgccacacacaaaccatttgatcttaaacaaacctaacaaaaacaagcaatgggaaaagaaattcctattccataaatggtgctgggataactggctagccatatgcagaagattgaaattggaccccttgtttataccatatacaaaaatcaactcaagatgggttaaaggcttaaacataaaacctaaaactggccgggcacggtggctcacgcctgtaattccagcactttgggaggccgaggcaggcggatcacgaggtcaggagatcgagaccatcctggctaacacggtgaaacgccatctctactaaaattacaaaaaattagctgggcgaggtggcgggcacctgtagtcccagctactcgggaggctgaggcaggagaatggcgtgaaccccggggggcggaggctgcagtgagccgagatgctgccactgcactccagcctgggcgacagcgagactccgtctcaaaaaaaaacaaacctaaaactataaaaaccctggaagatgacctgggaaataccactctggacatataggacctggcaaagattttatgacaaagacaaaagcgattgcagcaaaaacaaaaattgactaattttgtcaattaaactaaagggatctaattaaactaaacagcttctgcacagcaaaagaaactatcaacagagtgaacagacaacctacagaataggagaaaatatttgcaaactatgcatctgacaaaggtctattatccggaatctgtaaggaatttaaacaaatttataagcaaaaaaacaaacaacaccattaaaaaatgggcaaagtccttgaacagacacttgtaaaagaagacatacacgtggccaagaagcatataaaaaaatgctcaacattactaatctttagagaaatgcaaatcaaaaccacaataagataccatctcacaaaagtcagaatggctattactaaaaagtcaaaaaataacagatgctggcaaggttatggagaaaaaggaatgcttatatactgctggtgggaatgtaaattagttcagccggtgtggaaagccgtttggcaatttctcaaagaactcaaaatggaattaccatttgacccagtaatctcactattgggtttattctcaaaggaatgtaactcattctaccttaaagacatatgcactcatatattcatctcagtactattcacaatagcaaagacatgaaatcaacctacatgcccattgatggtggattggataaagaaaatgtggtacatatacaccataaatactacacagccataaaaaagaacaagatcatgtcttttgcaacaacatggatgaggctggaggccattcacctaagcgaactgacacaggaacagaaaaccaaatacacatgttctcacttacaagtgagagctaagcattgagttatatggtcacaaacaagagaacaacagacgcgtaagcctacttgaggatggaaagtgggaggagggagagcataaaaaaactacctatcaggtactatgctttttacctgcgtgatgaaataatctgaacatcaaacccccataatatacaattcacctatataacaaacctgcacatgtaccacagaacctgaaataaaagtttaaaaataaatcataaaataaaatgttgaaatgcctagaatgtttcatagcattaaattagaccatgctgtcttaaatgacatcttattttcatagaaatcatgtttctgctttttctgtttttctatgaaaatttttttaacaagcagaagttaacgaaatgtatattttaccacttgggtcaagaaacaaatgaaagtattgcccattaaggagcagttcttcatactgtgataaatgaatgtaagtattatgtttacatagatgaagtataaagagaccaattaatgtaaaaagccaatactgtacaaattcctgaaggaccattttttaaatctaactttaatttttagaaagtccttattcaagcaaactttactgagaccaatactaattatactttcctgctaaaagatacagataatgacattagttagagccttaaagtactactccaatggaataaaatatttaaaattgccaccaagacccagtggtgctttatagagagttgggtccaatattcatggttctaatgtgatctaaaaagaagtcgtttgttctccttaattcaacacctctcagaaattgccctattcttaaaactattctctaagactacttttcctccaagactctgccaaatgtctccccttggatcttccaccataaccaacaaaaacattattttctcaaagttagaaacaaccctgtgtggccaaaatatatgaatcccaacttcattctcactctggttgtaagaaatgctggaataattaattactcatttggaaaaaattaaagctgtatccatatctatcttaccagattccaagataaactccaaataaatcaaagatttaaattaaataagaccataaaatactgggcagaagaaattggtaaactctcttagaaccttggaatctggaaagattttctaattataactaaaaatacaaaagtcataggagaaaatattgatagaatacataaaatcaaagaatactgtatgataaactaaacagcaacgtcaaaagacaaatgtggaaaaatatttacaactcctactaaaaaatagaaactaatcaccttaaattataaggagctctagaaatcaagaaaaacccaacaacctaacagaaaataaaatggatatgaacagactggtcacagaataagaaatacatatatacctcttaaacatacccagtctcactcataaaaaagaaatgcaaatgaaagcattctctcacctatcagattggcaaaaatctgcagtttgaccacacactttattgatgagactgcaaggaaataggcactcacatgccacaggagtgcaaaggggtatcacccttatggaagagtgtcaatatctaccaaaattacttaagcatttactctttgacccaggaagtctacttcctaataatttcatcaatttgtagtaaatgttcactatagctgaataaactattgtaaatccaaacaataaaatacagtggaagacctttctgcacagctacagaagaatcccaagatatatgaaataaaagaaaaatgaaatgtaatactgcatatatagtgtgctacttttgtgtaagaaaggagaaaaataaaagttgactttcatattgcttgtgtttgtataaagaaacattgaaataatttttacaaaaagaagagaataaaaatgtttaactgaggatagcgaatgaggacagcatgaatggaaacgggtaggagtaagatttttcagcatttacctttttatgtcattttaatgtttaaaatataaatatgttaactattcaaaaactaaattaaaagaattattgcctggcacagatgaagtacagtttagatgttgactattattatttttgtatagcaatatttggatgggttaatgggctcatattatgtacagttgttccgaatctactcacactccaggcacttttgtcattgcaaagagggacaatgccaaagataatttaccataggatttccatgtgcacctcctcagttctaggctgaagtaacatagaatggcatttttaactcacgaaaaactctgttctaaaaggtgctttattatttgccttaatttgctcttcatatatttccttaattttaaacttagaattttagttgtaacttttcaaaggattgcccaagaagatgcaatgagatgatacatgtaaagtgcttagcttaatgcctggtgtttaatcaatactccataactcttagtggtagcaaacagaatcataaaagtgatgtgttcagtgaagcctctaatcaatcctagaatcgatacctacaatcagaaaaaaattatcaactcagaccatctttgtatgtttttgtttattatttttcctcaaaatatcttcaataaggcattcctagaatttgagagtctgtgtatcttaaataagaatgcattttattttaagaggtaaatggaaggagcaagaaccaagacaggtactttttgagtctggagtccttagatataataagtaatttcaggaatggtatgtatggtacctaaaggatgtggtttaattagaagggcttttgaagctttcttgtagactggttgttcattatggcttcatctatgtttctcccagaaggcttccctggcctcttaactaagttaattgtccctgcaatgtgctccttgtatttcttctgtcataatattcatcactcatgattgtggttactcgattcagcgtcttctatgcaaaccatgctttcagccttgtgcagacagaaggcatccatctggtccacaccagccatgccctttaatattatatgcccaggtcctagaagtttctggccacaatgaatgtgtattgaatgaataaaaaattgagaaaactgcaagctagtaaacagtcacatgagaagcgtcatccccccggcccccatcacaacccctacacacacaaagtaaaaacaacacagtcaacatgagcaaatagagaaaaaaaatgtggcaattattcaagcaatgcaaggtgaaaaatagcccctttgcctcagttatcagaggttttcaaaaggatattttttgcctgcattttttaatctaattgcttcaattattttatttggtcatgggaacatgattatattttttaataaagtgcttaatttgcatgcatgctttgaattgtaggttcttttacaggaggcttgtctactcccatattgcctttttctcaattattttacttctgccttttgcaaaatgttttaaatatttgattttagcccctaccacagactccaaatctgtgcttggaatttggagatcaaagtactgtagctaatccttaggacatttgccattgtgtgacttaagaatccatctcttatcaagtttctgtggttttctggagtatttacaggtcacaatgtcaaaatgtgcacatctgaaactatttttgaattatgctttctttatactcttccatatttagttaatgggaaaatatccagctcctgaatggtattgaactcgattaggccatctccagtctccttataaaagattcctaagttgtagtatcacatgttttcaataaaccttgtttttgttctcctttaaacagagcgtgtcttattcaaaaagctcatgacagtaggaaaggaattgataatgaaaagaaagtgagtccgaaggaggatttttcctcatagctttaggatttgttataagacaatgtgtttcaccgcctgacctgcagcttcaggagttggttgccatgaattctgatcctgtttctggaagtaatttatcgcattatcttgtacaagcttctctgggacactctttctttccttttaagcacagataagagcagcaatacactttgcagcgttcataaacagcaatacataaaagtaaatatgaaattagaaagttccaaaaactgctctaatctagtgccagtgagggaaaattttggtaaggattttataagtaaagatgggagttagatgcataattatatgtgacctgtttggttaataatcccactgaaatacagatagatgatagatagatagatgatagatagatagatagatgatagatagatagatagatagatagatagatagatgatagatagatagatagatagatagatagatagatagatagatataatagatctacacatggcaacaagcaagattttcaaaattataatgaatgtcaggtatttattcttggcttatatttactcaaattcactctttaaagtgctatctttttattcttcacaggaggaaaagtctattttcacaccccaatgtttatccctaaggattagccaagtgcctaaactgtatccatttcatatttccaaaaataggaaattgtgcattgaaaaatattgagagccaggtgaaccaggtaattctaaattttcccagataatacttagaatgaattcccatccataaatgtcctttgctaagtgacgtttcatctcaagtggcatctccattgtaacatccgagtaacacagtctattcaaagaacttcctgaagatatcctttcaaaaacttttagcagtaggtgatgattaatcataatctgtatgtcatctgaaaataagtatcaagtttcttaaagaaaaattacatatcccaacactactaaacataactggctgctaagtttcagagggtccatatcatttaactgcttagagtaagtgcaaaaagggagtattataaattaggtattgtagttttgctctgtaaatttaaacccataatgccattgtttggctgttgatgtttaaatattcaagctatgaccttgaataagatatccaagcatggaatttcatcataggatgttgggatttccagcagatgtttcaaatttgattattcattggtggaatccaaatctttttttttttaatctgcagtcaaatactggtatggggttctgtttagaaatcaaaactgactgcagctttgtcatttggtaggtgtgaaaataggtactgaagaaaattttaaacatctgatggtatcaacgtgcaaaattgctgttcctaaaagctgtctcaaactttctatataaaagaatataatataaagccactgtatcattgccctaaaccatgttctaaagcatcagaaaatacacatgacttttcatctcttcgatttattgaaaactgatggaattacacctaggtaatttactcaagatactagactatgccttaaataggatgtgcctcctactcattcatgatgactctcaggggacaaatgcttctttcctgttttataaatacagaaacacagcttccttacctccttcagtctgtaacccacatctgaaattaaatgtttgtgatcacactttgaagcaatttgtttcagtaggttactgatattgcaagggattcgtcctgtagcatgagaaaaaaaaaaaaatctactgcctgactctgcatccctgacctttcccccagactccagccccattcaccatctaccaaatgcctactagccatctcaaaattaacatggccataacggacaagtagttctgcccttcaaatagtgctcctcacctatccccagtggtatttccccagcttagtaaatagcactttattcacctgattgcttagaccaaaaaccctgaagtcagccttagactccctcgtttgtctcatcccacagtcagtccttcagcaagtcttggcctctccaccttcacaatgtgcaccaaatccagctcctttacagctcctcctgactttaacctcactcttgtaatgctgctctcaccctttgtccagaccacagcagtggcttcttacctggccttccagcttcctctctgacatctggcttcctttctggcatccagcctcttcctggttggtttcccaaaggtaaccaaaatgatcttgtgaaatacacatctgatcctgcactctgccaaaaaccctttccctgccgctatcatataatacttagaaggacatctaaagctattcccaaagctgtcgtgatctggctggagccttctctcactccgctcaagctaacttgatctccttgccttcccttgaacacactgaacacacttccacctcaaggtctttttatatttttttgcctggaaccatttttccttagatatgatcacggtcaccccttcacttcgttgggtcatggctcctctgagatgctttcccattgagacaaccgaaaatactaaaaacggccgggctcagtggctcacgcctataatcccagcactttgggaggccaaggtgggtggatcacttgaggtcaggagttcgagaccagcctggccaacatggtgaaaccccatctctcccaaaaatacaaaattagcctggagtggtggtgcacacctgtaatcccagctacttgggaagctgaggcaggaaaatcgcttgaacccgagaggcggaggttgcagtgagctgagatcatgccattgcactccagcctgggtgacagagactgtctcaaaaataaaataaaaactaaaatattaaaaacatgttaattataagatgtttgctaaattttacctgaatatcaaccatttgcaagtagttatattccctattcttaataatactttacttcttggaacttcacattaagatagagcacccgcccctctgtgactccaccctcatcctgctctgcatttccccagggtttttgtcactacctaacattatattctgtacttgtttattgctttaacatcagcctaccccaggagaacataagctccatgagggcagaaaactcttctcttttattcactgctctatacctcatgcttggcttatagtagacatgcaacaaaaaatatttgtcgaatgaactaatgaatgaataaataaattgccttaacacttaatttgagaaaagtcatatccaaaacactccttctgatgcttcctcgttcaaccagtatccaaaacaaaaaatgtaccacttagaatttgagaaattcaaagttagaaaggatccttgagacttgccagttcaatccaactattttaaaggtatggaaaccagccctgagagataagtggtgacaaagctagttaatggcgaacagataattaaactaggcatagttcaatgttctttatgcttccatgctttacatctctgtttcttttgaaagttccttctgtatacataagcaaatataatggaaccagaacacttctattccttcttatcttgctgctctgttggcaataaaacatctggcacatgatatacatgggacactaaaaaaattataaatttctgcagaaaagggctcacattgataaggcagattgacctctctgtctcaatctgctgtcccattgggacaacctaaaatataaaaaacatgttaattataatattttcgctaaattttacctgaatatcaactatttgcacgtagttatattccctattcttgataatactttacttcttggaatatcacatgtaagcctttgcttgactttctacatccctgtttactaggctttctatgacataaaagctaccaaaagagaaacacgggaaaaaaatatataagtgctctggaaacagaaattagtttgatttttggctccatttaccagctaaatgactttggataagattcttggactttcttagtatcaaattactaatctagaaaagtgaagggaaaggtatatctataaaacatttttttttagattgagagttaacatgataccaggcacactaaggcagactaaaggctttatatgtattatttcatttaatcatcccaatagccctgtgagaaaaagggatctattccctatttgcaggtgaggactccaagactcagcaagattaataggcccaaggtcacacaactaagaaaggacagaactagaaatacctgggctgttgcacatgaagtttatactcataacctctgtgcctccttgaagggctattatggagaaacaatgaaataaagtctgtgtactgagcatcccgcacagcctcatacatcagaggtactcaataaatgttgcccatttctcttctgttttcccaccactgactaaataaattaccttggccaatgtactaacctttctaggccatagcttcttttttaaataagttatggttctcttttttctcattacaaaagcaatacatggctattaaagatcatttggacaaaagatatatatatatatatatatatatatatatatatatatatataactaaaatttgtatggaatcttaccacctaaagataatcaccattaatatgcaaatgtatgtatttatactatttatttttctatatactataagaatacataatctggccaggtgcaatgactcacacctgtaatcccagcactttgggaggccaaggctggtggatcacttgaggtcaggagttcgataccagctcgaccaacatggtgaaacatcgtctctactagaaatacaaaaattagttgggcatggtggcgggtgcctgtaatcccagctactggggaggctgaggcaggagagacacttgaatcctagaggtggaggttgcagtgagctgagattgcaccattgccctctagcctgggcaaaaagagggaaactccgtctcaaaaaataataataataatacataatattttgggagagcaaaactgaaatcctgctatcctgctatgtaatcagttatttaaataatgatgtttagaaacattttatctcacaatattcttctaagacataatgttttgtggctgtatcgcatttgtggtaataataatagtaataataaattagctcaaatgtatgttagtattgtactgagatgtttcacagttaacttattcaattcttgcaaccctatgacataggtacctttattatctacattttacagataaagaaactgaggcacagaaagattcagtcacttaacaaggtaacccagctattaagcagcagagccaggattggaactgaggcacatgagcaccacagcccatgctctggaagggatatagcatgttgttttttattaatccatcctcattagaaatctggattggttctcattttttatactgctactaatagtgttaggtatgagctgggaggagaaaaaaacaatagtttaataagtatgctgctgcaaacttgttaacatctacaattttatcatacatccctacagtttaaattcctgaaataagttattcacattgttaatggttttgtcaaataatgtcaaattgctcccccaaaaaataccataccaatttattcttacagaaaatcttcatcaaataactttttttctctgccttgccaacattgacaattcatttttttaaactttgtcagtttgatagaataaaatggtacctttctagtattttaaatttcaaaactagaaattgtaaagaacttttttatatattaattagtcattgtttcttcttcctaggataaattcgtctatgtgccttctgtccaattttctactagcatgttttcttagtgttttatgtttatatattaaagatattaatcttttgttcatcatcatatatgttgccatttttttccaggtttgttttttgcatttcaatctgtgtagagttcttttttaatgtatggaattttcgtgtgttcgtgccttcacttctcaactgcaaaatatgggagattaaactatattgtttttaagacctttaaaattataacattgtattctatttctttcctaattactacaaacaaataacttatcaggtaagtatctatcaaataagttttgaacatctacagtatgatatgtacggagctagtcactgaggttacaaaaaaaaaagcacgtctgcatgcagttggtttcttatagcttactatagaagagaccagcaagtaaacagactactagtataatcatgggtaataagtgttatgacaggagcatacctcagacctctgggcacaagtggccttgactggttgatatctgtgctgagttccagaagcaagcagaagtgagccaggtaaagaagggagaagggccttctaggcagagcagcagcattttatagagcactttgaatgccaggtagcagaatttgatctttcttctatgtattggaaggccttttttaaatcacagaggtagtataatcatcttaacattttcatgtggtagtagaatacaaagtggtttagagaaaggaaaaacaggagagtgaaaaccaggccatacattgtagggatgaccaagagagaagtagcgtagcctgaactaaggaggagacaggataaatggaaagagaaaattagatatgaaacatactatggaagcagaatcaacaaaagtaaaccactcagtagatatgagacgaggaagacaataaagaaggagatgttaatccgtgaatttaatatgaggtctgtatcagaattttgttgtttaacttgattcatttattctgaaattcacttggtaaaaataaatacgtttacaataattgatactactttgaaaaagaataacatttgtgtcacacgaatataggaataggcaataaaacataatagaatcccaaaataggcttctcaataagtatatgcaaacatttggagaatgacagagtttttatttagatggtattgggaaaattgactttcatatgggataaaaagtaagattagttctctacttcaccacagagacaaacaaaaattccgttaaaactaatgattgtataagttagagtaatgcttagttattatataaatctccaaattctagtaactaaataaaatagaagtttatttcttacttgtgtaatagtccaatgaaggtgttctttgtttggggttggggtatatggtaaaggctctgttccatgcagttattcaggaacccaggctgacaaaagcactgccatcttcagcacatggtttctaagggcattcttagtaccaaactgcaactgacatagaaaaagagaaagtgataagccatatgtgcttgccctcaactgggaagtggcatacatcatttccattcgtcttcattaactagaattagtcacctcatctcacccagaagcaaggggtcccgggaaatgagacctctagatgggcaaccacttctcagagataatgctgtaccttagaagggaagcacatatctgtggtagacagctagctacctttaccacaaagactattctgaatagtaaacataaattcattaactaaataaggatgtaagtgtgccaaaataaaatataggaaaatatttttataatcttggttggacaaagtcattctagataacttaacttctgtgacttaaaaatgacatgaaatccaggcatctaaaacaggagggggatggttttgtttttcccactgtatttgcaaagattgaagacttataatatcccaggtaataaatgagtgtgcttagaaccatgtctatcacatagtgaacagtaaacattagatttactagtactatttttattattattagcattcctttttattagcaaggagagagaaataagtgtttccatacattgttagtgagaattggtaccatcattttgaaggcatcttgatatcaatcacaaatcaaaatatgccaagaattcagtctcaagaaatttagccttaaattccttatcctaaaaataaatgtacaggactattcgtttcagcatcattttaatagcaaaaccaaaagtaacctaaaaattcattaataagtgtcttagtctatttgttttataataaaggaatacacaaagctgggtattcataaagaaagtaggtttatgtggctcacagttctgcaggctgtacaaaaagcatggtgcctgcatctgctcctggtgagaacctcaggctgcctccactcatggcagaaggtgaagtggggccaacatgtgctgagatcacatgacgagagatgaagcaagacataagtgccattttctttttaacaaccaaatcttaagggaacttacagagccagaactcagtcattacttcaaggacggtaccaagccattcatgagcgatcctcccccatgaccaaaacacctcccattaggcttcacctctaacactggggatcacatttcaacatgatatttggaggtcaaatatccaaactatagcataagtaattggttaattaaataaattagtgtcctaccttatatacatttgtattgttttgatattttactttataactttaaagtgtatattttattaaaattattcaaaacttagcttatagtgaggccactagaataattcaaaaaactggaacaaaaaaatgtggtgggagagggggatataaacatcaagaacattgtatttgtcgtacttctgattgtctcagagagaacaagatgaagtgagtttaaagggaaagaggtaaatttatgttagttattagggaaaactttctgagactatagaataacttttaatttacaaaaattttaaaagcctgaagtctccagacagtttctagaagtcaagatataccctctttgtggcttacttacctcgagagggtttatctgtccttataactactagtttgaaagtgttcaaccatgctttgtttgatccagatgatttagttcttttcattgtgattttacattgagccatgttatactttctaatacatgcattatgcagtgtaattgtagcaacaaaacacagtccatcaggttcagatgtacaattggccttgctctaacccaatccttgagttcacaatagggaagctttggatgtaaataatgaaggctttttggtatttcagtgactaacaccttttagacagggtccatggtgatcaattcatattgattttgctgactaaataatacttgagcaaagttccagtggcatctaaaaataagctctttcacagtccttatgtgtcttaaatatcattatggtatttattttgttcaaatctttgcagtcacctcaaatttcaagaattcatgtgtaaatcattctaagtgatgcagtaaattagtgaacctacttcctaataccttgtaaacctatatttcacatttctactgggctgcttataatcaatagctctttcttcactacttcccaacttgttctaatttgtttcctttgagagaggtagattttaagagttctggattacatgcttttttttttattcatgtgacttagagctcctccttgtttattagcagttctatttctttctctagccccattttctcttgaagcagccataaaagtaccatctgtttttcagcatcattttatttctgctttctcctccctgcacttttctcttctctgaatgctttatgcgataacaatttattcctgatttattatccacctgctttcatagcctccccctttctgttcctcctccatccctatcccaccctggatggagtggtataccataattcttaaggacacagctttggagtcaagtaagggccagctcaaccacttatgcatgttagtgacttgaccactatgagcctcaatttcttcatttataagaaagagaaggttataatatcatctactacataggttggcttgaagaattaaataaaataatgtacatcagggtttctcagccttggcactattgacatttggggctgagtcattctttgttctggaggctgtcctgggcattgtaggatggttagcagcaaccctagtctctaccactagatgctcgtagcaacccccttcccagctatgacaatgcaaaatgtctccagacattgctaaatgtcccagggaggcaaaattgtccccattcggaatcattgatgtatataaaacatttagcacagtgcctggtacatagtagggacttgatcaataattgtgatggatggatggtcagatgaatgattgaatattcatttttaatacaagtgtctaatataattcttgacagtcaattaactacttaatacataaatggataaacaaatgaacctgaagccagtgagcttcaagggctgtccatagtttctaccttacaccaaaatgtgttatcttcactaaaaacaagcttcctatgtttcaaaaaatattttagacaattaactaactgcacagcttaagctactcccccaatttaatatatatgcatatactttaaataatagggagattttaaaataaactctaatggatgatagctataacaattatgttgctatagaattcagtgctagaaattgaagtgatcctttgattaacctgagtattttaggttgatatcccagtcaacaagccattgatgtggtaagagaacaaagctcagccaacttttaagtgttttttaatctaatttatcttatttaaatatttattgagtgcctactatatttcaggcactgttctaggtactcaggatacaattgtgaacaaaacaatgataaaacactgtggaaccaccattctatgaaatagtagatcacaaaaatagtaaatacataaatagaagtaaaaataaagactactcataacttgtaaaatactagcctaggaaatagtctaggtggtactgacagcaaaattccagtggatgactgtaacccaaccagaaacatttttgtgactgcactcactgtttgccatttggttgctcatctatgatttcagtttactgaactctaactttctcgtctgatctgaattacaatgagggtattaaatcaaatctgtggttacctttgcatattttggaacttcaaacatttagattgtgattcactgtgtgcataattttttaaattgtctcaaatcaacaatctttctcttacttttctaggttttctctaatgaactaactttatagcatactttttgtgctgtagtctaacaaaccgatagctgagtttttttaaaaatgaatacaatatatgctttttctgcctcgcttttttcatctgtaaaatgggatctgtgggatacctaacacataaagtcattgtaaggattaaataaggtaatgtttattaaaaaaaaaaaaaaaccttagaactgaagaaaatgccaagcacatagtaagttttaagtgtagtattttctgcacccctactagccatgtacttatttctagtatttccaatattttagcatagtaaatgaggtagtatatctttttcttttctttctacacttgggagaaagcaagattacaatgaaataaaagcaaaatgtatgtccaacagggtcatataagtaatgtctgtttgtaaaccactagtctcaggagtaaatccctcaacatgatgaaaaccaagagatgtgtttgcacataactctttttataaagtttttttaattgcaaagacatagtcgttgttataaacttccaacatacagaaattaataatttacaaagtgaaaagcccctttatgcatatattcacttcagctcactccctttagaaataattaatagtaataatcagcgtatagtctcacttttttttttttttttgagacgcagtcttgctctgtcgctaggctggagtgcagtggcacgatcttggctcactgcaacctccgcctcctgggttcaagggattctcatgcctcagccttccaagtagctgggattacaggcacgtgccaccacacccagctaatttttgtatttttagtagagacagggtttcaccatgttggccaggatggtctcgatctcctgacctcatgatccgcccaccttggcctcccaaagtgctgggattacaagtgtgagccactgcgcccagcctagtctcaaatttttttcctagtcatatactaatatatatttctattaaaataaaatcacattgtacatactgttttgcaactggcctttattcacttaaaatatgtctttggtgtcagtgtcaacacatttagttccttcttgtttccaacagctgccaagagtggtaactctctttggctctctgggtacttacccacaaaagcacatgcatttagagctggtggaaaaagtccttcagggcggacaccggtggctcacacctgtaatctcaactctttgggaggccaaggctggcagatgatgtgagctcaggagttcgagaccagcctgggcaacatagcaataccccatctctacaaaaaaatacaaaaattagccaggcgtgttggtgcatgcctgtagtcctagctccttgggaggctgaggtgggacacagaggttgcagtgagcagagctcatgccagtgcactccagcctgggtgatagagtgagaccctgtcaaaggatggaaagagggaagaaaggagaggagaggggaagaagccctttggctgaaacttgcactgccaacaactgaccccccctctctctcaaagcactgacccaaaaaggggcaccagcagagaggctcagaagatcttctcagtccacaccaggagaccagacctttctcagtgcagggagaaggatgagctgaatgaggaatactcacttatacagcagttaatccagaggatgacagaaacattacaaatgtgacatccttgaaatggaactcctctttggagtgtggaagcccagtcatgcacaacccacttggagcaggaaggaaattgtatttgaggatgttaaagtcaagctaacttttattaaaattgccacaggaggccattcatccccacttcacttatcccacttcaaagcctacttcccatcactcagatgtttacttatggagtgattaagttttcttttatcttttctatgctttcatcagatgctctttttctcttttttgcttagaaaaggcagattttttcagcctaatgtcaatatgtcaaacattaagtattcattcccttgcaatgcacagtgtttatacttacataccctattataacaaatgtaatattatttaattatgcagcaaacttacacataattggtgaacaggtctaaagaatactctatacaggaagcatagagtattcagcttagctgaggcctttgttaaacaatatgcaaagttgcaggtgccacattagggaattttgggggaaaggaaatgcaaacttatttggcaggaaaacaagagaaatgattatatctcacagcactttcaagctggacacatttacatgcctctgtcacatcacccagaagctgtggtgttgagggctgaggcaggagatccttttgccacaggaaaaaggatgaaacgagagacattgtgaaaggttgccccaaagtcttaaggctccctgaaaccttgggttttttgaacaccattgtccaatctgttgaaggttaaataatacgttgttcaaaattgcataggtaaagcgcagaatggccaaagggtcagaactacagcaataggtaggtcccattctctgccttttcattcttcagtcttcggaaatgccacagaggccaagtggcactaggtgcagctgggaatcaagatctgtttatctgtaccttaaataggtcaaagtgaaccttttggaaatattgttttggtaaataaaaattcctggtcgtgctaactgtggctatttcgacctgtttctttcagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggtaagatttgctctctgaatttaaaaacacaatttttgaaactttttcattgatcgctgtaatagttaataaacctgtcacaagaaaacttagtcattgcagaaaatggttaaaacaattttgggacatgatgtacaatggattatttaagagccatcataaacatccaagaagtagtaaagtgaatagaatcctcatagaattcttttttcctttttcaaagatttcccacctctaaaaatctttcattccttttatatctaggaattaatcacagcttggtacataggatttttggttcttattttttcgtctttccttgtctatctggtggaaaaggatgccaataaagagttttctacatatgcagatgctctctggtggggcacagtaagtataaaaatacattttttatttattggatgttgtgaattgtttttttttaatacaacgtaatggttcctatggatggtttcaataaaaatattaaattgcgaaagagagttatatggaaaataaatactacttattattgtctaaaggctttccacatctttttaggccaactaagttgtcttgtaaaccatcattaatatttcttgagtgctagattgttgccaaaattaaaaatatataaaatatataaatatatatcatttttaaaatggtgattaaaacattgatagtttgtttatttgttttaactttgtggagcacaaatttaaatgatcaattgttgcattgattttccgctcttcaaaagtttatctggggttaaaaaatgaatggaagctgtgaataaaattgcagcacaaagaaatgaaaaagaagactggtaaccatctgtgagatcagagattatagtcacctaatttcaaaactttcctctcaaaacctactttttctttatattattaaagaataattttccaaataaataaagtaaaatcatgattcttacatagaaagaaaattaacacatgctaaacattcatttaactcattttaaaagtttaagtcattattaatgaagaaaccagtaagatgttaaaaccagttcaaagcactatccaaaggacagaaacatttaaagatcaggaatattgaaatcaatgtgcaaatagaggcaaaactggctccttccacagtgtgggagggaagtcagttcaacctccactaggcagaatttatttacatgtccataggcaagaattattttgcattgctaccagttatcaacaacttacagagttgtaaaatagctcaaaggctatgaaaagagcagagccccataaaatcagaatccaaaaacctggaagggtgtactctgaacaacgcatagttttccactgaagcaaaaattttccctgcattgtaaagaatttatgaaacagtcattggagctatgccgtaataagaatgacatgggatataggagtgctttatgcaatgtataaattacatttctttttattttattcctttaaggtattccaaaggggagttatatgaaaataatcatagccaaacatggtggctcacgcctgtaatccaagcactttgggaggctaaggcgggccagttgcttgagctcaggcatttgagaccagcctgggcaacatggcaagaccccatccctacaaaaaatacaaaaattagccaggtgtggtggcacactcctgtagttccagctacctgggaggctgaggtggcagaatcacttaagcctggcaggtagattataaatgcttgtctaaagaatgtccatatcgttttggttcaaaaaaccccgtgagttctcttttaaaccacccttagtatttcttgagttctagattgttgccaaaataaaaatatatcattttcttaagctgtgatttaaacaatgataggctttttatttgtttgtttagtgaagcacagagttaccaattgttgcattgttccactagtcatcaaaagctcatcagcaagacccagaacatttgtcagagagggggaaaatttgttagggctgtatttagcagaacttgttgtatttgttgattgcatagcagcaataaaatgaataaaaatgagaaatacattcacctaaagattcgaatttttttcttaagttatctaagtaaatgtctacaagattatgccattggtttcaaaggattccgttggtttaataatgtggtttccggctgctcttcactattcacaagcaataatgggcatttcgaaaaagagtggaagcttgaaagagagcagtcatctgacactcttaaaatactttttatatgtagagagcaaatgaaaatctgtgactcatgatgggataaactgtaaactgagaaaacaggaggcttttcttgccagcaaggggaagacagtttatcatcccagccttcaaagcaatggtttgaattcaagtttaatttttgcttctcttggataattctaatgtatttgacttactgaggcacccaggtgccccttttgccactgagatgcagttgttggtgagtttagcctgggagctcattatctttctttttattagtcttccatttctccttattacaaaaaagaattgctgtattgtgtgttaaacagtgtgtgggaaactcttaatatacctctcagttagtcatcagtttgtttcttttgccagaataacccacacggtaggttttcaaaggtcatatctgtgactttcaggggaagaaacattttcattgatttgcctttcagttctgctaatttgactgacatttaacccgtacttaacaggttcctgaatggcctaattatgtttctatttttaaaaaaaatctagtcttgaatatgagagtaaaaattttataagagatcaaacttcgaagaattttttaaggccttattggtccgtagcaggtttgttgatattaactgactcattaatgaaattgtctgaatcctaaaaagacagaagaagcaaacaaacaagagagctcattgtttctattcattttaagaagaacatatactagattcctagtgggaaataaaataaatttagactattataccttttatttatacattaatcaagaccttagtgaaaattatggttgggtatttcttagttaaaattgcgcatgttgcacctaatggaaaccttaataactatggaagtatccagaataaatagggaaatgatagcatcctaaatgagagtatttctaagtgttacactttgatgaaaaaaggaaatcccctatattaaaagatcccacagtatcaacattaagtatcaaaatataggttttgttccacagatacgctgtgccagtgaattttcaatactaactctggaactccttccattaagatagtgagatctgtcccctagatcaacatttggagggatatcatggtgggatcagtgctgcccaaaaaactttgatccctgaaagcagtttcatattagtgaatagcaatacctagttcattgagtaagtgaaatagatataaaagacctggtaccaagaacatagcaagtgcccaatcaaatatgagagctattgttggtgtagacatcattgctgtggaagttaaatgaaagcacctttaatacaaaaggaacaaaaaaagagctatgtgttttgatgcagacccacagtttgaacacagaagaggcttgggaattggaggttgtgatgaaaagatgtcctgggttctgatgtggcaactaaagttgcattgatggcagaaaatggaagagggaagtagctctagtagctgaggcactgagagttgctggaaaaggggatcttctgattgttggatagagctccatttattatcattttctattgttatttttctcatttttggttgttccagatttattctgaaataatttaagaatgggtttccctggagttattttctgttattaaatccttcctgttttgtgggagtgatttttctctttttgatctgctttagatttattttgaaataacttaagatcaggttttcctgcactccagcctgggtgcttgagtgagaccctgcctcaaagactcccttggggagaattataccgtgccacggaaatctaccaacagtatattgttcacctgaacacattagctataaactaatgtacatagatttactaaaaacataattgtatcttcaaaatcaggtcaataaatatttgttgatttgttgcctgaaagaaagaaggatttatatctcctgatttggaattaattctgctattgaaaagaaaaaaaactttagcctaaccagtgtcttaaattataatctgaccatagcctcagccatctcatttaaaaaaaaaatcaagaaaagtctggaccagagttttcatttgtttttcagtattatttctgaggaagaattcctgaatgctaaacacacgaaggtgcccccactccacctcagattttcctaacataattacaactttatgccaacatttccaacccacagattttcagaatgtattttctttcacctgtgtgactgtatttgagcataggaaacataagggccaaaatatatctaagctgtttctatctgcaagacgccttcaaataaatggtccagctgaagagatggtacaaaataccagggattcctgaggccagctgtggggaggtagcagggcaaagcagaccatccctgcccagatcctcatccgccttgttaccctgcagcctgaaaaggcagctgccagcttctcagtttaagaactgtggcaagaaatggcagcttctcacttaaggagaatactactctgcctagaactttactgaaagagatggtggacatttttgtcacttgtaatttgtttttaattttaaaaagtaaattcaaaacgtcatgaccttacctatgatattataaagatcatactcaaaagtcacgagtatgaatcacagaagatttttataataaaaatgtaatctatccagtgcatgttcaccagcatatctcttacaagctctggaatgaggaaaaaaaatggaattatgtccaatatcgtgatgtaaagatccatctctctattctcctgcttctcatctcttacacacacgtatatataagcaaaatgtcacgctcacatgggtgtgggaaatcaaagctcacgaaacactatttagtttacttgcccacttatgtaaatattgtatttgttttagaatagagtagaagctctcagaacttatttcctcttcactgactggccagattaaccaacactcctcactcccacaaaacatactgaggcttgcagagcacaaaatgctctttagtatccacagaattctgttctgaacattgtttgaatgcttgcaaagagtcagcatgttcattaccaaacctttttttttttttttttttttgagacagggtctcactctgtcacataggttgcagtgcattggtgcatttatagctcgctgcagcctcaacctcccaggttcgagcagccctcccgcctcagcctcctgagtagctgggaccccaggcacatgccaccatgcccagctaattttttactaattttttgaagaaaaggggtctcaccatgttgcccaggctggtctcaaactcctaggttcaagcaatctgtctgccttggcctcccaaagtgctgggattacaggcgtgagccactgtgcccgtcccattcctaaacctttttatgtcagttgtatttgtaattataatggcatggtttaattttatattattgcataaactgatgacatatggtacagaaagaaagatggatggtttacgaaaatagaatgctttagaaaagcttgataaatgcaaaatactaaatatgctaaaatactaaaaatacttcaaaatcaggggtgaacacacaactatgtgggggaaaaatcttaaatatttaggactctgttctcagatagctcccacaaaagttgagtttatgcaccactaaaaaaaaagttaattttaaaaaacattaaaattaaggaaaataaatgatgcattatgagtgagatttatgcaaaaaagataaggcagaaccccaattgcagaacacattcttcatcaagaatattacatttatgtgctttaggctaaaataaaatatgcagcatataagtctctttgtgattatctgcattagtcaaatttctgactaagcaaccaagtagccatcataaaagtttcaattaagaagacttctctgtgtattctcatgcattaatatataatatcagaaaattatctcaccaacagagaataacaaggctgtctcataagaacatttattttacattgattcaactgctttatggttctactaattcccttgcagcacatttgctatgcagagtaaaagtctgatgtattgtgattcacttttaacactgtatatattagaagagaattaaatgctttgactcaggaagtatcaaaaatatattagtacaaaaagaacccattaaccgaccacactttagttctttctgtcatcccaaacccacccaatccctgtcatccccacctacctagcccatatgtagtcatgaagcatcctcatggttcacccgagatgaacagagtcactgggtttaattccagcaccatcacccatgggactcaacccttgcaccctaatgccatatgcacatatagaactggcagagaattacacaacaaagggggcgggatgtgatggaagtatcttcaaaggagcaactacattatttatttaatgttggattcccagtctaaagatagtgtaaagggattatttatttaatgttggattcccagcctaaagacagtgtaaagggagtgtgttatttatttgtttttctttataacagtaatccattttttccaaaatcagctctggctctttaacttcatttggcccatattactgtgttaactgtatactgttaagtgataatagcaacctgcccttctgcctgggagtcactgacgtacgcagtttgtaagcatctgcaatacagagatgatgagatacaattgaataagtcatcttcccatgccatgccatcaggatgctgctgggttcttgaagatctgtgagaaatgtttctagaaaacgaactgactgcctcatcacccaattcaattgtgaagtctagatgtgatttcctccaagcccctaaagatcgcatatgcagcctctccaggttctctgaaacatgctgctattccagaatctccccacttattctgaagaacgggtgcccttgggttcttgtgtgggcctgccctttctccgaccctgaacctaaatgaaactaatcattactgggttctaccagtgaaaagattcataacatttttggaaggcagaaagaggtttattatttagcacaagcatgggagaataagaaccaagagggctcctgctactcagttcatgtacaaaggatcaactgataaacattagcagggcctcccaagtgctaggaaaagaaaagaaatataatgtagttgtacagttccaaggagactcactggtacttcaagggcagcttgacctgaaagtccagaaaaatcaatgaatatctatgcagcgctcatctaaggatggtttatcaaatgcagctggtccttgacttaaaatgtcaaagccagatcaagcagatgggtcagggtgaatacctggaaaaaattaacatctttttattgtaagcacatcttaaagacttcataattttatgtctggtgctatctttctgttcacatcatgaagcccaggtgtcctctttgccaccacagaagggaaatgatgcatgcacgctccaggcaaaaaacgagggaaacccacaccaactccctctctggcatagagggggacaaaactgccaccctgttgccagatccttcccaagcctaagctgccaacaaaaggcccctttgctttaaccaggaaacatccctagctcctttgaaatcagaggggagaaagttattgaggctgggggttcagttgctggctgttcaggtcccttgcattcagtgaaatgtgatcatcccggaagcctgaaccggagtgtagggagaaagtgggcagggtctttgctcacccccagaggaactccagagtgctgttctcagatttcacaaccttctattctcccccgcaaaccacccctgtaagagaaaggggcaaccctaaattcagaatgaaagaaagcaggcactcttttctactcaggatgaaacactgagcacattgtcacttggctgtgtcccattcttcagagttagagtcagtggtttaaaacccactctgtgagcactgggccgagcaaatgtattattggaatgaaaagcaaaggaaaccacgaaatgtaacatttttgctgtgaccaaaccatgaaagttcttcttcagtctattattattaataaaccgatgtaaaaggattaagctatttttcagaaaaagtatagtagattaatatctgtcccacatatataaagattaagaataaaattgacctggaaattttttttctgcattctcaaggaattcttttgagaattccatattaatactgctgatgacattagattaatttggctcctgtaaagttctactacatattccctctctctgacattgaatgagttcttccaaccagcagacctcttattaacctgtccttgaccccttctcagaccttcacagcccaagcctctttgcctattccaagcctctgactccccacacatgatcccaccttctccttgtctataattgaaaggacagacataagcattcctaatccttccctccactcacactgaggccacatcatacccccactgtggaagcgctgtcctttcacactgcctgggctaacccctccaactgtgcccttaaccgaattccttcttgggtactttaccccatcaggaagccgccaccccttccctcttcagtctcaccctctctacaaacatgcagaagtacatcctggaaagcctcccttcaagtcagagattcctgggagttcttgccctctacatctcacttcagttgttgccaatgttcttcaaagtattattcatttatttactaaatatttagtgagtttctctcactttgtggcaagcattatgctagatgttggggaaataaagagcaagctgaggttccactttctagttaaggaaataagaatccctacccaaagaaaaatacaacagactatcactcacgttaatgttattacgaaacaaggagctgtaatatagagtaatcagagtctctactgaagataggtaggaaaggcctctccaatgagggagtattttggataagacctgaaggatgaaaaggagccctgggaagagtgaggaaaatggcaattccagctgagggaacagcttgtgcaaaggccctgaggcagaaagatcctggcttgtttgaagagccaaaaggccactgtcattaaagtgcagtgagcaagggtaaaatcaaaatgatcttaggtaggtggagatggcttaattagtagcttagaatttattttgaattcaacagctagccattgaaggattttttagatggaaataagaaaatgataccccttgcaggtatatgaagaaggaactagaggaaagcaaaagcaaaagcagagagagcaattaagaggctactatagcagcctggtctaccatggtggcagcaaagacagagaaaagggggtgaatttgcaaaaacctaaggagatcgaatcaacaggacttgctgatagattccgtggggggagtgagggaaatgaatagttaggatgattctgaggcttctgacatgagcaagtggatagattggtggagctcttggttaagacaggaaggaatatatttggtagaaataagagttctgttttagacacattcagttaaatgactgtgtgacatctaaatggaactgtcaactgcagatatgtgaattgggaactcagaaaagtggtctggcctagagatataaatttggagtgtttagcataaaagtggcatttaaatctatgagaacatttaagatcacctggaaagagagaaaaaagaggggatagaaaagaaaggaaagtctaagaagaatacaatttttaaaagaagaaaaagacttagaacaaaaccttaaaaatccagtgtccaaaggttgaaaagggtaagaggagccacagaaaaagagccaccaaggaatacaaagagaaaaccatggaagtgaagagaagagtgcttctagaaagaggtggtcagctgagctgaatgcttctgaaaggtctggcatcatagaatttgtctccctctttatcaaacctgcttctgaattgttccccctctttcaaagcccaggtaaggtggcatgaccagagcaaccactttctcagtgattgccagtgaccacctatctccaccatattcagtctctttttctcaatgctcattgtccttgttttctttttctctctctctctctttttttttttttttccagatggagtttcactctgttgcccaggctggagtgcaatggtgtgatcttggctcactgcaacctccacatcctagattcaatcaattcccctgcctcaccctcctgagtagctgggattacaggcatgcaccaccacacctggctagttttgtatttttagtggagatggagtttcaccatgttggccaggctggtctcaaactcctggcctcaggtgatccacctgcctcggcctcccaaagtgctgagattacaggcataagccaccgtgcccagactcactgtccttgttttctattaggctgtgacatcagagattacctggtctttgtgaaactctccattctctattgagtttccatttatataaccctttcccgattgttctacttttgaaaaacttgaaaaacatgacatccaaagacattcttctctgactttcctttcccttccattccttaaatgtctgtgttttttgaggtgtccctggaccctttctgtgtaccttttgtaatctcagttatgcacatagctttaacatcaccctgttactgattctaaaacccaaatctcacgccaaaccaaatttctctctcaggactcaagctctcattctcagtttcctgctagacatttctgcattagtcatactgacatttgaaaaaccattatttgcaaaactaaactcttcacctttactccaaaaccttctctttttcattataatgcttttatttatggtgcaaccatcttcccacttaaaattttcaagtcactgttaacttagtctttccttttacctcaatcaataaatttatttctattgaacttcctaaacatttctctttactctccactctcatagtgtcttaactggtctctgcacctctcatttcttcctatttcaatctctcctgtacatttgctgccataatttcagcttctaaaagcactactctgatcacattatgtactttgcttacaaaaaccttccgtcagtatttctgggctgcaaaacaagagagcagaatcctatcccacccatagggctttcattcctttattcagtaaatatatattgagtgactactgtatgccaatcactgtgcaaggtgcttggattcagcagtaagataaagtcccaacccacatacaatttactttctagttgggaaggcaaacaataaacaatttaatcaatatacaatatcatttcaggtattgatacattctatgaataaagatgaacagaataaggatttaggaaacagttggtagggaagtagctttttttgttgttgttgattttcgtggggttttgttttgtctttatgagaaaatgactgttattattatacagtgtcccccagcgattatttttctgtaaattattggggaacaggtggtttttggttacataagtaagttctttcacggtgagttgtgagattttggtgcacccatcacccaagcagtatacactgcaccctatttgtagtcttttatccctctcctccttcccatcctttcaccttgagtctccaaagttcattgtgacattcttatgcctttgcatcctcatagtttagctcccacctatgagtgagaacataggatgtttggttttccattcctgagttacttcacttagaacaatagtctccaatctcatctaggtggctgcaaatgccattaattcattcctctttatggctgagtagtattccatcatgtatatatatataccacagtttctttatccactcattgattgatgggcatttgggttggttccacatttttgcaattgtgaattgcgctgctataaacatgcatgtgcaagtgtcttcttcatataatgacttcttttcctctgggtagataaccagtagtgagattgctggatcaaatggttctacttttagttctttaaggaatctccacactattttctatagtggttgtgctagtttacattccaaccagcagtgtagatgtgttccctgttcaccgcatctccaccaacatctactatttttccacttttttattatggccatttttgcaggactaaggtggtatcacattgtggttttcatttgcatttccctgatcattagcgatgttgagcattttttcatgtgtcttggccattcatatatcatcttttgagaattgtctattcatgtccttagcccactttttgatgggattgtttgtttttttcatgttgatttgtttgagttcattgtagattctagatattcatcctttgtcaaatgtatagattataacgattttctcccactctgtgagttgtctgtttactctgctgactgtttcttttgccgtgcaaaagctctttagtttaattaagtaccagcaatttatctttgtttttattgcattcacttttgggttcttggtcttgaaatccttgcctaactcaatgtatagaagggtttctccaatgttatcttctagagtgtttatagtttcaggctctatatttaagtccttaatccaccttcagttgattcttgtatgtggtgagaaatgaggatccagtttaattctcctacatatggctagccaattatcccagcaccatttgttgaaaagggtgtccttcgcttctcaaaagaagacatttatacagccaacaaaattatgaaaaaatgctcatcatcactggtcatcaaagaaatgcaagtcaaaaccacaatgagataccatctcaagccagttagaatggcgatcattaaagagtcaggaaacaacagatgctggagaggatgtggagaaataggaacacttttacactgttggtgggagtataaattagttcaaccattgtgcaagacagtgtggcaactcctcaaggatctagaactagacataccatttgacccagcaatcccattactgggtatatacccaaagtattataaatcattctactataaagacaaatgcacttgtatgtttattgtagcacttttcacagtagtaaagtcttggaaccaacccaaatgcccatcaatgatagactggataaagaaaatgtggcacatatacaccaaggaatactatacagccataaaaaaggatgagttcatgtcctttgcagggacatggatgaaactggaaaccatcattctcagcaaagtaactcaagaagagaaaaccaaacaccacatgttttcactcataagtgggagctgaacaatgagaacacatggacacagggaggggaacatcacacaccagggcctgtcaggggttagggggctgggggagggatagcattaggagaaatacctaatgtaaatgatgagctgatgggtgcaacaaaccaatattgcacatgtatacctaggtaacaaacctgcactttgtgcacatgtaccccagaacttaaagtataataaaaaagataaaattcagccttaaaaaaaagaaaaagaaaaagaaaagggtgtcctttccccattttatgtttttgtttgctttgtccaagatcagttgactgtaagtaccttggtttgtttctggattctctattctgttccattggtctatgtgcatatttttataccaataccatgctgtcttggtgactatggccttgtagtttgaaatcaggtaatgtgatgcctccaggtttggttgggtttgtttttgttgttgttgttgttgtttggttggttgggttttttgttggtttatttgtttgtttgttttggcttagtccttctttggctatgtgggctctttcctggttccatgtgaattttatcattgttttttctaattctgtgaagaatgatggtggtattttgatggaaattgcattgaatttgtagattgcttttggaagtatggtcatttttacaatattgattctacctatccgtgagcattggatatgtttccatttgtttgtgtcatctatgatttctttcagcagtgttttgtagttttccatgtagaggtctttcacttccttggttaggtatattcctaagttttgtggattttttttttgtttgtttgttttttgtttcgttttgttttgtttttttgtttttgtagctattgtaaaggggattgagttcttgatttgattctcagcttggtcgctgttggtgtatagaagagatactgatttgtgtatgtgaattttatatccagaaagtttgctgaattcttttgcaagttctaggagctttctggaggagtctttagggttttctaggtaaacattcatatcatcagcaaacagcaacagtttgacttcctctttaatgagttggatgccctttatttcttcctcttgtctgattgctctggcaaggacttccagtattatgatgaagaggagtgataagagtgggcatccttatcttgttccagttctcagagggaatgctttcaacttttccccattcagtattatgttggctgtgggtttgtcataggtgacttttattacttttattacattgttatattatgacattttattgtcatagatgtcctttgtgtaccagttttgttgagagttttaacgataaaggaatgctagattttgttgaatgctttttctgcgtctattgagatgatcatgtgattttggtttttaattctgtttatgtggtgtatcacatttattgacttgcatatgttaaactatccctgcatccctggtatgaaacccatttgatcatggtggattatctttttgatatgctgttagattcggttagctagtattttgttaacaattttagcatctatgttcatcagggatattggtctgtagttttcttttttgattatgtcctttcctggttttggtattagggtgatactggcttcatagaatgaattggggagggttccttctttatcttgtggaatagtgtcaataggactggtatcaattcttctttgaatgtctagtagaattctgctgtgaatccatctggtcctggactttttttgttggtaattttttaactaccatttcaatctcattacttgttattggtcattcaggctatctaattcttcctgatttaaactaggagggttgtatttttccagaaatttatccatctcttctagattttccagtttatgtgcgtaatggtgttcatagtagccttgaatgatcttttgtatttctgtggtgtcagttgtaatatctcccatttcatttcttcttgagctaatttgcattttctctcttctttttatggttaatcttgctaacggtctatcaattttattcatttttaaagaaccagctttttgtttcatttatcttttgtattttgtttgtttgtttcaaattcatttggttctgctctgatcgtggttatttcctttcttctgctgggtctgggtttggtttgttcttgcttctctagttccttgaggtgtgaccttagattgtctgtttgtgctctttcagactttttgatgtaggcatttatggctataaactttcttcttagcatcgcctttgctgtgtcccagagatcttgatatgttgtgtcattgttgccattcaattcaaagaattttttaatttccatcttgatttcatttttggcccaatgatcattcaagagcaggttatttaatttccatatatttgcatggctttgaaagttcattttggagttgattttcagttttattccactgtggtctgagagagtgcttgatataatttcaattttcttaaatttattgaggctcattttgtggcctgtcatatggtctaccttggagaaagttccatgcactgaatagaatgtatattctatggttgttggatggaatgttctgtatatatctgttaagtctatttgttccaaggtatagtttaaatccattgtttcattgttgaccttcagtcttgattatctgtccagtgctgtcagtggagtattgaagtctcccactattattatgttgccacctgtctcatttctaaggtctgttagtaattgttttataaatttgatagttccagtgttcagtgcatatacgtttaggattgtgatgttttcctgttggactaggccttttatcattatataatgccctctttgtcttttttaactgctgttgctttaaagtttgtttgtctaagaataggtactcccgtttgcttttggtgtccatattccaaaaatgtctttttccacacctttaccttaagtttgtgagactccttatgtgttaggtgagtctcttgaagtcagcaggtagttggttggtgaattcttatcaattctacaattctatatcttttaagtggagcatttaagccatttacattcaacgttagtattgagatgtgaggtaccattccattcattatgctatttgttgcctgtataccttggttttttgttttttgtttttgttttttaaattgtatttttgttttataggtcctgtgagatttatgctttaaagaggttctgttttgatgtgtttccaggatttgtttcgagatttagagctccttttagcagttcttgtagtggtggcttggtagtggtgaattctctcagaatttgtctgtctgaaaaagactgtatctttccttcatatatgaaggatagttttgttggatacaaaattcttggctggtaattcttttgcttgaggaggccgaagacaaggccccaataccttctagcttatagggtttctgctgagaaatctgctgttaatctaataggtttttatttataggttaccaggtacttttgtctcactgctcttaaaattctttcctttgtcttaactttagattacctgatgacaatgtgcctaggtgatgatctttttgcaatgaatttcccaggtgttctttgtgcttcttgtatttggatgtctaggtctctagcaatgctggggaagttttcctctgttattccctgaaatatgttttccaaacttttagatttctcttcttcctcaagaacactgattattcttagctttggtcatctaacataatcccagacttcttggaggctgtgttcgtattttcttattcttttttctttgtctttatggagtgcgttaactgaaagaccttgtcttagagctctgaaattctttcttctacttgttcaattctattgctgagactttccagagcattttgcatttctataagggtgtccaaagtttactgaagttttgactgttttttatttatgctatctatttccttgaatatttctcccttcacttcttgtatcattttttggatttccttaaatcgggcttcacatgtctctggtgctccctgattagcttaataattaacctcctcaattctttttcaggcaaatcagggatttcttcttggtttgggtccattgctggggagctagtgtgattttttgggagttgtaaagaactttgttttgtcatattaacagaatcggtttctggttccttcttatttgggtaggctctgtcagagggaagatctagggctgaaggctgttgttcagattcttttgtaccacagggtgttcccttggtgtagtactctccccctgttcctatggatgtgacttcctgagagctgagctgtagtgattgttatctatcttgtggatctagccacccaacaagtcttccagactccgggctggcactggggattgtctacagagtcctgtgatgtgaaccatctgtgggtttctcagccgtggatgctagcacagtatttagggtgtctcctaggtccttcaggagcaatctgcttcctgcagggggtctgtgggtcctctctattttcgttttaaaggcagactttgtaataggacacactagtgggcaatttatagttgtatactcataagcaaactgtttaaattatctgaatccaagtttcctcatatgatcacaagatgaggtcccacaacaggtcgtctgcaagctgaggagcaaggaagccactctgagtcccaaaaccccaaaagtagggaagccgacagtgcagctttcagtctgtggtcaaagatccaagagtcccaaaattgaagaacttagagtccagtgttcaaggacaggaggcatcccggatgggagaaagatgtaggctgggagactaagccagtcttgggaagtggcttaaattaggtgatctgggatggttttctgtggagctgacatttcagcaggtacctgaatgcaaacctggaagtaacagaaattcagaaagagaaaagcaagggcaaaggtccttaggcaaaaaaaaaaaaaaaaagagcttggtgtgctgatgaatagcaaggcaggaggggcagaagcagaatgagagagagcatggtagaagaccatatctgagaagttagctgaggtcaatcatgaagaaccctgcaggccatggaggagctgggactttgttctaagagatgtggggaacgcctggagcagtctgatcataggagaggcatgatattcaaagacattccctggcctagctttagcatatctagttaaccttctctttactaatcctttacttttctttcattgtaaattgagaaattatagttgtatatatttctggggtagaaagtgatgctatgatttacaaacacaatgtggaatcattacatcgtgctaattaacatatccaccacttcaaatacatatcaatttttgtggtgtggctgggtgcagtgactcactcctataatcccagcattttgggaggccaaggcagggggatcatttgaagtcaaaagttcaagaccagcctggccaacatggtgaaaccctgtctctactagaaatacaaaaattagctgggtgtggtggcggatgcctgtaatcccagctactcaagaggctgaaacaggagaatcacttgaacctgcgaggcagtttgcggtaagctgagaccgtgccactgcactccagtctgggtgacagagtgactcagtctcagaaaaaaaaaatgtggtaagagaatttgaaatttagtcttagtaattttgaaatgcacaatacacattactaactgtattcaccacactgtgcaatagatctcatatatatatatatatacacacacacatacacatattgttcctgtttaactgaggctttgtgtcctttgaccatcatctccccattcccccaacccccagcctctggtaaccagcatactactctcttctaccatgggtttcattgtttcagattccccatgtagtgaaaacatgcagtatttacctttctgtgcctggcttattgcagatcatctcatgagatgcagaaacatcatttgatcaaattttatttcataataaaaatcctcaacaaattaggtacagaaggaatgtaactcaacacaataaaaagcatatattataagccaatagctaacattatactccacagtgaaaaattgaaatcctttcctctaagatccagaacaaaataaggatgcccacttgagcaagatctagtgctgtgctggcttcaggtctaacccagtgcagtctcagtgatggtggccacaaggctgcttgtgtcgcccctcaccaagctccaggcacctcagcacagagaaagagagactcgtttgtttgggagaatgtaaggaagagaacaagagtttttgcccagtaatccagagaattctttcagatcttattcaagaccaccaaggtgatacatctacaagtctacaagaaccatagcattactgggcttggggtaccccttaatgcagaaatgcctgcagtgaccaaaaacttagatcataatactgaagtcccttcaaataccaggaaagccttcccaaggaggatggctacaaacaagcccagattacaaagactacaataaatacctaactcttcaatgcccagacactgacaaacaccacaacctcaagataatccaggaaaacatgagacactcaacataacacagagaatgaattcagaattttatcagataaatttaacaaataaattgaaataattaaaaagaatcaagcagaaaatctggaggtcaaaaatgcaactgacatactgaagaatcatcagagtcccttaatagcagaattgatcaagcagaagaaagaactagtgagcatgaagacaggctatttaaaaatacatggtcagcagagacaaaagataaaagaataaaaaagaaggaaatgcccaaaatatctataaaatagcttcaaaggggcaaatctaagttattggccttaaaaagtagggagagagagagaaagtttattcaaagggataataacagaacttcccaaacctagagaaagatatcaatattcaagtaaaagaaggctatagaacaccaaacagatttaacctcaaagcattcactaataaacttgcaaaattcaaggataaagaaaagattttataagcagcaaaagaagagaaataaataacgtgcaatggagctccaatacatctggcagcagacttttcagtggaaaccttacaggccaggaaagagtggcatggcatatttaaagtgctgaagggaaaaaatattttatccttgaatagtatatctggcaaaaatagccttcatgaaggagaaataaagactttcccagacaaacaaaaactgaggcatttcatcaacaccagacctgtcctataagaaatgctaaagtgatttctttagtttgaaagaaaaaaggcattaaggaaaaactaaaaaccatctaagggtagaaaactcactggtaatagtaagtacacagaaaaacagaatattatagcactataattgtgctaattatttatattttaagtagaaagacaaaaagatgaacttatcaaaaataactacaacagcttttcaagatatacacagcataataagataaagtagaaacaacaaaaagtttaaaagtgggatgacaaagttaaaatgtagcattttcattaattttctttttgtttatttgtttatgcaatcggagttaaattgtgatcagtttaaaataatgggttataagatattatttgcaagcctcatagtaacctaaaatcaaaaaagcatacaatggatacacacaaaaaaataaaaagcaagaaactaaatcataccaccagagaaaatcactttcaatgaaaggaagacaagaaggaaagaaaaaagcaagagaagaccacaaaacaactagaaaacaaataacaaaatggcaggagtaagtccttacttatccataataacactgaatataaatggattaaactctccaatcaaaagacacaggattgaatggattcaatggattaaaattaaattttaaaaagcaagacccaatgatctgttgactacaagaaacatacttcatctataaagactcacatagattgaaaataaagggataaaaaaagatatcccatgcaaatggaaaccgaaaaagagcaggagtagctacacttagatcagacagaataggtttcaagacaaaagctatcaaaagagacaaggaaggtcattatataatgataaaggaatcaattcagcaagaggatataacaactataaatatatatgcacccaacactggagcacccagatatataaagcaaatattattagagcaaaagagagagacataccccaagtcaataatagctggaaacgtcaacacccaactttcagcattggacagatcatccagacagaaaatcaacaaagaaacatcaaacttaatctgcacaatagaccaaatggacctaataaatatttatagaacatttcatccaacagctgcagaatactccacacacttctcctaaacacatggattattctcaaggatagatcaggataggccacatgttaggccacaaaacaagtcttaagacattcagaaaattgaaataatatcaagtatcttctctgaccacaattgaatgaaactaaaaatcagtaacaagagaaaatttggaaactatacaaacacatgtaaattaaacaatatgctcctgaatgaccaatgggtcaatgaagagattaagaagcaaattgaaaaatgtcttgaaacaaatgataatggaaacacaacctataacaaaaccaatgggatacagcaaaaggagtactaaaagggaagtttataactaaaagtgcttacatcagtaaagaagaaaaacttcaaataaacaacctattatgcaacctacaagagcaagagtaaaccaaacccaaagttagtaggagaaaggaaataaagatcagagcagaaataaatgaaattgaaacaaagaaaatacaaaagattaacaaggccaggcactgtggctcacgcctgtaatcccagcactttgggaggctgaggcaggcggatcatgaggtcaggagaccgagaccatcctggctaacatgatgaaaccctgtctctactaaaaaatacaaaaaaaaatagctgggcgtggtggcaggcgcctgtagtcccagctactcgggaagctgaggcaggagaatggcgtgaacccgggaggcggagcttgcagtgagcccagatcacaccactgcactccagcctgggcaacagagtgagactctgtctcaaaaaagaaaaaaaaaaaagataaacaaaagaaaaagttgttttttgaaaagataaacaaaaatgacaaacttagccagactaagaaaaaaggagagaagacccaaataaataaaatcagagatgaaaaaggagacattaaaactgatactacagaaattcaaaggatcattagaggctactgtgagaaactatataccaataaattggaaaacctagaagaaatggataaattcctatatacatacaacctaccaacattgaaccatgaagaaatccaaaacctgaacagaccaataacaagtaatgagattgaagccataaaaaaaattatcccagcaaagaaaaacctgaaacctgatggctttactgttgaattctaccaaacaatgaaagaagaactaataccaatcctgctcaaactattccaaaaagtagaggaggaacaaatacttctaaactcattctatgaggccagtgttatcctaataccaaaaccagacaaaaaatgcatttaaaaaagaaaactacaggccaccatccctaatgaacattgatggaaaaatccttgacaaaatactagcaaaccgaattcaacaacacattaaaaagatcatccatcatgaccaagtgagatttatctcagggatgcaaggatggttcctcctatatttagaacacaacaaagatgctcattttcaccactgttattcaacatagtactgaaagtcctagctacagcaatcagagaagagagaaataaagagcatccaaattgggaaggaagaagtcaagttatgcttgtttgcagatgatatgatcttatatttggaaaaacctagagtccccataaaaaaactattagaactgataaacaaattcagtcaagttgcagaatacaaaataaaatacaaaaatcagcagcatttctatatgccaactgcaaacaatctgaaaaagaaattgagaaaataatcccatttacaatagctacaaataaaattaaatacctaggaattaaccagagaagtgaaagatctctacaaagaaaactatgaaacactgatgaaagatattaaagaggatacaaaaaaaggaaagatatttcatgttcatggattagaataatcattattgttaaaatttccatatttctcaaagcaatctacaaattcagagcaattcctaacaaaaataccaatgacattcttcacataaatggaaaaaacagtgctaaaatttatatggaaccagaaaatacccagaagagccaaagctatcctaagcaaaaagagaaaaactggagaaatcacattacctgacttcaaattatactacagagatatagtaaccaaaacaaaatggtactggcataaaaacatatactgaccaatgggacagaagagagaaaccagaaacaaatccgtacatccacagtgaactcattttcgacaaaagtaccaagaacatgcaacgaggaaaggacagtctcttcaataaaaggtgctggagaaactggatatccatatgaagaagaatgaaattagacccctatcccttgccatatggaaaaaaatcaaatcaaaatgggattaaaaagttaaatctaatacctcaatctatgaaactactacaagaaaacatgagggaaattctccagggcaaggatttcgtgagtaatatcccacaagcacagtcaaccaaggcaaaaacgaacaaatgggatcacatcacgtgaaaaagcttctgcacagcaaaggaaacaatcaacaaaatgaagagacaacccacagaatgggagaaaatatttgcaaattatccatctgacaagagattaataaccagaatatataaggagctctcatgactgtataagaaaaaataaaataatccaattttaaaacgggcaaaaaatctaaatagatatttctcaaaagatgacattacaaaccacaaacaggcatatgaaaaggtgctcaatataattaatcatcagagatatgcaaatcaaactgcaatgagatatcatctcactccagtaaatgacaggcactaacaaatgctgtcaaggatttggagacaggcaataacaaatgctggcaaggatttggagaaaaggacaggcaataacaaattctggcaaggatttggagaaaaaggaaccattgtacactgttggtgggaatgtaaattagtataatttagccactatggagaagagcttggaggtttctcataaaactaaaaatagagctaccatgtgatccagcaatcccactgctaggtatattcccaaaagaaaggaaatcagtatatcaaagagatatctgcactctcatgtttattgcagcactatacacaatggccaagatttggaagtaacccaagcatccatcaacagacagataaagaaaatgtggcatatatacacaatggagtactattcagccattaaaaagaatgagaacctgtcatttgcagcaacatggatgcaagcggagctcattttgttgagtaaaataagccaggcacagaaagacaaacttcacatggtctcatttatttgtggaaactaagaattaacagttaaggattaagaaaatgtggcacatatacaccatggaatactatgcagccacaaaacaggatgagttcgtgtcctttgtagggacatggatgaagctggaaaccatcattctcagcaaactatcgcaaggacagaaaatcaaacaccacatgttctcattcataggtgggaattgaacaatgagaacacttggacacaggatggggaacatcacatactggggcctgtcatgggggggggggagaggggagggatagcattaggagaaatacctaatgtagatgatgagttaatgggtgcagcacaccaacatggcacatgtatacatatataacaaacctgcacattgtgcacatgtaccctagaacttaaagtataataattaaaaaaaattaacagttaaactcacaaagatagagagtagaatgatgggtaccagagtatgagaagggtagtggagagagtgagcagagagggaagcggagatggttaatggacaccaaaaaaaaaccagaaagagtgaataacgtctagtatttgaaagtacaaaagtgtgactatagtcagtaataatttaattgtacattttaaaataattaagagtataattggattatttgtaacacaaaggataaatgcttgaggtgatggataccccttttaccctgatatcatcattacatatcgcatgccagtatcaaaatatcccacataactcataaatatatatacctactgtgtacccacaaaaattaaaaattattaataaattattagtttgatttaaaaaaaacaaggatgctcacttttgccacttctattcaatatagtagtggaagtccatgccagagcagttagacaagagaaagaaataaaaggcatccaaataagaaaggaagaaaggaaatttttgctgtttgctgacaacataatcttatatatagaaaaccctaaagattccagaaaaaaactgctagaactaataaattcagtacagttacaggagacacaatcaacaccacaaaaatcactagcatttctatacattaacaacaaactttccaaaaaagaaatcaagagagcaatcccatttacagtagctacaaaaattaaaatacttaggaataaatttaaccaaggagctgaaagacctgtacacagtagtctataaaatattaaaaaaataaattgaagaagtcactaatcctttttaaatccaccatgccccagtccagctgaacaactcatacttttcagaatctactctatgtgttctcactgttctgcagctagccacctctttctcctccctagatcaccttctttatcatttctgcttctcaaaatgttacccctctttcaaagcccaggtatgatgacatctccctagtaaagctccctcaacacctcaagcttataataactaatctcttccttgaattcccatagcaggttatttgtacctccattataatacctctctcatcctgttttgcattttaattattcatgtgtggcatgtttctcttattaggccataaatatcttaggacaagaactatgccctcatttttgttccactacaaatcttaacacataccttgcacacaccagaccttcaggaaatgcctgctaaggtaacgaagggacagcctaaattaacataaattattatttgtgtactgatccagtcctaaatccatggtgctatcatttctgtatcactgatggttatccacttacttaaataatctttccttaaatacacttagaaaagacggaaaactgtgttataagggaggaacaagtatgtaggttattcctttccttaaacaaagagaagttctgtcatgcgtcatggaaaattaaagcacagtaataaaaagcacgaacaagatttgttgaataatgatttagtggaaacgttgcttgcctcctgttcataggtcctaactttcctctcaagtacttaagctgcacattctatttattttgtttctagattacattgacaactattggctatggagacaaaactcccctaacttggctgggaagattgctttctgcaggctttgcactccttggcatttctttctttgcacttcctgccgtgagtatctttgcaccaataaagcagtttaaattagatcttagagacttattagagtgagctctcacaaattcgtatgcttgggaacatatctatatcatttacaaatataatttttccgatataatgttgacttttctaaatatatctacttggataatttataaaatatggtcttcccttggagacacttaatctgagactttatttaatgtaggctcatactttgtgaccaaataatcattcagatggctcactttttaggcaacatgctactaagacatttaaaatatttgcaaagatttaaagctatattcttttaaaactgatccttccaatttggtttataatgtgtgctacttaagagacagatgtgcacaatggagtatttttctcttcagatccatttgagtgaaaagcatatgaccttaaagggtgttaaacatgtcagatgatttattcattgtgtcatcatcattgatttttttaatgagcagtttctgtatcttatcagaataaagggcacatttatctgcccccaagcttctgattattttctccttagtgaatgaagcctgcctttctcatacttttattctcttgtgtctttaaaggcagctgttcaaaatattacagtttgcccccatttccaagttcttgcttttgttcgctccatctggggtagggaaggaggagccaataaaaaggagggttaacgcggtgggagcagaagtgcttaaggaaaatagatccagtcttgctccagacacagctcaagctgtgccaaccagagaccccagagcacctctccaaagctcttttaggtggtagggcttctcctctgcctattaataagtgcagagaacacccttgtcccaccagtgcccaacttgagattcaccagatcgttctgccccagaacactcaaaatcacagaaaagagactgaaaaggccatgcatatgcttgggtactagacctcagtttgaatacatctttgtcacatactaactatatgactgctttagtttactagggctgccttaacaagtaccacagactgggtgacttaaacaatagaaaggtattgtctcacagttcccaagactggacgtccaaaatcaaagcattgagaaaccacgagagccatgagagaaagaactgttccaggcctctcttcttggcttatagatggctcttcttcctgtgtcttcacatcatctgtgtccaaatttctacttcctagaagaacaccagtcatatttgattagggtccatcctaatgacctcgttttaacttgattacctctgtaaggaccctattttcaaacaaggtcacattctgaggtcatggggattaggacttcaacatatgaattttggaaggacgcaattcagcctgaacagtgaccctgaataagtttcttttttaatagaatggaggaagaattattgagcccagagaaattttgtgcggaccaatgtaataatgtaagtcaagtgcttgtcatgaagagaactctcaataaatgttacttccctttgcctgtatgaatctagaaatacatgtttcctggaacaaaatgatgaaatccaggagaattaaaaaaaaaaaaatcttacgtatccaaggcaacttcatctggcaatctcaacaattcagaacagagaagagattcactcaataatcagattccctacaggaaaatacctttagaaacaatacaacgcagtcttgggttttttcccaaaataatggcacaaaataattgcagcttttgtgtttatatttatcctgaggccacatgtagagcaacctctatgattcagtgaaaaactatgaacaaggaggtaggcaacctctgggctgttgaaatagacaacaggctatgttctgtcctcataggagagccacttgagacctaattcataacctagtcttcattcagagaaaattctgataaactcacctatatggtttcacaattctttgaagattataaacaacaaatatagaggaagatgatagaacaaacactgcaacagaaagaaatggtaaaagactaacagcaaagaagggaaaaggaaatctgtgagtagcaagcagacatcagtgttcaaaatgtgtatcctgtcagtaaaaataaaattaaattaaaagggaaaacaaaatgtatgaagatctagggccaattagtgttagggtcaacaaacctctggaagttggctgcacccagcacagcaaaaaggcagtccccataatgaaactctaaactatcacagggaggttaaatatgtcactaggttaagttaaaggtcagagactaagtagtcattcttggaaatgtttccaataaagtaagtatgaaatttttatatgcaaattaaattaacctatgttggaaatctgaaaattttgctttcacagaaaattacatttcttaagaaccccaagaaaagtaacctctactaaggatcttttactgaaacttcacaatattttctgagtccttatttattaaatgaaagactgaatggtccatatatacctttagaaaaaaacaagattgccagagattttattatatcctgtgtatctgccaaccaaaagagttgtctgattgaaatttaggaagacacattgacattttgctgagaaagctagaggtggattgtgggctgcccctatgtagggttcctcccacccaggacacctgagaaccaagaaagaaaagagcctttctccatcttaccctcaaagcagaagggccatcctgcacatcacagagtcatacaagccacccatccaaagcgccactgtggggtcacttcccctggtgcccgctccatctctgggctaatgagctcacagaagaagccccagctcccctgtgttaccctgatatgcaggtctttctcctttttagagtgctcccttgtcttctgctagatattcctgctaagagtattttcattgatgaagaaattgagttttatagagactgaattccttgagacctccagctagtaaattcagtgcaagaactagtgctgtttgactcacgatattaaccattccattaaaaatattggccactgtaatccttaacaatattaactaaatgtaattattgcatataataacatgttaaaaaccgtttaaaaaaacagggcatcttgctgggcgtggtgattcacgcctgtaatcccagcactttgggaggccgaggcggtcggatcacaaggtgaggagatcgagaccatcctgcctaacatggtgaaaccatatatctactaaaaaatacaaaaaatcagccaggcgtggtggcgggcacctgtaatcccagctactcgggaggctgaggcaggagaatgatgtaaacccaggaggcggaacttgcagtgagccgagatcgctccactgcactccagcctgggcaacagagcaagactccatctcaaaaaaaataaaaaataaaaaaaataggatgtctttcagcattgcctatttgctatgtgtgggttacaaattaggttcatttaatccagaagataatgaagggtaaatttctttacatttattggtgtcagtatttgaagggatgacatatatgttcaaagcttaagccatgttttatgtgtgtatatacaaatataatagaccttattttcacagacttctgtttaggtgcaccaagctgtgtactaagagagaggtggaaaaaaattggaaaggagccatgatgagacaataagcagacctggtttaataactgctgtaatgtacagtctggcacaagaaatacgtagtgaacatttaccattcactaatatatgtttccgagcaatgccaatgtgattttcagcacattttagattgtttggcagatgataaatttgtgctatgtagggcctgtctttattttccaaaggggattaaactccgaacctcacatccacatcataagtgctcaaaatggtagctagtgctgttaattcaatgtctgcaaaatctaaattatgctccatacaagtggattatacacatatatgcacataaatgcatgtatatatactacatattataaatatatgccagaaattttggtatttcatattctcttacatgtctacactttatgaaaagtagtattaaagggaaaataaagaaatctttcctaaatgatcttacacagcagaaaaaaattagaagttacaaatgacttaagttgttctggatttagaaatggaggggcatttttataacacctaaatggagggaaatgttgtttaaatctataaaccagatcacagagaccaggtttttataaagcttagtttgtacaatcacaacctgtatgagatagagatcttagacagcgtaagacagtcactgaaaaggagagatggaaaacagaacctatgatgtaatttctaatttcatagtacagtcatttatactaattaataatggagtagatcattgctcacgaatagcaaatagtattatcagaccactgcgtattttaaacatgattgcattacttattgtctggttattgtcactgatgtactcagaagtgtggaatctcaagataagaaggaaggttaaaggttatctagagcccaaaaatatctcagccaagttgttattcagttgagacttaacaccttctagaaatgaaaaacccaccacctctccagacagcctatagcatctttgaaccatctttgagctactctaaaaataaaaagaaaagaaaagcaaccattccttacctgtagcaaatactgacttagtgcttataaaatgtccatctctaaccaaagggttagactccttgaagtttaataaaaaactaataatttatagctagcaagtaaaatccacagacttgaaagcagcagagctcccagccccatgctaataaactcaagagttaaagacaaagcccagagactgaatttagcaagctccaaaagccaacccaaggctgagacaaagcatcttgtttttacaaatgttagtagaccagagcaaattgaaaagagtgggggacatcaaagaaccagaattttggcagatcaagatgataagcagaagaaaagcaaactggcccaaaactaatgtaaacctagaagggaatactaatcttactaatcccaaaaactgaataggtgagccaaaataaaaaaggcaaggaatggtaaaagtgtgaattaaaatgggaatgtgctttgcaatgatccacgttcttgtctctagtgtacaaatgggcaaaatagaaaaccttctactctatatcttcaaaactgagtatccctgctctccattttacttttcttttagtaggtgtacagttataacattataaagaactacagctgggacagattttatacagtcctctctcctccatttcatgaatagagaatctaactttcagagtctcatcaaagtgctagaagtattcccatgttcacagcagtgagactttaactccctcagatttaaaatccagctctgtcccaagttgaaattcatgttctctacattccatcactggatgagaccattcaatctaacttaggcaaaaagaaatgtcacagagaaggccacacacacacaaaaaaattttattgtgattttatttataatcatggtgcctatgctataccacaaaagataataaatgacaatgcctaattgacttactaaagaacagaagttgtatctcctggcagtattgcccaacaatttgccattggctattggtattataatggagataaatactgcttattttaataagtaacatgtttatggacaggttacataccgtttgtcttctctcagactcattttagtgactttttaatatttgtattatttaacagtgcttttgaaatttttgagtgccatttttgtattttgttccagggcattcttggctcaggttttgcattaaaagtacaagaacaacaccgccagaaacactttgagaaaagaaggaacccagctgccaacctcattcaggtaaatgtcaatgtaataggtagatggcaacatttgtgtccatagtgcttgatgggtcattttccaatctctgtgcttcattgcttggtagaactactgctttgttcctttttataaaatgaagtcagaacttaatgtacagtcttggatttggacagtcttggatttgttcctcctctcccaaactgaaacacatgtatttttagcaaatggtccatgcattgttcagactaagtaaccatgtcagcaaggccatgcaaaggttagcagttgtgtggctcgtggaattatctaatatgtcttatgaattacttgatgaaacgtaattgatcattaagtgatggagcagaacagggcattgttccctgcattccaattactttctccagccagatgtatgttgctgttttaaagaacaacatatttgtttagaatgtcaaggtttaatacctgtgaaattgcttttagtgccatctagggcagttagcggaaatagctatcctattttgagagctgatgggactatggaatacatcagtgtttgagaatattaaacaataagtatataatttgaagctagctcctaatacataggttgttatttagtatttcattttcttttcactaactcaggattagcttcagcactaaaaggaatgcttctccttttgccatccatatattttccatcctagatccaggttaagaatcacaaaatatattttttgttagattcataatgtagagttgacatttagttatggacaaaataattctacaatctaaagtttctcccctcctgctagggaagtggaagctaccgaatttctaaactggagggtcttgaagtggtgctccaaggccctaggaaacttgccttaaagctgcagtaacgggcacactgttttgttgctgttgttgttttgttttattttttgtttgttttgtttttttttttttgagacagagtcccgctttgtcgcccaggctggagtgcagtggtgcgatctcggctcactgcaagctccgcctcctgggttcacgccattctcctgcctcagcctcccgagtagctgggactacaggcacccgccaccgcgcccggctaattttttgtatttttagtagagacagggtttcaccgtgttagccaggatggtctccatctctcaacctcgtgatccgcccacctcggcctcccaaagtgctgggattacaggcatgagccacggctcccggccacaagcacactgttttaatttagattgtaggtttgggtgggtgggttggtgggagataaccaccacaacccctacctttagtgtttatctgtgactgtgatatatgcagtgcctcccacagacatggagctggggaaagaagggggcagtatggttcagttatatcatgaaggagatctgtttatatctaatcattaaatgaggatattaatttttaaatcaagctattctgcaactgttgacaagaaagtagaccatcaggcatgacttccagtgcaaatcactgagaatctctatttttttacattattttttacaattttttttttttacatattctttacaggttttaaaaggtcactaaagagaaagtaaactctattttcttatatgaagttggagtttaagatctgatgccaaacaataatcagcagaatgaaaagaggagtcacacactttaggacacacgcaaaataccccaaggtccagaattcataggctttcatcctttagcactccttaactggttacacatgttccaatacttctaataagtttttctctttactgttcttatcctttaattttccttcactctagaacaacgttttccaacctgtgagtgcagaagttattgcatgggttcctttcatccgtctgagcaccaagctctgtctacatatggaaccaataatacattttacacaataaaacctcttggaatatcagctgttttgttagaaagtgagctctttgaggaatttctcatgcacatatcaattgtgatgatacaaagctgtgccgctcaatacagtaaccactagctacatgtagctttttacatttaaattaattaaaattaaaaaccaagtttgccaatggcactagccacttctcaagtgttcaatagctacaggtggctatcggctgccataccatacaaaagaaatatagagaataactgcaggaaatctcctgatctaacttgtcattattgactactaaactgtgcaacaataatttccaattgaacttgaaaataaattgttatttctacagcaaatcattggagcagaggcatttatatgtctacagtcaaaatgaggcaaggcctccctcacaggtaaccctgtggaggacaggctaattgaacagttttacctggaggcctagaattttattttatggaactgggttatgtaacatatattgtgatcagtaattgaacttgtacaaatgcaggtaacaatgaagtaaaatcgtgagtttttattttacttaaaactccaacttaaatgttgttcttaacaaaaataatgcaaaatggaatgcttgaagcattcaagagtacttttaaaatctaatcatagtttcattaatcaaagtagaatctactaattttaaaagcaagtgctccttcatttaaatgcaattaatttattacacatagaaataataatataattattaatttgttcattgttcttccttgctatagtctttagacagaattcaaggctttaagccttgattatatattatagaaatttatatttcaggatgtaatagattgaaaagcaaacttcatttaatcatcctttcaccttcttacccaataaacctgacttggtctgctgaacacacaaaccatcaagcccaaaagcgtctcatttattttaggccagagtcactatcttcttaaaagggcaactgagatgcccaaattgcttcatcatttggttggtgagagaactaaattaaccaacatttcagggttttaggaaaaaaatttaaaaccccagaagcttgcagcaaatttagctgtgtcaatatctttgcatgattcttttaaatttgcttttcatttcaagctggagcagtctggaaaaagaaattagctctcagtaatgttttgaatacctgcccaaatgtcacaacttttattaataatgcttaagactcatgaagtgctttttagtttgcagggtgcttctaatacattatgttacttgatcctcgagacaagcctaggaggagctaggactcaaatccctgctgtctgaatctgaatccattacccctttcaaaaagcagcatttacatcctcataaatatatgctttattagaaacagaaacagggaattaagtaaaagtttgtgaaataaatgttggtagggatagattagaagatgttgctttgatgccaactgacccaaaagaaaaatatatatatttgtcttgaaactttggcttcccctagtaaaatgacttagtctccacccaattaccctaaagcgaagccactagtcattaagctcaagccacttatatagagattttacatctttttagtgctccagtcataaataaaaacagtgccaggtgtggtgactcatgcccgtaatcccagcattttgagagggcaaggtgggaggattgcttgagttcaagatcagtctgggcaatatagtgagaccacatttctttaataaataaataaataagaacagactcagaaaaaaaaatcttagatgtgaaaaacatgaaggcaggaaaaaaaacagaaggtaagataaagttgtgaaaatttccctgaaactagaataaacagagattgaaaataaagcaaaaaagataagaaacatgaagtgtccatccaggcattccaatatccagctaataaagatgtctcagctcaagtgcagggaaactaagaggaagattttatcaaagaaatacaacattatgattctccagaacaggaggacaggagtggccacagtagaagagctcaccaagtgtccagcactgtgaaccaaaaacttcacaccaagattatcacagtaaaatatcagaaaacttaccaaaaggggatcctaaatgctttctgagcaggacagagccaaaggaacaagaataaggatgacataggatttctcattagtaatccaaaaattagaagacaatgaaacaatactttcgaaattatagaaattattttcaacctagaactctatatccagccaaaccaccatcaagtgtgagagcagcaccaaggcacttttaggcatgcaagatctcaaaaattaatctaccatttacctttactcaagaaactttgtaaatagaacttctcttccacaacaaggggataagccaagagagaaagagacatggagtcaagaaaacaagagattccgcacaggaaagagcaaaggggatttctatgataatagggaagggaagtcccaagacaacagctatgcaggccttgagaacagaatgagaaggaggctgagagctccaggagaaagatcttcaaggaagcgaaagaatggagttctcagatttcatgatgcatttgaccagaggaattttatagttctgttggaaagatctggaatgtaatcataacaggtacatatatgcaaatcaagaaattaaaatagggcaattataactccaaaaaaaccaaaaacttgtataagaaagaaagagcagccatagtacatcacattgctgaactgggaacagcagttacattgtcataataatattaaatagtaacttagctaagaattgtgatattaaaatgttgataggatgaaaggaggggaagagggcatgtaagtgggcaatatcattatcgttcaggataggaagttaattgataatgtctaaaattgaaaaatcaagaaatataactataagcataatccttaaaaataagcattcttggctggacgcaagtggctcatgcctgcaacccccgcactttgagaggctaaggtgggaggatcacttgaggccaggagttcaagaccaacctgtgcaacatagcgagaccccacctctacaaaaaaattttaaaaagtcaagtgcaatggcacacacctgtagtcctcacacacctgtagctactcaggaggctgaagccagaggattggttgagcctgggagtttgaagctgctgtgagctataattgtaccactgcactccagcctgggtgatagagtatgaccctgtctcaaaaataataataataataaataaggattcttaaaaatagaagcaacaactataagaattgaaggggttgcctctgaggaacagaaagtagtgtgaagaaagatgtggaaagggattgctggttcatagcctaaaactttcaggactttcacattttaaactctgtaccttgaaaaaataagctctgtgttcattattcctttggatggtcagctgaaaccttctaaaccatttccagtaaggatcaaacatgccataatggtaatacttgcaagacaaacaaaatactcccaaaaaaactgaattatactggccttgtacttattgagcaaagtccaaatctctttgactgcctagagcaccagcatcacctgataaatggcaaagttggctctcattttgcttcttgttgatttgtcctttgaattgtatacaccatgtaaattaaccataggaaatccctctaagtgttatttttctcttgccaactactgtgtgattttggctttaaatataggaacatcagctactggatcacagggatgtgggttcaaagttcagctactagaaacaatttgctaagagagacctaagaacaaaataaagttattagagtgtaacgggcatagagttccactttccaccttcatttttactgttaactaatatcagccatgtgacagatgccacctgcaccttccatacctctcatttaaaaggcatttttgggagatgagtaatgaagggaacaagagcttagctgttgggatcaatttgagagaaaaatagcaagacatcaggtctcattgtaaagaaaatctttaattttctcagagtggcctcttttgcccccagttctttataacattcacaggcaatgccttggtcccattcttttgttgttctgttgttttggattttttcactggtatctaataatgtgcagacctgccatatgcttctagttctacaggagtcttgctttcaatgtatcaaaaatcatatatgtgtgacatcttctatggaaattgtttaattaaggcagccgtctgtgtcatcacaacattagaggatctctgggcatcactactacagaagaagctgcaatcctaaatccatgtgttttccttaattattctaaatcactctataaattgtgcaggtataatatttgcaaagattaacatttcaagatgatgcaacaatagttgcattatataagatgtcaagatacttagcacaaatttccacagatttgtagattaaatcagcatgagccatgtaatgaaggcaaggaactttggttcaatcatttaaaccttcctcaaaaatataaaaagtccctcagtttctaccactatatttttctagtttttttatgtcactttctgaaatttcattgaagtacaatgtgcatgcagaaaagagcacatatcttaggagaactgagcacacctgcataaccagcactcagataaacagagcaggacctcctgtgtaccccttcgcaatcactatcccataaggataaccactgtgctaccttctaacagcgtagaatagttttccctggtttttgtacgttatggaaatgtactccttggtgtcttctttttctcactcaacgttattcacatgaagttcatccatgttgttgtgtgtagctatatgtactattgccatatagtattgtactatgtaaatggtgtcacaaattttctgtttattctactgtttctgggtattttggaatttccagctttagtttattagaaaccaacatatagtacatatcttttaatgaacatatataagcatatattttgaaaatatacctaggagtgtgtagttgtatcataggatacttaaatgttcagctttcatagaaacttccagttttcccaagtagttgtgtgaatttttaacttttatttagcatacatttattcaatgatattctcaggaaaaggaatattgttagatcacattttcttcattatggatttcacaatcatgactgatgtgttatgtactagggatgtggcccatttaaatgaattggtctgccaggcatggtggctcatgcctgtaatcccagcactttgggaggccgaggtggcagatcacctgaggtgaggagttcaagatcagcctggccaacatagtgaaaccctgtctctactaaaaatacaaaaattagctggatgtggtggtgcgtgcctgtagtcccagctactcaggaggctgaggcacgagcatcgcttgaacccagaaggcagaggtggcagacagccaagattgtgccactgcactccagcctgggggacagagggagaccctgtctcaaataaataaataataaataaataggtttgtcacataaaataaaatgttttgattaatctactataataaaaaagttttctctgaggggactggagtaaatacctggccattagagatgtttgcagactcattaaaaagaaagaaatttaccaaaatctatatgggaaagtaaggtcgggcaatctctcaaatgagcagttcagatggaagcttttccaataacagtcttcaagcagtcagcaagtctccgtggagggattctatgactgacagccaggcaatctgagatattgtctcaactccaccaactttgtataaacctcttcatttatctgagccctttttttctcacctacaaaacaggaatcttaattcacactttgatggtgaggatcacataaaaatactttgtcttatgtatgccaggtgtaattatatgaaatggagagagttgatgttttacatcaaagagctataaacatattcttagatcatggcataaatccgtaggtgttttgcagctatacacctagagagtacattttccccatcctgttttagttctgcttcttgatatcactatcttcatttttagcattagaagtattacatagttcaaggatttcattaattcaatcactagcataccctggtgttcattagttaactagttagcttactagttgcataatggattttcattagtcctttgcttctcccttatcaaatattgattaaagatcaatctctagaatgtatgctcatgctcaagtcgctcacctaactactatcttggatattagcatttaaccagtcaatcattactttttgttttggataatatagtatctttcccttaccaattcaaaaattacattatattgcactttttgggccttttgcttcttggtatgttgttttgaaaagaagctctggccaggcacagtggttcatacctgtaatcccagcactttgggaggccaaggcaggcggatcacttgaggtcaggaatttgagaccagcctggccagcatggtgaaactccatctctactaaaagtacaaaaaaaaaaaaaatagccaggcatggtggtgggcacctgtagtcccagctactctagaggctgaggcacaagaatcacttgaacccagaaggcagagattgcaatgagctgagatcgcaccactgcactccagcctgggcaacagagtgagagtccatctcaaaataaataaataataaaataaaataaaataaaagaagttctgatgtggtgcaatatgtttaacagccagctgaaaatgccaaagtagccttcttcctcctttgggtatttatcagggctaagtataagaggcaaaagattcttcatgtgtagtaacttaatcatttctctttttattttattctaaatcctgctctcttttttctttttcatgtccccatctatgccacatgcagtgtgtttggcgtagttacgcagctgatgagaaatctgtttccattgcaacctggaagccacacttgaaggccttgcacacctgcagccctaccaagtaggtatcagtgtgacagctgccactgtagttgagtcttttcaagtctgttaaacaaaccatacccacacacacaaaaaaaggtgttaatgtttggcttctcttattctctgttgctcctaaagagattcaaacctatttagtagcagttctggcacaaaactaaatggaatcagtatcattcctcacaatccacagactggggttaaagattaaaataatgtaaattttatagagatttatttttactatttcatgcttactttctaatgtctcatttcgtaaagcccaccagcatcctaaaggtaagcaccacagttcttgaaaaacaaggattatttattttgcacccatcgcctgaccccaagagatgagtgcttagagagtaatccatctttgtacgtttagatctctcaaagccatttctcatctggatcctctctggatggtcctcaagcttttacttgcagatcaaactcacatcagtggcaaaaaaagagaaaaataggagtcctaataggattatagtttacaatgaggcaatgggacccagcggattaaaatttggaatttgcattcacaattttaaagtaagactacttttcttcacatttcattggccaaagtaaatcactcagccatgcctaaactcaaagaaaatggggaagtacaattttaccttttaccatgtgcctagaagcaggcaagaaccaaggacattatggacagtcctaatgattaccacagagatctgtaattaaaaaaaaaaaaaagggcttagtcttggagtcttggaaacctggactccagttcaactatcacagaaaatgttaaatcatattcaccacctaattaaagaagtcctcattgaaataccgaagcagtaagtcatgagaaaggctttctgtgagtcacccagcttgattagcgtagtcagttcctcaggttgttcaaaagttattaaattgctcatccgacatttgagagcaccagctgcttttcttcatagcccaacaaaaccttaatcctagtggcttcatgggattcaggacacctaactactgtgactcacaaaaaaccacctgttcttactgatcttgggagatatcagctgaggaaacctccatgacattccctggcagtaccgtcttaatggaggtttgtgatgcagcagaatgcataccattgggaagcaccagatccatcattaactacattacttccctgttctgcccttggcctcagttttcccacccacaaagagaaggacaagagttgggcaagatgattcctaagctctaatgggaaatgcctcctggtgggtggtatctaaaattcttgtcagcacctaggacagagatattcatagcactccagggatttcagagaggatggaaccttagcatggatagaagcatggatgctgttgaatgcatgtttggattaaaatcctcttttcatttagatcttgaagtttagttgaactttttatggagtttaagaccctttcaacattttgatattaaaaaaccgaaaatagaacctaactcctgtgccatttattccttgggagtatgaaccaaaaataaaaattatatagaaattgtatttcttgtcttcatgaagtttgctaggtaaatgtaaaaagggaatctgagtaggaaaactgatagagaattctcaagtgacagaggagagtggtctattatcatatgtgattatttggcttcccacttactgcagtttttggattaaaagtcattaaaagcctggaaaaactgtttaataatgagtcaaattcccccagtaaatcaactattattttattcacataagttctttctactcctctgatattttccctgtcttaagtgggggtggaggtggaggaggatttatgcaaacacctgtgttcctcatgtcctactgtgcctttccctcactttccttttcctgcaaactcatgaaccatggggctcagctccattgaatgaagaacagttatttgtccagaatgacacagcagtcactggtaaagttcatgggaaactagatgtcctaacatctctccccttccagtgatgcttcattgcttcaaaatgcagaggttcttaatccttgttgatgttttttgttaaaccattgagaatgtgatggaaattatggggtctttcccaagaaagataatcaatgcacgagaaaatcaatactttgcctacaattttaatgtattcacagagtccctgaagccaagttcaaacttttgttttacaaagcaaacttgctttaatcaagtgacaataattttcagtgacttagagggatctttttacatttaagtggcttaccgaatggagagtgttgtagtaagaaacagactacaattactattttatttacattgtgtattttcctttagcattcagcctaagaacttctgatgggaaagatcatttattcagtcatgtatgcattcaacaattactcattgagcacctatgatgtgcaaggcatagttctaggcactgagaatgaagcagttggagtaaaaaaaaaaaaaaagttagaatctctggccttgggaagtatgtattcaagggatgttgggatagacaatataaataaataaatataggatatgttagatggcattaagtgctaaggagaaaagtaaaataaagaaggaatttagggagcatcagaggctataatttcaaataggtggccagggggaagatcaatttatcaacaatatcatcatcatcatcatcaatgttactgttatcattaaaaaacaccagccccatgctcttgttccccagttttaaagacatagtgggatgctttgattccactaaacaggatgaaagagaggtctaagaaacagctgtgcagggcagagagaaatgggaggagggacactcaaacctgccagggatacaaccagcagttccttactctctcttttcaggtctggtttgtctcttacatacactctagaggtcttagcaattctatttcaaagttttattttaataacagaaggatgtatagaagcaagtacttttcttgattttctcctcaaagagagtgaagctgcaaagggcaaaacacaggtaaatatgctatttagggaatgagtcagaaattttatgaggctatggggaattatcaagctccaaaaacaccttgtggtaccttaagaagtggggatttggagattatctaacctaaagcctttgatttactcataagaaaaccaaaacctgcaagcaaataaggtgcctgcccaaaggcacacagctcgtttgcaaagagtacagaccctacaccatggtgcttagacctacatttgctaaaatgagttattacaaatgccacccaacagtataggctaaaagagttttggtaaatattctatgtaccttatttactccaaggaaatttagattttatacgatacaaaaaaaaatctgcctcagcaagtgactgagatacaattcattaatgaatccaggtttagaaaccaaagtctgccagatgcacagagaacagttatgttgtaactagcaacattctaagagcccttgctaattctggttagatcagaaccactttttcttagccatggatagctttggctaatgaaaagtctattgttttttattctatgtgggcagtcttggctttgccaagtaaatgttgtgctatctctggtctgtatcacaaagaatatatgttagcaagttgagtacatttattataaagaacactgcttttgtggatcttgcatgaaaagagttacttaaggtatttgattccccaatctccaatttggccattatcaagtgctataaatatattcactggtttatcatcatttctcttctgcctgcacgcacctgaaggaaagaacaaggggaagcatcaagcaggtttgtgatttctctcttgctacatgtttgtttataaatctgatacctaccaggtgttttaaatgtgtctcatgtgagtaaaatcgatcaacaaatacaagatgattaaaagtgacctttcacaagattgcctgcaaagattgctattttattgatatttcgccccttagtatcaaagtgtctttccctaactcactccctgctttttcaaaatctgcagggcatggaacatttggaggtgggggaggaggggaactgatcttggattagtccttgctgttgttttcccagacagaagtcttatcaaagtattcaaatatggtaatctagagaatgaaagaaagaaattttttttctgaatgtaaaaagtccaggcagcagtctaggatacactccccttcactagggtccttcttttggagtgatatatatatatatatatatatatatatatatatatatatatatacacacacacacatatatatatcatatacatatacacatacatacattatatgtataggtatatatacctatacatataatctttttttttggcaagatgaaaccacctctctgtgacatctccagatctccagcccactgagtgctgaggtctactcaagtgactcaaagagccccatccccatcttttaggaagaagacaaccctcccaaaaattccccaaataatttattatcagtttcccatgacttagatggaatgagtcgtcagattacagcagagaattaaacctagagggaatacgaggtgaaagaaaaatttcttgatctgtgttaatgagtaccaggaagtgcctagatttgagagcaaagccctgaaaaacagagccaggtggaacccagtattaatgatgtgaagagtggcagaggcagaaccagcaaggagaatcccaggtgcctggaaaggaagaagagatacattttttttcctatcattgtcactgtgtttccataaagaaatgaaggcatccacctacccagagttggtccctaagtggaggccagtgtgggcccagggattgttcttttagcttagtactattataataattatattaataataatatatttatgcaatactgaagccagttttgaaagttcacttggtgtattaaggctctggattatccatttttgcattatgtttatatgtaaagataaacaaatgaaaacataaatgcattcgtctatgatgggagataggcacgataggatatacaacatcaggcacatcttctgcgtaggtaacctacccaagggatggcattaaagttctttctcttatttggtagctctaactaccaaataagccaagggctttggatattccttggagatatttccagaaaaaagtcattcttccccacctaagaaacgtttttgaccaaagagaggttctagtcattagattcggaatagtctttgcctagacactggaagagacaagctgaccaattctagacttttagtccattttctagattccatacagagctcaccatccttctgttgtgacaattttacttgaaaaaagttacacaaaataaatcatagccattttaaggtagcttatagttgctttggtgatattttaaaagctttcattgtctcaggagctttccatttactaattatctcaaagggtgatctgcctccaaatccaaaggacagagaccatctttggcacaaattccagagctacctgagagtgcgatcacccatcttagattcatcctccaaaacggagctgttaacacctaaaagagaagtttgtaaatgacatggaggtgcttgaataagtgtaaactctatggcaatcctgaaggaggggtcaccttgggctggcacaatgatattgtactgtttttaaatgttagcacagcagaaaacaaagacaaaattaaagtgtcactgttgagcttctgctcactagtccaaaaacaagcttcctattcagttatcactattcaaaaaaactaccaaccaaattttccacatttatgatgttcgcatatatctacgacatttacctctctgcatgcagcagactgaggttgtcaaagataactcacccataggtttaaatatgtacaaaaccactgaagtgggttgatgacttagagaatcacacatggaaatttcttgcttctctgtggtcattgaacatttggcaaaaaccaccttgaaataagtcctgcactattacttagcctagattcattatttaatatcttatatttcatacacttaggtgtcctatcttccaactagctgtcacatcaccctgggtaaagctattacagaatgtgctcaataaataattcttggatagagtaataaaatggccctgacctcaagtagtttgtgggaagagataaaacaccaacaaaaaatgggaagagaggagaaatataaaaagagaaataaaaaattaaaaacattgcaataatctaaggaaagtaagctgaagctcccatttaatattatgtaagctttcaccttgttgtgctccatacacagaatttataatcctgcataatgaatgcagaaaggctattgtaataacaatagcaacagtaccatcttagaaagtaacaaagttgtccttacccaagcaaaatatcacaaagtaaaatgcatttataatgagagttcttccttacagaagagtagatctgggtccagagtattgttaattaatgcttgaccccatttcaaaggaactaattaacaccacccaactgcagagtaatttactgcctttgggaccactgagttattgatggtgagtcagaaaggcagaggagacaagcttcagcccaagcaggagccaacattttcaccttttagcccagagcttggaatctcctaagtccttcttcatggtttttctttgtgttacaaactgagagaaacccaagtgtagatgaactcaacacagcagccaacatccgcctctgggtgcctggcactctcaccaaaggacggagccatgactgtagagtgggtcatacacagagaggcttttctttctgcaacattgattaagatgtcgaacacatttatagaacccttagttaactacattcccggctttggaatgttcttgttaaaaagggattttgtctttctacactgaggctagggtatgtttaaacaaaatttgcctacgatgtcttgggctaaggaaaaatgtcacattatttatgacagatccaaaacttttctttaaaaatacaatggccaagtgcagtgcctcatgcctataatcccagcactttgggaggccaaagagagtggatcacctgaggtcaggagttcgagaccagcctggccaacatattgtgaaaccccctctattttaaaaatacaaaaattagttgggcgtggtgctgcatgcctgtagtcccagctacctgggaagctgaggcaggagaatcacttgaacctgggaagcagaggttgcagtgagctgagatcacaccactgcactccagcctggatgacagagcaagactccatctcaaaaaataaaaaataaaataaaatacaagccattaatctgaagaagagctttttaaatatagctcaactgagcaatagtgaaaatactgtttcatcagttctttttggtacattcaggtacaaattactgttagtctcaactgagcctgctgttttttcctctactccaatcataaaatacttctttagcatcatttaatcactcatttcttttcctctgaattcccactaaaacagtactaatctcatatatgtggtggtaaatgtgtttattgatttcattctattaaaaaattagttggaaaagtcatttttaaaatgggacaagtttttttctgttttgatataaattgtcattttcagagaactgaatttacctgtgaatccatctgtccagaataagccaatattctcaccttgaggttttatgtggttctcccttcctccttgaccagattatcaaatagtagtcagtcatcacattgatacaagaaggcttttccttctatctacctaagttttattgctacaaaaacagattatattatctgaggttttgagattatctatacatcttgctgcctctagttactctgtcttcttaatcaacaatggttggctatatgcctgcttgatacttaagcttccttaatggcaattttaaaagctttgctagaaccctttcagatttctgagtagactaaagttgctttaccaggtacctgtgagactgttgtaaagatgcatgtcttaaacgttaaggcaaaaatgatatttttatattacattacactcttgtgctgtgagccaccgagtgctttttctgaaccactcctgtgtggttggcttttgggggaagggggagttctgaagctgtgtgtggctcttggagagaactctagaaccctggtggaagactgtgtgctcttatattttttctgcatttattttctgttatttcaattttctttcttctgtgtgcaatgaatgatctgcatgtgttgttaaactaaactcaataagactagattttggtttttttccaacatagtcaacttgtgtccttattggcaaaatgttccattgtttcaaaaacaatctttccaaaatggtctctccttctgttcacatttattgatagaggaaacggatttagtcttctaacaacacatcataggacttaaaataagaaacgtacttttctttcgtttcttacaaaccagcaatctagaatcttttcttctgttttgttgaacatatattctgacaattggttacctatatcaactataaatgcagatgtttcacacaaaccaagaacttacgttttcaaatttcaacaattaatgtcatgaatttattgatttctgtagttattctttgaagttctaaagtacgttattaatcatttatactatgtgttattgatatttattacaggggtagctatattctaaagtatttattcttacatgctaacacagagactatcatcatttgtatgtaatgcctagttcaaatccaatttttcaacctagccgttaagatcactggatatctttcaagcagcacaattaaacaacatagtactctctgcttaaatagtctgtgtacttctatattaaaaacaataaagccaaatggctttgtttttataaaagaatccctgagcactttcctattcgtgaaatgcttagtaatgtgctgctctatttccctcactcctagtaagttctgtagtaataagcagaagctcttcagaatgtacacctcacggaagcagaggtacccagcatccgggctattgacatgagatttgagaatgccaactaacctcaggtgcatgaccaggttacaccgccaccccacctgagccctgttcagagactcactctttctagggacttcttgaatgaggttttcaacccgcttgaaattttccttgttgcctgttgcctgctttgatactctccaccgctgggacaaatagtcggcgtcccgcgtagaactggcagtcagccctttggcgcctccttgtggttggacaactgctgagctgctgcacgcactggattgttatggctcagttgccatattgtgcctgaggcgagaatttgtagaatgcttatcccatgaagggctaaaaccctaattaagtataacaataactacagcattctaagtcccagaggattactgtggggttatgatgatgccacacagttgcctggcagagaacagccggtagtagactgcatgctaggccatttgaataacctgtacatctggttcctagagatgagagaattctctcttgcagggtgacagtgcaggctctgctgagcatggtcctcagctgtaactgtgggactgtaccctaagagagatgctccgatcaatgaccacagcaattttttttttactttctgcaaagcaagacctccttgttggtctcttggggataatccttggcattcttcctaaaaatactgttacataaatcttcaaaaatcatattcgtagatgtcaccaaaaaaaaggcaggaaaataatgaagacttcagtgtttcagtgaagagtctatatttttaatcaattcaatgtgtgttttcagtaacagtcacctgatcagcttaatagtcatctaatcaagacgctgtgttgattttcaaagggaaacaaagtagaaaaataataaagtgagctttttgtaagaggacacaagaacagatctttgccttggaaaagaaaattttgcctggttaaaaagttcttgattagaatcttattcttaactttcatataattatgtcaaaagagaaagtgaaaacattacattttttctaatttaacatgtaatatgccgagtttattttaaaataattcttgggaatctttaaaataatagacattagcaaatatccatgtagttgagaaggacaaaagggaaatgttacttagaatttatttttgtcaactttaagtgctttaaatgatactaagatttagagaatattattcacattttccaatttattcataaggtaatgtcaaaatggttcatagaggcaatttttaaaaatatttttataggtatgatttttaaaatacttttattataaacaaactatggtggattgaatgctaatactttcattttggatgtttttacttttttagtaattgaatttttttaatttttcatattaagtgtttttatgatggtttatccatttcttatgtatttagttgacatagaaaagagatatatcttgaaagttggagaaaataatttgatattaactaaaaccaaccttttatagtaattagcatctgttagttccagaaaaggtaatagataaaatcaaatatagtgaggaccaattgtaatgatatctatgtcaacttgagctattcattaatctgaataaaggtgcagaagtgagcatatgcttcctgaactagatcattgtaaatttaaattatggaacagatgtgttgaaactaaaaagagatttgaaacttttacaatttaaaaaaaaaaaaagcttgagaaaagtagatatttttgggcaccatccctttgacagatttgtttaaataattgaaggctttgggatgacatggaaaacctagcctgagaattaaaagatgcaggtttatgatgttattgttgctcttgtttaatgtaatctatcatttaatcacacatgtgtcaagcacagataaactcttccactgttgggattgttgtaaagaactcttgaacccacctgacctcatcaccaaactgccccgcctgttctttgcatgtgccttcagcgagtcatgctggacttagctgtgtctgcatttcagaggggagctgtcagttgcatggtcaacttgtttattgtttccagaactccctgaccaccagttcatgatttgatttgttttcatgtaaacacacataaaacgtggtgcccttttagaatatcgtttgttaagcaactaggcatggaaaaataaatgttactgtttcttgttagctacaaagcacatatccactaaacacatttgctgttggcatgctgcagttggggacagtggacattgcggtaagtggacaaaacaaggcctccacttcgtctcaaataagccttatccatgagaacgctgctttcataccccacaaaggctgcggctttactctctcagagtagctgctctgagagacttccctcagactcattgcccaggatttcttcaggccctgcagagtcctgggcctctcacattgatgacagtatcaccttctaatgaatggcataatttcactataaaggaaacaagaaaaaaaaacagaatgggtacacaaagcttcttacagttcatttgattcccacaagaatcccttagctgtgttgctatgtttatctccaagttagagatgagaaccctagcccccgtgtgtctgatcccaacctgcccttcctagcacatcatagcatatctcttgattaggaaagtgtgaagatgcactttggattttatgattgttgttaatgcttcttttatcagcccacaacaatttgatcttagccggcatcagagaactgaatgcctgaacaaatataatttaccagtagctgccacagcaaatcaataacctgtttactagcaggaaattgtgttagtgaacataacatctcattctcttcatcagtcatcacattcattatctgttggggctgttctatcttgtgtggttttcatctcacaagaatgaatgtaagcataaaagaaatctaatgttaagtgttgtgtgtttaatattatgtatgtggtgctaccaactgctatgagattgcatgaatttatggataacataatcttgcctggaatataaaatgcatgccaaatgtaggtatatatgtaactgtcatccctgtttacctgtagaaatgtctagaaattacaaagagatatgctcccaaacaaaaaataattttttaaatctcaaaagttgaggttaaagctaaaattacccaactgtttttcaagtgaattccaaaacagttcttagttatctacagtgtaattgtgtacaaaatgctgtatgacctcagtcttttctacaatgaatccaagaaggatgtatgtacctgtagaatgagattgatctcgaatgcaaatatagagattagataaagctcaaattttaaataagggaaaaataattgctatgctcctacgtgctgaaaacatcttgtctattgaaatatatgaccacatgagcttcatcaaattacttacccaagcaaagtggaagaaattgcttgaaatggaataatcatgcctctgttctccacagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatggtaagccctgtttttccataaccatttttaattggataggctatagtgagtgagattatgaagtaattaattctccatagtgccacttgaagaaagaagaaaacaaccccagagaaagaattgtttgtttgttttattggaagtttattcattgccttgggcaaatgtacagaacataagtttacttttggaaaccactttggcagctaaatttacattccaaagaagctgacaaaatgttgttaattcttcacttgtatctacaaatttatttctcagacaagggccacattaagatcaatgggactgtcattctgatgtatttgtgacgtctgaccagcaaaggtccaagacccagggacaaccaggtgcttgctctgtgaatatcttgaaacacagtaaggaggatgatcatttctggtcaacaatgaaggtgctctttccctctctcacacactccatctaccagcaaatcagagaccactgcttatcttccttagagaggttcctgttgaaagttatttcgaagtcttccaatgataagtaaaattcaagttcttctcccaagaggaattaacctattttatttatcatattatgtagcagacattcacttgccaacacattttattgagtgccacataattttcatgtttataaaataaaatattttatttttcatttaagataagcttggctttccttttaactaggccccctgggatctcttatactgggcaaggaaccaaaatcaaatagcatttcccattaatgcataaaaactacaaaggctatcagtccttctgttcccttttcctaaataacgtgtattttcccaggccctcaaagctcgaggaataaaattaacaaccaggggtcataatcacaatgatctgaggatccctgcagtgaagtccctggaaccgcagtccacgggtccctctcagcttactcaaaggtcctcagggatatctcttccacgctcaagtgagcaacacaagtcacctcttcacgcctcactccacacccctgtgggtgccatgctcttcagggcgacccctagtggctgcactgacgtggctcctcctggcggagcttgcaggtcccatatgggcgcaagacggctgatcctgccatgcttccccgcagcctgtcctgtgctaaggaaggaaaaacctccgccaccaacacgggacactcctccatcgagccacttgcaggatctgagtcacttgtggcacagcttttcagtgtcctctagtttcctcactctcctcctaggattttggctgaaagcccttgagcagctgagtcaagagttaccagtgacagggctttatgttgcactcaaaataggcttgctgaatataaatgggtacatcctttctggagggcaatttggcaaaatatattaaaagtctttacatatgtctaagcctagacacatcccacctaccaattctatttctaggatataatagatacaatgaaacaatgtcaggcattagaaatgatgctctaaattaaaaattattgacacagaaagatgataacaaaaaaatcattccatttatatatattatataaattcatgtatctataggaacaagtctggaaagatttacaagaatgtgtgaacagttacctttgagtggtgagatcacagttatattttgtttcttcattttttaatctgtatttcctaatatttctacaatgaacaggtaaagctcttgtaataagaaggcaataaaggattttcttttttaaaaaaaaaaaagccctcagtttagaaaaacaaaatgttagggggaaaaaaagaaaaaaaaaactagcccttcaagaaaaaaaattagcccttcctttcacacactgccctctcccctgcccctactctaggggcccttgccctgactgttactcacctaacacctttccttaagctgatttcctcccaagtggtagaaggagcagcttgtcttaatggtgggaaccagtctttgttgagtgcagacatagactatgtaatgatgtttaatagcttctactacaaatggaacttgtattagtttgctcaagctgctataacaaagtactagatgccttaaacaacaaaaatttattttctcacagtctagaggctagaaggccaagtttaaggtgtcagcagggttggttccttctgaaggctttcttcttggctttagatggtcttctccctgagtctttacatagacttttctctgtacccagccatgtgcaaatttcctctacttataaggataccaatcatattggattaggagccactctaataacctcattttaatttaataacatctctaaagaccctatctccaaacagtcgcattcggaggtactaggggttaggaccataacatatgaattttggagggatgcaattcagcccatagacaaagctcatgctcacccacatcacagcatccctggaaagctgagatgtgtccatatcttcatccccggccctggtttcacactgcattagaaatcatacattacatattgcaatggatccatattcttctaacatgtgcttcaaaaagcattcaactttgtagtgtaaggtccttactgttggctgagcatatttaaataaaaaattcatagaatctggatttttaatttggaaaacaaattctacttgtactgtttggccagaggaaaagaatttttcacagtatctagagtcaccactatctatcacaatattttcagtatctgcaaagatgtctcagaggtacagaaacagaagtcctattctctaccaaatcacaaattggagaggtctcctgtcatctattttctaggtcatttcatacgagtacagttttgtttgtttacaaaagaattgcttctcccttgttgatgcccattcaattaattctgagtttcccaagtgaccagaggaccaattgctgttctgttgaaattactttgttggctacccacctgcaagagatagtagctcctgcctcctcatttaatccaatagtccagaatctttacctctgattgaattcaatgttgcgtcttgggaaactggaagttctttttttacaagaaaaaaaattaagtagctgtcaaataaatgtagacttcagttatacatctttacttatagtacctctttaggttttaagtatttctaaaatcatctacttactaccatagaaaataatatataacacttatagccagttttcaattattccaggtctatttgcccattcacttctggggctgttttcttctcctctgctctcctcacatattttcagcattccattgcccattaacatgctcaggagaatagacaaataaaagaaagaataatggaaactcagatcaacctttaagttaataacaaaaagttatatttggaaaataatagacttgcaattgaaagatagtataatagagaaaaaaaaaatattcagggttaatctgtaaattttaataattcctgacaaatctgatactctttactacagacagtagtgttttcataatttaatgactctttaagaaggttattaaatatccatggcatttttctcttgctataatttttaataagattaatatgttacacttaaaaaggacgcagttgtctctcaatattccatacttgtgtgtaccagaaaagtagaaagtagcaggcagatgctgaagccacaaatgacaaacgaaagaaagtaaactctaaaggactgatgtggtgttatcataccaaatttattttgactgctatgatatgaatcatatttttaactgataaattctataataaaagatagaaatactctattcattgacagtatgtaaccctcttcacataattttagaaattaggtaatatagaaatatttttgtcaagtatatgagtaataataatgataaaacgaacatgtattgaattcttcccattggcatgtgttgttctaaattctttacctctattattttatttaattctgtcaatacccctatggagtagctgaggtattatccccattttatggatgaggaaactaagagttgaatctaagtaacttgcccaaggtctagcaggtataagtaaaggagccaccatgcacatgcaggcaattgaatttcacggtcctcctacaaacgtattctaagatgttctcctagatattatatcaatttccctttaagaatctttcatttcttcccctcccccaacccccaccaccctcttcttgccgctgctcttccaacttcaatcggtcagattccccttcccatataagccacttgaccatgaccatgccactatcccatctttctcccagcctcagctgccaaacctctcaactacatcatctcaaggcagccagagctagaagattaggcaaattggggaaatggcctttcaatgaccgttctctgttttgatcaagtatctgggaagagactcaggataacagccatactggtctgtgtctattttccctggagggaggccaatggtagggtcatctgaggcctgtttcaagatgcaaaagatagtgtcagaagatgcacaggtgttgccaacagacaagcaagtggaaggtggcagattgcaagcgagaaatggagcaagcagccaaaatccacaagaatgatactaaggtagagctaggagaaaatcttcggatttctggtgactagtttgctacgaaggagtcctacacttactgaaccccactgcatttgggagtgccttacagaattgcaatcaaagagtacaataacctggacagtgaaggagaaggacgtagctttagggagctccaccttacagtgcttgatattagctaaacccaacgttctgtagtaattagcatgttcgttccagaagtggcaatagatctgaaaatctgtctcacatacatgtataaccatgcatgttttaacaagtctaacattgtttctgcttaaggagaaattaccattcctgctgagcaatcctcagtgctcatgttagctgccatggaaggtacatcctcatcaggtgtttatgggaaaaactggcacagcctgggttcaggagatgtttagggttcaccagggtgggatctgggtgagatgaagatgcagaatatcttccgattgtgggggtccctcaaggctagtgcctttgttccaggcactgatggtaattcctctctcttcactacccttcatgttcctttctcctctcagccagtgtaccaattaggatgcatttagcagcaggtcacaaaagaagcagattcaactaccttaaactataatgcaatttataataccacatagaaagaggctcagagataagacagctctccacagagcctcagggctctggcttcatttctctgattctctgagtcttcttttgactttttccatctgtctgcctgcctcctcctcaggctggaagcaaaatggctacagcagttgcaatatcttctatagatgcaacactttcagaggcagaaagaggccatcttatgtttgtatctcttcttaaaagtgaggagaactgtccattcacatcttattttgcagaatcctcatgcctaaaacaatcaccagcatggaggatgggaccgccatcattggctgtcaccagtcaggacccagcagctggatctcggccagactcccctaaagcacatgatcaagtgtggggggaagtagctggataaatttaaggatttaggtttggggattgcatttggggaaagcaactttccatagtataatatttgatatagccaagaaacctcttccactttggggtgagggtaaggagtcagcatgtccttaaacatggtgctttctctcaaatattctgtctatatgtcatttctgttcctctaaatgtccgggcttttaaaaacataaaagccagatttataatttttttcacttttctctcatcacatcatttccatgaaacaacaagcatagactagactgtctccttgaatttcaaatgaaaggcaaagtgggtaaaggaacaactagcaaaaataaataaattagtatttcaatcatataatccttcctcacatacagtcagcccataaatgttctatcaccaccaccactaagggaaaactggtacagttcccttcctctccacctcctcagcagcttcctgacacctcgctcctcaagctgtttctcttggtgactccttcttccttctgaagttaataactaacccagtctcacctaaaaatagcaaaaaagtagaaatacaccatgtggggtgccagaaccctcaagtcttcttaaagatagttcatccccttcctctcttctcttaacttctacctaggttctaggcccaccagtctaccacaacccttgtttgaaaatatcaagatcactgaaaacagtgacaaaaaggcagcattttaatgcaatggttttgacaactatcctgaactaacagtctcttgtatccataatggcctattttcttccaagcagtataaatcacagactatcagtattttctatttgactaatttatgcacacgagctttcatcttacactaatcctcttttatgcttattttccaatggcatcttcctccctcatgtttttctcagtctccccagttgacatttttggtgtttccacaaaatgccaagcaccacgctgcacatagcatttttcctgactttccataatgatggcccaacttcagccaggccttgattataattttccacatgatgcttcctggcactttctgaaattgcctgataatgactctgcattgtgttgacagaaataattcttgttaaagcagtatcctattagggcttccacttaacctgtttgtgcagatttctggcctgggattctgactgagtagggcacccattcctgtcatcctctatttgtaacaaaatctgagggttttctttaatgttaagaacaaaaggatttattgagaatgactggatctaaactctagaaatttattcttcatatttaactctatattcagcgtaattgttggagtaattctatgcaaaaccctacaaagggtattcagtaggattctaaaacgcactttcagtacttccttaacttattggtaaaaaccattacctgaagaaattgtctcaattctgatccataggtgtcttttttctttagttgtccaggttctttattcagtccctcaggcatcttcattcaaagacatatcctactcctctgctgtgtttcatatgtactcttgtccccctaagatctgcttctcctattgggtggagagtgacctctcaatctctggtttcagaccccaagtgactacgttatttcttggatttctgagaagagttgtgtcttagtttgtttggactgctataaaaaacataccataaactaggcagcctataaacaacaaatatttacttctcacagttctggaagctggaagtccaagatcatggtgctggaagattctgtgtctggagagggcccacttccacgtgatggaaagggcgaggttcctcttgggtctctttatgagggcactaatcccatttattagggctctgccctcatagcctaaccatctcccagagcccccacctcttaatactatcactttgagggttagggatttaacatataaattctggggggacacaaacattcagaccataacaggttgcttcttccattactttttgtgaaatgcttgttcttagtttttagtgacggggaaatgcttttctattttgataagactgaagttccacctggctttctactctaatccaagtgctctttgtattatagaacaggatttctgtcagatttctctaggttctgtcccatggtttgttgttactctacagtgataaggaaaattatattctgtttctgttggtggataaaatagcttcctgcttgagctctgaatggatttcatctcctcccttccagcagaaactgagctgccaaatgaccttcgagtgctgccttaaccataccttttggcttctgtagatccaggtttcattgagaaacccagggttataaactggagccctatattttgtttcatcagcaaagtgtgtgtgcatgtccacattgatactttaaaatgaatctgaatgctgtattagttatctattgttacatagcaaattaccctcaatttagtggtttgaaataacacatacttataatctcacagtttctatggtcaggtatccagaagcagtttagctgaatggttatggctcaaaatctcatatgaggttgcagtcaagctcttggctggagatgctgggagaggacccattaccaagctcaactgagcatttgctagcaggccttttatttccttgccacattattcacaccctaggttgcctgaatgtccatatgacatgcagctggcttcccccagagagagctgagagagtacgcagagagaagctgcagtcttttatgacataagctcagaagtgttatgccatcgcttctttcatgtgtaagtggtcacaaagaccaaccctgtacagtgtaggcagggactatacaggggggtaataccaggagatgagggccactggggaccatgttagagtcaggctaccacaaatgccttcagatagattatgtcttttaaattgcagatttcaaccagtccctattgtctttccaggaacccaaaccaccaattccccattcctttcgacctctccgttacctacctgcctttaacgacatgggtttataacttctggtctaaccattttatgtccagtatcctttgtattatatctcaaaaaaaaaaaaaaatcctggcctcaacctatagctacgcaattatattccactcttagtgcagactctcaaaaggaatattaacaaaatattgagtatgtgattactgcagcaacaagttaaataaaatgaggaggccaggtgcgatggttcatgcctgtaatcccagcactttgggaggctgagggggatggatcacctgaggtcaggagttcgagaccagcctggtcaacatggtgaaaccctgtctctactaaaaatacaaaaattagccaggcgtggtggcgggcacctgtaatcccagctactcaggaggctgaggcaggagaatcacttgaatccaggaagaggaggttgcagtgagctgagattgcacccttgcactccagcctgggcgacaagagcaagactccatctcgaaaataaataaataaataaattgagggagcaggacatgaactagtcagttgcaaaaccaaagtgtcataacttctaacgcagctctctttcttgtacaatgtatggcccctcttcagcttttcaagaggttgaagatatgttcttggttgcttcaaagggcagaagcagaactaaaaggtgtgtgataccaatatttagttcaatataatggcagcttagcacttagagactccacagcaattgagtggattccataattggaagcattcaaatcaaagttggatgatcaacagtcaggaatttctggaagcttaaggagatcaaaccagaaaacctctaagaaattttcttccaaatctgagtttttataatctgctcttctggaccaatgcaaagtatcttccttagccattaactcgtatcctcactagcaattctatactaagaaatagaagaggaaagcaaggattggctgaggaatgccaggagtgagttttctgtccttaccctagtttcacgtctctttgataccgagaaaagtgctacccgctgcttcttgcctctcattcctcccactgtttcttttccactttcactgtcagccatagtcctttctgtcctaagaagtgtatcaggtgtgtcccacccaccattgtgaggtttatgtgtgtgctccatagcggctcattcttagaacttgaataagccctccactggatttcaattcatatcagaaggtatttgagggctgctactcagagctagcatgtttctgggcatttagaaggcagggaggaggcgtgacaactgtcaccccaaagaacttactgtttgtctgtaagttttaccaccccagcccacctcagttacagtattgattggcactgaggggaacaaaaggcaccttcctcattcttcagacttcatagttttcagaaataacctgtgggtgacgtccaaaattcgcacaaaataagcacaaaattaaccattacacaaatcacagaatttagcccatatttaagagaagcacttttcagctgcatggtgatttttccttcatatatctcaaattatttccttcaaagtcacacttagttgtctgctgcataaacagaaaccaatatgacacaattttaaaattatatttaatcgctttcatggtgtgctctacttggtaaagaaggggggaaacaaggttaagtaaaggccaggatcctttttctgcaatggatgactgacatgggaaagagatgagttacccaggctttgctttttgctacctgcagtataaaactccctgacattgtcccaaattgcttttacaggtattttattttcaacatctaatttgttcggcttttcttcccttgccatctttttcttcttttgccatgtataatgcataacaacaatttctgaactccaaaagcatagaaacctcagaataacattacctgggaaaaattaatctctctacctccagctaccaagagaatcatttgcacatgaaaccctgagatttgcgtctttcattaatctaatgcagtagcaattgttataccacatcgttctattggaattgatgactaatcattcccaaaactcttttgaaactattgttcccataattttgtgttttgattgaaaaatgtcatgaccctatatctcttcatgttatctgttgcatagctaaccctctccctcagatttagtggcttaaaacagcaaccatttgtttagcccacaattctgttaggcagttcttctggtcttaagtgaactgactcatgctctgtgttcagctgctgtgttggctggtgctgactggactaaggtggtctcagttagaattactgctctttgctcatgtggtctctcatcctccagcaggctgggctggttcacatggtggtggtgggttcccaagagcagtacattgatatctgaaggcctcttgaagttcaggctcaacctatcacagtataatgtccactatgtcctgttggtcaaagcaaatggcaaggacagcccacatgcaagagacagagaaagagattccacctcttcatgtgagaagctgcaagtgtcgtggccagtattgcaatctaccatcccagccatttaaagcttatttgcttttagtattttcaacatcctgttggttctatgaagacagtgtcagtgtctaattgacttttttatttctccctgtagtatccttcactcaaagagcctaagaaagaaaaggaaaatagcattgttagcacctcatgtatcgaggcattggctagacattttctatgaattggctcatttaatacacacatagccattttgcagataaggaaattgagactcagaaaatgtaaataacttgcccacataattcagtctaaatgccaaaactggggtttgaagttgcacttaggtctaagttcaaagctttttatgttctaccatgcatgctgcttagcatgttttctttcatataattcatgctgctaatgaaacagtataaaccagctgtatgttaactgctagtgaaatgatttattgtcttctttttcagtaaatatggcaagtctgctcaatttattccctttatcattgcatacactacaaatattctctccctataccttcacatgtcaattaaggtatgcaacagtaatttccattttttttaaacaatgcttatgttaccatctctagacaagttagtccagatgattttggggttaacatgttggcatttcctggcactattactgctagctgaataagagttgaaagttggggaaaaatttaccagatctgtattagttttttcgcacactgctataaagaactacctgagactgggtgatttataaagaaaagtttaattgactcacagttccacaacctgtacaggaagcacgcctgggatgcctcaagaaacttacagtcatgtcagaagagcgaaagggaaggaagcgtgtctttacgtggtagcagaagagaaagagacagagagaatgagaaagtgagagtgaagggggaagtgccacacttttaaaccataatccacccccatgatccattcacctcccacccagtccctcccccaacattgggaataacaactcaacatgagatttgggtggggatacagagcgaaaccatatcaagatctatttagaattctccagcagatttgattaacaatatagatttgtgattctgcaatttgtagggtcattataaaacatggctgccttgattgcaatcagatatctctgaatatggttcaaaggaaacagatctcgttcttgtggagataggattacataactccctctcagtcattttgccattgattcagaatgtttctccctaagatgaagtactgttttagcttagaatggtaacagcaattcatcaccaggcacagtggctcacacctgtgatccccacactttgggaggcccaggcctgtggatcacttgagcccaggagttagagactagcctaggcaacatggcaaaaccccatctctacaaaaaatgtaaaaattagctgggcatggtggcacaggcctatagccccagccacttgggaggctgagaaatgggaggatcttttgagcccaggaggttgaggctgcagtgagccatgatcgcatcactgcactccatcctgggcaacagaacaagtccctgtctcaaaaaaaaaaaaaaaaaaaaaaaaaaagcaattcattgatctcatctagtttgactagttcaattatacatgtgagaaggctatctgagatgatgtcaggtgtggagcagtgactatcccagtgatctgaatgtgattgaccacttggcttcaccaggattatctcactgtttggttctaataaaggcagtcattctagtctatgagtttacctcccttttgctacaaacacttcagtgatatactattgaaactataaaaatccataaaaattggtttttgtatgtgagttttaaaaaattgttttcaccaggctgtgagttttatgtctttgttttctattgggatactaatagtgctatgactatagtatgttctcaaggaaattcttatgaaaattgaattaatccgacacagtgcatggttttggagtaaaacagaacttgttttaaatcctagttcccccactaggttgggtgagatgagacaaacgacttaacctcactgccactttaatttgttctctctctctctttagggtggtagaaatgatacctacctaatagggttacgtgagtaataataagatataatgtgtgtaaaattcttgtacaatgcccagcacagaataggtgctcaatatattaaatatattgttattatttattaattaattaatgctgatttctgcattaattttgactaattgaaatcctggacttgcttaatttgcatgtatttgtcttcccttcttccagtacttgatggcaatttctacctgtggtaaatggaacgttaaaagttatatgcttatacaaactttagtcctttattccttggagtgagttttaagagtcctcatgttgaataattcatgtaatcacagaaataatactatgtatcagggaccgcttcctttattaaagataaaggcagtggaaatactgcctttgtcagaaatacttcagttactctgagagagagagacatttgtttactatatgacagcacagtgcatggcaaataatagaagtttggaaaatatttattttgaatgaatgaataatgaacacattgtgaacaaataaatggtttactatttaattattcaggaatcaattaagctttattaataaaaattgtttgggggttttaaaaagcccacacacaaatgagaggcatcacagaggcaaacggtatgacattattaaaatcgttattgctgaatcacagttcagcaataagcaagtgtttgaggcattcaaataagtgagtatttgagtgactctaagaagataatgaaactcctccactgttttacagttgcaataatttttaaggaacatataaaaacatattctagtgtttccatttgaataaagatagtatatataacatatgcaattaaaaagaagaaagaaaacaaattttaatgtgtttttcttttcaccttatgggcagttactagatgtatgatcagcaattttagcagtagagaccttattaattgtttttgaaaactctctagtgcttcacaccgtcactcaaaacagagaaattccttttaattaaatgtcaggaagtattccaagaaattttgccagcatttctgctagccagtaagtaaggttaattgacaatctttaagagagaatcttagagacattcatatcataattaatgtaatttaagatgctgaggatgcatgaattacctactcagtgtaaatggggtctttgattgtgaagagaaatactcaagtgcagtggtatcttacagaatagattccctcattagtgtgaattagtgtttctgaatgttgctaattagcaagcctgggaacaaacacaatgaaaaatcaagtttaccaaatcacaaaaaaagtactggttagcatatttggtaaacatgggtcgataattattttgattgaatctcccagcaacctagtttattgtggttgcaggccctgtgcacagtatgttttacctgccataggtataatcaaccatatactaaaagtttgtaatgactgttgagatcaaaaagtatttcagaaagtcactgagaatatagttttctgagataaggagatgatgttctatttctgatgtgactgtaaaaaggcatagaacttaagtgagaaaacaacaacagtgcctctcattttcccagaatttatttcaactggctgttgagcctgcccttgctctcttaggactcatgttacgtagaaatgcagactgtgtgcagttctggtcacctcctagggaagcactgagaagggagcaagtaataaacctcaggaaaaatagttttttgttttttgtgtcaaagagcagtgggtgatggttttaaacatctgagatagaactggtgataaagaaaagttaggaaagaagacatactgaaaagtaaaattgagggatgtgaaccaggtagaaaatactgtatctaccatgcttttcaagctatggtagagtgtcatgaaatcaaatgaatgggttatgatcagcattcttttagtgaaatgaaacaagatgggatgagaagttatggaatgagatgggcatatctgttgtaaaatgggataggataggacagaataggaaatacatattatagaatgcatcacaagtaataagagccagtgtcatttcttgagccttttaggttttactcaaagatttttggttttaccaaagtggtatatgtatacctggttttaaaggtcaagtaataaagattaacacaaaatgaatcacagatttaaatataaagcataaagcttttagaaaaaaagtaagagaagatctttgggatccagaactcagcagaatgttcttaggcttgacaacaaaggcactacccataaaaagaaaactgataggctgggtgtggtggctcacgcctgtaatcccagcactttgggatgctgaggcaggcaaatcacgaggtcaggagttcaagaccagcctggccaacatggtgaaaccctgtctctactaaaaatacaaaaaattagctgggcgatgtggcagttgcctgtaatccccgctactcaggaggctgaggcggaagaatcgtttgaacctggcaggcggaggctgcagtgagccgagattgggccgctgtactccagcatgggcgacagtgggagactccgaaaaaaaaaaaaaaagagagagagagagagagagggagggaggaaggaaggaaggaaggaaggcaagctgatagaatggatctcattgaattaaaaacctttgctctgcaaatgagactaaggggatgaaaaaacaagctgcaaactgagagaaaatatgtacaaatgacatatctgattagaatatataaagaaccctcaaaacaccacaggggaaaaaaaaaaaaacaccagttgaataagaaaataggcagaaaacgtgaagaacatttcaccaaagagcatataaacatggcaaacaagtgcaagaaaagatgtttaatatcattagccccatggggaaagtccagttaaaactacaggagatatcactacacacctgccagaatggctgaaacaaaaaaaactagggatgacacaaaatgctgggggagatgcaaagaagccggatcacttacacattgctggtgggaaaacagtttagtagtttcttaaaactattcagttagttactatctgaccaagtaattttattctcgggtatttagcccagagaaattgttatgttcccataaatcctatatatgcatggtcgtagtagctttctttgtaatgacccaaaactggaaacaacccagagtaatattaatatatataatatatattttattatatattacatatattattatattacatataatatattaatatattgcatatattatatatgtactatatatatttaaaatacagctgaataatattccgtagcatgtatgtgccacaatttgtttaaccttttgtctattgaaaagtttaaccaataggcaaaaggttaaacatatcgtggcacatacatgctatggaatactactcagcagtaaagatgagtgaagtattgatacacacaacaatgcagctgaatcttgtgagaattatgttaagtgaaaatataccaatcccaaaagatcacatatcattaattattaagtattactgtatacattaatgtagtgtgggaagtgtatatatatatatgtgtgtgtgtgtgtgtgtatatccatttatgtaacattcttgaaattatagaaatgcatatcatattagtggttgccagtaatcatggtgggagctgggagggaggaggtgtggctctaaaaggacaacatgaggactccttgtggtgacggaaatgtctatatcttgactggatcagtgttaatattctggcagtgatattgcactatacttttgcaagatgttaccattgtaggaaactgaatagagggtacacagaatctctgtattatgtcttacaaattacatgtgaatctacaattacctcaaaattgaaagttcaatttaaaataataaaagtcaaatgatataagccctttgttacagaatataatgattttcttcctcaactctcccactctatccctagaccacctttccaggagcagccattttctatttattttagttattcctcttgatatttacatatctccatatttttccaataatatgagtgtactgctaacttctgattaattcattttgaatactgtttactttctattctggtaaatgaagatttcactcttttttcactcttccttctgcagaccctcccaacctttcaatgtaagtcactatagttttttgagaagtcaaaattcagcatctacattatgtatacatattacactgcactatggttgtttcttaccttttgcttttcctgtagtaaataaataccttgttcattgttgctgttttcataattcttcccacatcttcaataatctctcagtaatattttccacaaggtaaattgcgtcaggtaaccaatcagtcccattgtgacttttctttgagaacacattctggaaacctccattctccttttacctgagctggctgctctctaagcctactgcacagccattatcttttgaattcccttttattttcttctagattggattctcagctttcaggatcttgtgtttttgtctttcttgattcactccattatttcagacagtaaaaatccaattttttttacataaaaagatgacatgatgacagaaggcatgatgatgacagctgtcaatgtgtctgtccctcaattcacactagtcctatctggaccaatttccctctccacctgacacactgctttcacacgggaattttccttccctgtcaccctgctgactcctgttgcgtctctctgtgtcaccctgttctgtggctgtgtctcccactctcttcgtttactttgccattttgatgaagtacatcctatcatacattcctgagaagagtgtctggaaggcaaaatttttaagagcttgtatgtctggaaatagttcgtatccattctagaatatcttattgggttttttttttctcccttcattttctctgaaagaagagagaaaatatgaagatatttctcataataaagatatgaaaatctgttatttgaaagttggacttgcatactggccccgattttcttatccttcctctttcattttctacctctttgtctttttgtcctactttctaggagttttagctaatattatcatccaaacctcttactaagattttcatttctgctatcatttctaaggtcctttgtttttgttgtttttgactaagggttcttttattttagtatcctatttttgttgcatggatagagtattttgccttatatctgtgaagatattaatgacaatgttttgaaattttcatttccttagtttctgttaccttctagttgcttttgagctccatttttgtactggaagatttccttagatacatagtaaattgaatgttttctcataataaaatgttggagactagaagggtgactggagtttctgagtgtattagagctgattaactttgatcttcaccataggttgacctgagtcaaccacttttgggggaattcctggcaacagtatctttagctcttttttcttgcactgatcagattccccagagagtagctactcaaactcctagagggaaaaggtcttactaccattattacgataacgagcaggttgtggtggatcctcaacattcaatctgtgtatgatcacttaataccccagcttttggtttaatacctgtcctttgactgtgttggatgtatctttggatgaaggggtgaactctcatctaaagatttctatcttctgctggaataggagaggaccatatgcccaggagtctgggagagattgcacgcaaccttccttatcttagttatcccctctttatgcttggatcaagaagtacctaacgttgccaattcctgagccttttgagttttccaaagtgtaaatcttgttgttcttagcttttctcagtgttggcatagggttttctctctggtgtcagctagtcagttacctaacttgtccatctgctttcccacttccaaaattatgttgttgtcatctcctttccttttctcttcttttatgggtttatgtctttttttaaagtatttcatcactatagttttagtgggtttttcaaaatgagcaagattagctgtatatgttcaatctaccatcttaacccagaaaggaacttctgtcttaattatatgtgtatgtgtgcatctttgtatgtgtgtgtgctgaatcacagcataaactataatccttattgtggatgaaagccaaaaaagtcagttagtccaggccaacaaaaagtaatcaagttcagtcaaaggctagtcatattttctctttgctatgaaagcctcccatagagctgagagagttttgaagacatatgaggacattttttcagaatgtggtattcataggaagctctaagtctatctctttagaaaaaaaaaaggtaagctacacttcctctaatactgcatttgaatgtgtccttcatttctgttttgagtactaagattatttattctaggtcccaaatttttatgtcaagaatgtcataatactaaataagtaaaataaaaaataataaaaataacaagtaatcccagtgctaagttatgcaatctgtatcaatctgtaatcttcaattccactaaaaaaaaaaaagtttgctctccaaattgcatctactttggcaaaaatgcatggaaaatgcaattacctgttcaaaatattaaaattagctctttagaatattgctttaaaagctcaaaaggatatttaactttgaaaccaatatgtgctgcagatatggatacctagaggcttttttttcaataaaaactaattttcagaatttttttcaaatattgtatcatttctacagcctaaaaaaaatgtagtgagagtgtgttcacagatgcatcaaaattgttattatagcattatcttttatttctatgggaactcagtgagatgatttttctaactcttaattttaaaaaactcacttgtaagctattactccaaatctcctaagattcagaattgagtaaacaatggtcacatgattgagattttacaatttgttgctacagtaccagcaatataaagtattgggataaatgtcagtttggaaaaggtgataggtgtgaaatatccaaaagtgacatgtgaagtaatgctatcttgctgtaaagtatttagatttccattagtgttacattgttcctgaagagaaaaactaagtctggattgccttcttttttatattaatatggatgatacagtgagagagagagagagatccctcttccttttgtaccaatgtgaacattcttctattatttactaattataaatatatagatccaagaatttaaagtgggcttacagattgcatttccacctaaaaataaacacgcagcatactatatttattcaacaaatatttcccaagttctactataaaagttactcattcttttactttaaacttcttttgcctcttaaatattttcatgggctaataggggaagattctatttaaaatgtttataaaaagtaaacattatgtggaaattttgggtttttttcacagtaggattttgaagtatacctagtcacgaatgatcacaaaaacaaaacaaaaaaattaaccatagtacaacagaaaataataaggccaaaatcccatgaatgacaaggcacggtcctgccctcatggagctcactgtctaacaaggaaaggggcttgtaaacaatgaaatataatacagtgtaataactgagaagacataggcatacatagtaaaggaaggactgcatcagtcttccttcagaggtggtagactcttgaaaggcttgtcattccagagctaagcctgaggctctaaactccatcacgccaccctgcacacttcatcctctgtgcttaggacctctcaaaataaaagaaattgctagactacaaaataaagttatggttttcaaagtgccacaaaagttacatgtaggctgaaattaaaatggtgtgttctaattattctgatgttctccacattgtgagtgtcccttgctattgttagtgccccatgcatattataatctgcccaccacaaattcagcacctagaaattaccagccaaacaaataagaaaagcaacgaggatggatgagggtgtgtagacgataccccttgggagaatgtccaatgatgatgatgcttgaacagcacctaggaaagcagttggaatttggtgtggctggagaatgggatggaaaggccattataagatgaggctgaatgggagcttctgggccatcagaaccaacttccttcccaaggcaaccagagatgtttaagtttccatctatgctgagaaatcgactttgacattaaacatcaattgatgtacaggaagagattggaagggaatataccaaaacttgataggatttgtcttagagtgttaaaaccacaggtgaattttttttctttctttgtgatttaatttaaaattcaaattttcaaggtttctacaatgcacatgtattactattataatgagagaaaagcaaagtgaaaataaaaactatttgaaaggaaaaacatctagagtaaaaaatacattatccagagtatttttctgggttccttattcatgccttgaggacctagtttgtctcttggttacttagcagcatctaacatggaacaggaagaaaagtccctagccaaggacttagtgaaatgaaattgtgctactgcatcagggcccaagcagttactctaaactctagttggattaaaggaattgtctttggactagcacatgtctaaaatggtaactctaaatctaggatgatatttaaggttttgagaaatgatagcagagggtggcagggggtgagtaatttaaatacaaccagcagcagaaagaaggaacccttggaaagtaaattataattcattacgggatgtaataaattagttatcaccaccattaatagtagccattttaatatgtgttccccatagcataatgaaatagaatcatcacatactttatttaaattcctaaaataaaaatgaattgtgaggttgggcgcagtgactcatgcctgtaatcccagcactgtgggaggctaaggcacgcagatcacctgaggtcaggagatcgagatcagtctggccaacatggtgaaaccccatctctactaaaaatagccaggcgtggtggtgcgcacctgtagtcccagctactctggaggctgaggcaggagaatagcttgaacccgggaggcagaggttggcgtgagccgagatcacaccattgcactccagctgggcaacagaatgagactccattcaaaaaaaacgaaaacaaaaacaaaaatgaattatgaacttctagccctcacactttcactgtaagtaacatatcacaataatggttgccttttttatgcgatgcataaatattttgttacagagtacaaaaatacttttcacgttttggttgattcaaggtttggaaagaatgaggagcagcggcaggcagagtgactgtggagaggtgaacagtacggcagagagggcattcctatgactgttggcgcatccgaggagataggagcagagaagcccaatttgaaaggaaaaggcaaatgccatctatctgttgggtggaggcaggcgctgagtctggaagcgtgtggggccacggggctgggggctcgggcctccctgaagcgtggtgggtgcaggggcgaggcgagcagagagaggccaggcaggatgaaccaccgggggccaggacctgttgctatggtgacagcgtgaaaacaaactgtacactcacatatacacaagcgtaagcgtcttcattcgtgccaggaaacatgcaaaattaaacgcctcgtttcctcgagcgggagctaccgaagcaaagttgggtgggaggtcaggccttgcagggtccaagtgatcctccgagctggatctgagcgcctcagcgagaaggtccccaaatcctcctgggaggcgttggagaaaggcttgagtgtgcagaaaagggctgaggaagaggaggaaggggaaacaggaaggagtccactgtgtcaggcttaggattcacaatttctggggggcagcggcagctctgcacaggccgcccgggggcgggggcggtgggagctcagggcgcctgtcccggcaccaccacagattcccagaaccaactccccggtgaccagactgaagaactaacagaactgacgatacttccatccttgctgggtggtgtcagaggaagggaaccagcgcacctggcatggagggcggcggcaacggtagtggcagctgggtaggtgaacgcagcatgggtgatggctggggtcagctctgtggtgtacaaaggataagggcccaggcctctgggcatgcaggcatcagagcagcccccatcaggtcataggggtcccgagcgatgaagtaagtgtgctcctaggtggggtgcatgttggtgggatttggagttgccattagcttgctcttggccatcttggtgttggctttggcaaactctagcctcatgatctgtgggttttcgggatctaagcgaatatcgttcagcgcatttttggccgcttctgctcctgccccgctgtcaaagatcacaaaacaggctgtctcgcggtgagcttgagtagggactcttcataccccttgaacggccggaagatcaagtagggttctctgggtttaatgtccatggggaggccgctgatagtgtccggacctcctcttccaggacgccgccggaacccgcgctggagccagtacaggtgctgccgccgcgctcgccctcccgctacaggttgctcctggtgcgggggagggggcggggcggcgggaagggaacgtccgggcgagcacggcggcggcgccggccccagcgttgtgtgggcatggttgcctttaagtcctggaattttggaagatttttttttttttttttttttttttttttgtggagacggagtctccctctgtcgccaggctggggtgcaatggcgcgatctcggctcacgcaacctccgcctcccgggttcgaacgattctcctgcctcggcctcccgagtagctgggactacaggcgcccaccaccacgcctggctaatttttgtctttttagtagagacggggtttcaccacgttggccaggctggtctcgaactcctgacctcagggatccgcgcgcctcagcctcccaaagtgctaagattacagacatgagccaccgcacccgtcctggaagattttttttcttcattctgttttcctatttttcaaatacttcatatcaaaaagtatacattatttttgtgatggaaaaattcttaaattccttaggaaactttaaatgaagtataaataatttataatctcatgcactagtacagctaattttatttttacatattctcttctagctacttttcttttcacatactattgtacatagttataatcaacataagtagtttcatattttaatttcattgcacatttttaaatattttcatgttattacatactattcataattgcctttttcagagctgtgtagtacacctgcatgatcaaatgctataatttactataatttgcagttttctactttagggcattgaaacttatataactatttttctatagtaggtgataaacattattgcattaagctacatttctattctttttgaacttattttacaaaggaaacttaccttgtataaaattgtaagattgctgattatatagcaaagacatagactcaatctaagtgcccatcagtgacagatttgataaagaaaatgtgttacatacacaccatggatactatgcagtcataaaacagaatgagatcatgtcctttgcaggaacacaaatggagctggaggccattatcctcaccaaactaacacaggaacaaaaaaccaaataccacatgttctcacttttaagtgggagctaaatgaggagaacacatggacacaaagaggggaaaaacacacactgaggcctacttgagggtggatggtgggaggagagagaggatcagaaaaagtaactgttggatagttcctgggtgattaaataatctgtacaacaaacctgagtttaccgatataataaaccttctcatgtacccctgaacttaaaagtttaaaaatcaaaaataaaaataaaaagattgctgattatacattaagtattttattgtcataaaaattaatccaatttatattgtcaccagcaatgtcaaagtgtaccaaattcatgtcaatttttattagttattattcttttgcaaattaaatcggtacaagttcatgcttttaatttacaattttaaaatttctagtaaggctgaataattttcagtcattttttgctagtctttcctgactgacttatttgtacatatatattttgaattgtgattcattcagataagttccttatacattgtggatattaagccttttttatattttggaattcttccctaatgaagaatttttggcattgtaatttagttattgtgggtagcaccatgttctgtcttcatgatcaaagctgccagctctctcctttataatttcttctattgccccaaatgtgaggacgttattattcctccacagacaaaacaagtgtttccgctatggttttttttgtttgtttgtttgtttgtttgtttgtttgttttttgagacagagtctcgctctgtcgcccaggctggagtgcactggcgcgatctcggctcactgcaagctccgcctcccgggttcacgccattctcctgcctcagcctcccaagtagctgggactacaggcacccaccacgacgcccggctgttttttttttgtatttttagtagagacggggtttcaccgtgttagccaggatggtctcgatctcctgacgtcgtgatccacccgcctcgggcccccaaagtgctgggattacaggcgtgagccaccgcgcccggccttccgctatgtttttgacaattgggttttatttttgtctgtgactgtgtaagctgcttgtgtttaaaagcagtagtgatttctttaaaagagaaagagggccaaagcctgagaagagggggttttttgatggctgcgagtagaagacaatgactggaattcagcaggctgaggccttcaagctcaattaaagatgactagaatgttgtgataggacaaaaccttgttcctgtatcaccaatttatcaaaggatttttaaattgtttttctgttttttatgatgtagtcatttactgctgtcttgtgaggcacgtatgttgtctcaaattgctcctctgcaaaatatatcagcagcaccaaggaacacaggatggcggattagccaaacactgctcagctctggctgagggagaccaggagatgtcatttttctacctacaaccagtggtctttgcccttggctatacatcgcattcttccagagagctgggaactccaacgcctgggtcctagcctttggtttctaatgttattggtcttgagagcatcctcattattgggattttttttttaacactccccaaatgattttaatgtgcagccaaggttgaaacccactgtaatcatttcatcaagaaatgcaaagaagatatccaaaagaaaagaagtcaatatattgaagagatatctgtactcccatgtttattgcaacactattcacaatatccaaaatatggacttaacctaagtgcccgtcagtgaatgaataaagaaaatgtggtatagatacacaatgaaatattattcatccattaaaaagaatgaaatcctgtcatttgcagcaacatggataggactggaggccattatgttaagtgaaatgggccaggcacagaaagaaatagatcatatgtgctcattcatatgtgggaccgaaaaaagtggatctcatgaagacagagcttagactggtggtttccagaggctgggaagagaagttggaaattggaagaatgggaatgaagagaggttaattaatggctacagtctgatagaagaaatcagtcctagcgtttgataggtcagtagggtgactatagtttacagtaatctgttgtatatttcaaatagctcaaatagctagaaaagaataattcaaatgtttctagcataaagaaaagacagatatttaagatgatggatagcccaagtacactgacttgatctttacaagttttatgaatgtaataaattatcacatgtactccaaaaaaatgtacatctatgtatcaatgaaaaatagaattatttttaaaaagaaatgcagaaagaatctaatccgtaaaagaaggtgactaagaaaaagaactagaaactacctgtccttcttccataaataccttcaatttgatggtaaaatttcatagtggaaatagaaatatggtttttggacacagcagaagtttccaaaatggtcttctttaccatcctctctcttcatcatctcaagtccaagtggccctttccaaacagtatagaaagtagcaattagcagtttttcaaaattcaaaatttggcttagatctttttattttatttttatttatttatttatttagagatggagtttcactcttgtcacccagactagagtgcaatggtgcgatcttggctcactgcaacctccttctcccacgttcaagcaattctcctgcctcagcctcccaagtagctgggatcacaggtgcctaccaccatgcccagctaatttttttttttttttgtatttttagtagaggtgggttttcaccatgttggccaggctagtctcgaactcctgatctcaggtgatccacctgcctcagcctctgaaagtgctgggattacaggcgtgagctgccgcacccagccagcttagctctttttaaatgtcagggaacagagtacttgaaagccaatccttaacactgctaatcaataggaaacaggaaaggcttggggaagataaacagttgtattttatatttatttttctccctaatgccaagcatggaccattcatggggctagatctgccagggaggatcccaagaggatccctcacagagagcaggactttggggaggaccttattccattggcattttgcccttttctgagtaggttttgactaggtgctcacatgagttcacggtcccataacctacatctcccaaaataccaggacagagaggcaaatgtgtagttggagaacagagggccagcctcagctggaaatatagcccctcctaagtaccttagcattcagaggggtttaagcccctaggagtaataagaaagacatttaatgtgttactaacttcactggaaataaaattgacaactcaagatatagcaggtccacaaataaaattgtttccttcatcatcgttttgttagatggatgaggaaaaaaaaattggttcttggctggaccactgtctgtgtggagttggcacatcctcctcaggcctgcatggattttctgcaggttctctggtttcctcccatatcccaaagctgtgcactgaagttcattgacgtgtctaaatgatcctcatctgagtgagtgtgggggtgtgtgtgagcatgctctgctctgagatgtgccctgtccatggctgttagctgccttgtgccctctgctgccaggatgggctccagccaccctcaaccctggactgaaataagtgggttggaaaataaatgaatgaatgaatgaatacaaattattgtaaaatcaaaatgtgtcagaccagactcagtggctcacacctgtaattccacaatttgggaggcctaagtgggaggatcatttgagatcaggagttcaagaccagcctgggcaacataacaagacctctccatctctgcaaagaattaaaaaataaaaactagccagacatggtgacctgtgcctgtagtcctagctactagggatgctaaggaggaaggataacttgagcccaggagtgaagttgcagttacctatgatcacaccactgcactctagcctaggcagcagagggagacgctgtctcaagaaatatataataatcaataaccatacatctggtagtaaaatgagtttggttaaaaataactaaataggccaggcatggtggctcacacctgtaatcctaacactttgggaggtcgaggccggtggatcacctgaggtcaggagttcaaggccagcctggccaacatggcgaaaccccgtctctactaaaaatacaaaaaattagctgggcatggtggcaggcacccgtaatcccagctacttgggaagctgaggcagaagaatcgcttgaacccggggggcggaggttgcagtgagccaagatcgcgccacttcactccagcctgggctaaagagcaagactctgtctcaaaaataaaataaataaataagtaaataaaaaatagcatacaataatcatacaaatacacaacaattgatgcagtaggaaagcactcagcaagcccaccaatatttgctcgtttttttaactgtatagtggtaggaggtgccccttctaattttcgctatgcaatcatttattctttgatttaacctcccgccattatgaccactgtcactcactgattaaccaaaaattaggtaaataattatcttacttgtttttattaatctttcttaaatgtatatgtagctcacatttgtttcagtgtttaatattgtgttttgtgtctttatgtagaaatttggtgacgtttttgtgaccagaaatatgccataggactttaactcttctttagatcaaatagctatggtaaaatcattttcattatatgtgatttcacttaaagtcacaatttccaagaacctaccgaagacattaagtgaggacttggtgtacttatgaagcagaaagacagcatcttgctcatttttgtagctttgaagcaagaaaaaaaaattccctaattcactcctgcctcaacacatgccagcaaagatatatttcctattcatttgctctaactacacctacccaaaaaaaagcagaattgagtgtttaatttatggcttaaacaatcaagttataaagtgctgtataaaactgcacaatcagatgcatttgagtataatgtaattgatgaccgactctcatcctctgtccagccctgttcctaaacaggatgagtctcttattggggtacaggatgttgatggggagtgcaacattaggctgggaggtaatgtcttgtaatcatctgggatgttcgcaggttcatttatgtgtgaacaatatagtttcactatctttacttttgtgcttattgtgacagtaaacatctgctgaaagaaagttttccattaacctcaaaattaaaggactctatattttatgctatttcattatttggacctgcattatcatattatggctggttatacagtgttttcaaatacagaaattattaatataggcttgcaggatctgtcttgtaaccactccagtgttccccaactttctgagatatgagaagagactaagatagaagtacctctcattcagtttcagatgagggaaagcagtcatatgcctctgttttgaaggacagcataaaacactcttgtgaattctgtactgggaatcttttttttttttaagagagtgggtctcactctgttgcccaggctggagtgaagcagtacaatcatagctaactgtaccgttgaactcctgggctgaagctattctccctcttcagcctcctgagtagcttgaatgactacaggcatacacactaccatgcctggctttttttatttttattaatattattatttgtagagacagggttgcccaggctcatatcaaactcctggccttaagcaatcctcctgccccagcctcccaaagtgcaggattaaaggaatgaaccaccatgcccagctgtactgggactcctgataaagtttgttattcaatatttcctttggggagctaacatctgggcatctcccagggctctataatgatggctggtggcttcagttttgtcagccacccagcctgtatatgagtcctctattccacctgacctttccacatcccttacacaacccccttgaatttccagggtctgtatatttccaaggctcctttgggtgtggcctggcccagcacatggccatggtgaccacattgctcaaaatcaaatctcctctggatttgatatggggtccacaccgtgccaagtgcaccagccctgtgaagaaaaatgtaatgcaggagatgggaacccagataccaataagagatacaagaagggcagccccatgtggtggttcacgcctgtaatcccagcactttgggaggctgaggtgggcagatcacctgaggtcaggagttcgagaccagcctggccaacatggtgaaaccccgtctctactaaatatttaaaaattagccgtgtgtggtggtgggcacctataatcccagctactcgggaggctggggcaggagaattgcttgaacccgggaggcggaggttgcagtgagccgagattgtgctactacacttgagcctgggtgactccgtctcaaaaaaaagaaaaaaaaagagagagaaatacaagaagggcaaatctggaagtggtcagaggtgaggctcagggtcagacagctccagaacccaactgctggggttaaagttctcattctgtcatttattctccaggtgtcgctcggcaagtttcttagccttctgttcctcactttcataatctataaaacaagaggtaatggtaaaacacactcaggccgggcgtggtggctcacgcctgtaatcccagcactttgggaggccaaggcaggtagatcacgaggtcaggagatcgagaccatcctggctaacatggtgaaaccccgacactactaaaaaaaatacaaaaaaagtagctgggcatggtggcgggcacctgtagtcccagctacttgggaggctgaggcaggagaatggcgtgaacctgggaggcagagcttgcagtgagccgagatcatgccactgcacttgagcctgggtgacagagtgagactctgtctcaaaataaaaaaaaaaaaccgcttcatggggttttgatacaattaattaaagttcttggcacataattagatttctctaaaaaaaaaaaaaactcttattactatcatcatcattattgtcctggagtaaagaattggaagccatcagggaaagttttcccagctgtattcatttcttgggctgccatcccaaattaccacaaatcaggtggcttgaaagcacagaagtgtattatctcacagtacgggagtccagaagtctgaaatcatgggctcattatggttgcttccttctggaagctctgtgggagaaaccatcccctgcctctctcctaacgattggtgggggccaacaatccctggtgttccttagcttgtagatgcattactccagtctctgcttccatcttctctgtgtccctatgtctttgccttttctgtttcataaagacatttttgctgcatttagggtccccgcctaatccagtgtgatctcattttgaaccttacataattacatctgcaagacctttattccaactaaggtcatattccgatgttccacgtggacataaatcttggggtgactctattcatcctactacagcaactaagagcaggttacaataaaatcagagaaaccatgaacaattcctggaaagaatgtcatcaaaccatgggcacgatgtttatgggctaaaaagactgtgttgtgtgggtggtcaatccagcaaactggctaccctgaaggtcatcactgagtcagaaccaactgtcaaacacagagttaatcaatgtactctcattccaactggggcaaatttctctggagaaaacatgtatctgacaggagcaggctgtacacatcaggcaacacacacgtgtagtgagctctttgccctgtctctcctgacatattgtagtcacaatttaaccccaaactcgttctgatactgcgtaatgcaatgcaaagggcatgggctttggagcctcagggaactggattctaatgtcagcctctgcaacttactagctccgcttgccaccttcatggcctcagatgaggtacttaccctctccaagccttaatttctgcatctgaaaattggtcataataccactaacaacttgtaaagttgctctgagtatgaaaattaatatatgcagaagctgcacctaagtacctggtgtaaatttcaatgagcagttgctatttgtcttagtctatttgcactactataaaaaacgcctgagactggataaccagtaaagactagaaatttatttctcacggttctgaaggttggaagttcaagatggcaccttgctactgagtctcccagaagagacaaatgctatgtcctcacatggtagaaagaccagagggtaggagggcctacctagttcactccagcccttctataaggtcgctaatcccattcatgagggctccaccctcataaatgaatcaccttctaaagttcccacatcttaatactatcacactggtgattaagtttcaacatatgaatacaggaagacaaatttcaaaaaataacactattattatcattattgtgaggtagtagtttcatctctctcctactaggcttaaaggcaagaaagccaaagggacctcgaagaagagctgtgaagatccatgtgtctacatgtatctcatcatctcttcccgcaccaccgcctgcattacagcacaaaagtaaactgcataaacacacagtaaatattcattgatgtaaatgacacacaaactgcattacaaatataagcactgcctcaatgaatgaacctccaatagcctttcaaaatttggagcccaaccaggacagcccatggcaaagtcttttcctttcatgacttagcaaatgaacactgcacagagcaaaggcaacacaaagtagtattagtcctctagtgtatgtcaacatttagagaggcttggaccatataaaaatggtatttggaggccaggagcaatggctcacccctgtaatcccagcacttagggaggccaaggcagacgggtcacttgaggccagtagtttgagaccagcctggccaacatggtgaaaccccgtctctactaaaaatacaaaaattggctgagtgtggtggtgcggtcctgtaatcccagctacttgcggggctgaggcatgagaattgcttgaacccaataggggtggtggttacagggttacagtgagccagatcgcaccactgcactccagcctgagcgacaaaacaagactttttctcaaaaaaaaaaaggtatttggaggccacataactcctctttcatgagagcatttttattactttactttgtattgccaaagtaatacatgttcattggagaaatgttagaaaatacaggcaagcaaaaacaataaaatcattcttaatttcagatatgcagagagtttttttctttaacaatatactgtgacactttcccagtcattagtcttcaacatcattttttaaagttgtctaatattccattatataaacctaccaatattcatttgacctatcctccatcacaggaattttaacttcattctaatattttgttactgaaaacagaaatgcaatgaaatgagcttattccttatttgctttacaaattcataataatttggcatttattataaccctgctgccttccccaaacatttgcaattaacccaaaagtaaatttccttggtttacgaaaaactgattttttatccagtctgaaaatcgccctcagctttggctgtatgatctgaagcaagctctttcctggctgcctgtatccagtaactaataagtagtcagcattcttggctccggctacttagcttacttgttcaggacataaggctaatggggtcagtgtcatgggatatgagcttgatatatacaggccagttagttacaagtccaaaaactatttctgtaactccagacagctgtcacttaaaagctggctgttagtttccaaggaactgggcaaaagagcataggtggatcaacacaaatccatcaccagtactggaaagataatgtgtcgatagcttcatcttgcccgtagaaaacagttcagaaaagtattcatatttaaaactggggaggctgtagaaaaagaagaaagaataatattggcaagacaattggctgaccttatacatatcttggtttatcagcttactctgtgagtatcccgccatttccacgtgagaaaaattcagcaacatgtttcaaattgcggatggtggtgttatttaactggcaatattctcttgcagctgacacagcccttggcactgatgatgtatatgatgaaaaaggatgccagtgtgatgtatcagtggaagacctcaccccaccacttaaaactgtcattcgagctatcaggttggtgaaaatcttgaacaacgtgattcagagacatacttatgattaattgaattactatgttgctaagttctttttctgcaggtaaatatcctggaataaccactttccctttcctattcatccatatgcctattgaattgtgaaatatttgtttcttaatacaaaattctgctgtgttcaacacaaagagttataaaacgtgggtgggatttgaaaagccaggtcatattagagagattacacgagtcttggcttgtcgtgtgtatttgctactttaaggacatttagtttattgatgcaattggattttttaattatttttatgacttgctccaatctgtattctgtacagaattgtatatcaaagaaaaggccttgtaggttatttcaaaatgggttgagttctgaaaatgggaaacctaaagtattttgcagtgacttagtcttattatctgaaatgtaattgttaaaggctgatcttaatttgcttcctctactgatggcagagagctaagagagtatacctagcaacttaaatttaccttttccatgacctttcccaccacacacacacacacacacacacacacacacacacacacacgcaatcaagatctggactagatgaattgctgcatgctcagctggcccagtttaacccttttgggagaatttgtatttgtcaaggaatgctgagtaactatattgcaaaaaaaaaaaaaagaaaagaaaagaaaagaaatacctctgcctgttggtgaaaaactagaagaaagttaaaaatatccaaaccaggccaggtgcagtgcctcatgcctgtaatcccagcactttcggaggctgaggggggcagatcacttgaggtcaggagttcaagataagcctggccaacttgacgaaaccctgtctctactaaaaatacaaaaattagctgggtgtggtggcgggcacctgtaatcccagatacttgggaggctgaggcaggagactctcttgagcccgggagatggaggttgcagtgagctgaaatcatgccactgcactccagcctgggcaacagaatgagattctgcctccaaaaaataaaataaaataaaataaaatatccaaaccaatttagctattcacatgtttggtctaatcttgaatgttagcatgattgattacttacttctgtttttagttggtcatttggcatcatgttagacattgatttgccctatagctgagagtcactgggaaagcagaaatgagttctaaagattttcataaatgtttgtgggggcaaagaaaatcatggtgtgatgaaactccagaagatgtttaaacactatctgtagcagcagcctaaaaaaaaacaaaagttcagttacttctcaatggaaccctcaagtcacaaaccctatgggtggagagattataccttcctatctggcctggacagtccagattatgcctctagtctcatcataagtgttaataatgctcccatctttctcaaagtatcccagtttggacaatcaattatatggtcaccctatctctagtgaacctagaagtcttgggtgatgtataagcccagataacccagaatatgtagtgaaatgatgtctgaagccttcagttaaagggatagaggatttagaactgcactgtccaatatgataaccactggctacttgaggctactgaggctatttaaatttgaattaattaaaatgaaatacattttaaaatttagtggatcagtcgcaccattcatatttcaactgttcgatagccacaggtggccagtggctacttcattagacaaagaaacgaaagatttcccatgtcacagaaaattttattgaacattactggtctagaagtcaccttgaaatttttcacatgttgagtatatccataaaagaccctaaagtaaaggtgggacaattcagtccacgaattaatctgacttgcaacaagtatggaaaatcttatctagtgagagcagattaggcttcctaaaagtcatacttaacccagtttatgtcatttcccaagaccttctgaagctttctgcttttgctttacaacctataaaaaggattgtgagctgcaagaaagaaaatgaaataggtttattctgctagctaagcacttcagcaacagcttaagatttactttgttattcttcttgaaacttgactgatttttgtgaagtctttgcagaattcccttgcttttcagaattctttcttggttcttatttttaatggaactttactatttacatgtctatctttttgtggattcttgacattttctgcttgctgcattgtggtacctgagggggatgtttttctcctccatatcctgattctgcctagtggtttttcatcacttctaaattccatttcaaattaacagattgtgtcgcttgaacccaggaggcagatgctgcggtgagccaagattgtgccactgcacttcaccctgggcaacagaacaagactctgtctcaaaaataaaaataaaaataaagagaatacaattaaattaacagattctgtaaaaacctaatagatacactcaatagcttaataacctaattgaaaatattttactcatggtgtacttaatttctaaagatacataatttaaaaaccaactaatacaattagcagctctaaaaagaagtttgcaggtataagtcctaaatcttatgcagaagggttcttttcctaaggtgtttaattatgttcgtaagttcaacatcagttgccggagggtttttgccagaacatgcccacctcttgcagctcccctgaagcagtatgtatatgtatattacagattgcaggtgtgaaacatctattattcatctcaaaatagtaactttgggcatttttcttgttattttttaattgttagaatatttaatacgaatatttaaatatgccttttgtatttcagtaactcttgcaatagtagtttttcctagcagccaaattaaaatgtgtaacaaaaaatatgtattctactgcaaggatgacagtatggaaaataatattactaccttcacaaagagcaaagtaagagttcttattttcagttatcaatattttttaaacatctgccattttctagagatgactaaggacactctctgaatttgtctggattctattatccaaatgcactctgacactttttaaaaaataaataatgtcactgttcatggtacatagtaaagaattactattcttagactatttccaaaatatgtcttttactcagaagaaaacttagttttgtatatttcttccagaattatcatagatttttctcaaaatattatttcagggaaatgcaaaaatgtgctggaaatgtgttttcaaactcacctttaggagtgaagattgtacttatttttaacaaaagccccatattttagtgattcagttcaaacaatgttaagtttctttttatccactcatagaaattagttcctaaatggaaagataaaattagcaggaaagtaaacaaacaaatggatagactctagaggattctacacactcacatatacctatttcgtagtagatcacccatttttctatcactgtcttaaaaatatagcccataaattacctagatatgttccttcaaaatgtcaagtatctggctaattgggactatctgaaggtaacagactattacttttcatgctagtacttggctttgtagtcattacatatatatacatgaatcttgggcaaagttttacacaaaaattaatatatgctgtttaaatttaaaataacagggcaggcatggtggcttatacctgtaaacccagcagtttgggaggctgagttgggcagatcactttagctcaggaattcaagaccagcctgggcaacatggtgaaaccctgtctctaaagggaaaaaaaaaaaagaatgacactaaaataacaaatatttgaaagtcatatacaactgcatatttatggaagagccccagaataataacttttttaaatataacagaaattgtatttatgtactgaacaggcaggtaatttatcagatatgcacaccaatgcaacgtataagtactgtgtaaaggattcaccatttggggaaagagctttgttaaaacagtgcaatgcaaagcttacctgcttcttaccggtattgttttcaatgaattactacatctaggatcaaggctactcttttttttttttttcaatttttaaaactatttcaacagatataaaattatcctgtcaaattgctattaaaagtttctaagcactaatctcttcatggattggtacccaagagttggtgaagcagctctggtcctcagatcacacttttaaggccactcttaataagatcctcagtgacagttgttttcctgtccgtttgttttatacaaccatgttttatgtcagttgtcaagaactgaatcaaaatactgtgaaacctgttctttttgtgaatatcaacaaaaccactgatgcagattattcattattctgaagagaaatgaccaagacgctatcgattgtgccttgctcttaccgtctcttactatctccgtgcaataatggtcatgcctgctatgtttcactttatgaaaccttttctttcccaggccagactagccttttagagaatcaaatgaatacatgaataaggtccagggtgaaaactcaaagaagtctttagttgaagctgacaaacgactttacactggtaccattggctaattctatcccctcctcccaccctccctgaagctgctagggagaggtagtccaagaaacaggacagcctctgtacatccttgagcaactcatattccctcttcaagcctctgtttcctcactggcaaactggggatggtaatggtattgacctcatagggttgtagtaaggaatgaataaatgaataaacatttgcaaagcacttagaacggtatacacggtcagcactatgtaaatgctaatattattacccttgagttgtctggactccttatgccttccagcatgctgcctccactgcccgtcctctgctctgggtcagtcttttcctttctgagctccacccgcttccatgatgagtcacatgagaagagcactttgttctgtctttgaatcagggtgctcccatcttccaaaacatacacagcctcacctgcttgcatctccttcacctggaagcacttgccattttccccttgaagttaccttcccactacctggactgagaaattactcagagttggaagagcagttttttttttttgaaacagagtttcactcttgttgcccaggctggagtgcaacggcgcgatcttggctcactgcaacctccacctcccaggttcaagcgattctcctgcctccgcctcctgagtagctgggattacagacatgcacgaccatgactggctaattttgtatttttagtagagacaggttttctccatgttggtcaggctggtctcgaactctcgacctcaggtgatctgccccccccttggcttccctaagtgctgggattacagacatgagtcactgcgcctggtctagaagagcaattttttcaaccatgaagagcaatcatgagccaatgttccaagtaaatctcacctcttttctcctcagggtgagcttgctgccttcccaggcaccctctgaagaagcaacaggataatgaaagggagaagttagctcttccctctccctccctgacccttgtcgaagcctgactatagactctttaaaactcttcccagcgttcagtgcatgcatttgaaaaataggtcttgagcttcaactgtgcaccaggcacagagataaacgttaacaaaaaagatggatccctgcttagagttgtgaggaactaccagaaaagtagagtcaattacaatgcagagcagcatattactacagtgacaggacggtttgggccaacctatatcggcacttttggggaaggtggcatttgggaagactctaaaagaaagaaaagaagaaatctggtagatatgtaggaactagccaggttactaaggaggatatagaggctgggcagagagaactgcaattgcaaagaagcagaagtgaaggtggcattagaaagcacgggtgatggttgaaggtggaggacaaggatgaggagagtaaggctgaagagaagagcaggaaccataagaatgagcaggaatgtgggggattctaagtacagaaatgaatttatcagatcagtgcatgatatggtttggatctgtgtccttgcccaaatctcatgtcaaactgtaatccccaatgtcagaggaggagcctggtgggaggtgattggatcatgggggcggatttcccccttgctgttctcataatagcaagtgagttctcatgagattggtggtttaaaagtgtgtagcacctccctcccgcttctctctttcttcctgctgctccggccacataagaagcctgcttcccttttgccgtccgccatgattttaagttccctgatgcctccccagtcgtgcttcctgcacagcctgcagaaccatgagccaatgaaacctcttttatttataaatttttcagtctcgggtatttctttacagcagtgcaagaatggactaacgcagtgcttcatttgaaaacttggaaagatgactctgattgcaatgtaaggaatgtattgggaagagagaactattattacaatacctggatctgctggggcctgagctgggcagtcatgatggagaatagtcaaggatggatttcagataggatttggatatttactgattggagaggatggagggaaagaacaggaggaatcaaggatggcatatctggaggatggtgagacaggctggcttgaggggagatggtgcattattgtgagtgttgagttcaagcagtcacagtagggctcagcaggtaggtggatctctggatctgacacccaggagagcagtctggaatatggacaaatttggtagctgtcagcacagagataaatggtttgtggaagtctcaccccagggagtaaaaagagaagatggtcaacacagaagtctaaggctcacaaacaggagctgcaaaagtaagaatgctctgaaggagatagattcaaacagccagacagatggaaaaccaggagagcgtgacagaagagaagccagaggaagaaagtgtttcaagtaggaggcagatgtcaacgctgttaaatgctgctaagaggtcaaagaagataaagagtgagaaggtcctttgaaagtggcaacaaggaggtcatctgtgacttcggagaaaaattcagtagaaggaaaagggtttgaagccagatggtaaatagaacacttttttaaattaccagaatctctcactctaatatgaacatagatgaagtgtcaagaatttctttgtaactagcaaaggctcatcaactcttctaaaatagctcagatctgatcagtgaactgaagaaccactaatgacatttcagagttcctgaggtggatatgcaaatcaggcctcactgttaccctgggttgggtgataaagtttttcagttttcttgcccctgtgttattcctgttctgaaaggcatgtatgggaccattatcttgaccatccctaaaatgcaatctcagctgtgaatccttcttgcatctcacttcatatttcaggcaagaatactccgcaagtaaagaagaggcacgtgtttgccattgcgggttttgttaaatctacaagctgtttaatcatcaccagttcttaattttgctgatggcatctctgctattttagcagaggtgatgagtctttgtttgcaagtcactattaagacattcttgacagccaatctatgacatgttacagtaaaggacgctgctaaagaacattttatggatcatttagcacatatctttaaaatcagctaatatactccctggaatgttgtttttgcttgtttttgttttgaaggtaattagttgtggctacatttgctccgaggctgtgttaaagtagtgttttcactgaagatgcacttactttgtagcatgtgagatattaaaccttttctttggctataatttaaactgagttttctattatttgctaaaaatatagaatctcctattccatgttaaaaatattttaaagtagtcaacatgtatagtcaatttatttatttacttattcatttcacactttattatttggtttttttttttacactttaaaatttatgcaagattttacactcctaggaacacaaaatccccaaatttagtcgccatatcaatgcttacaaattcctggcaggaaagacttcttcggatctggaagttcttgcttgggttttactactcttatacccttaaaagaaaatccaacaaaaatctacaggaggggccaggtgcagtggctcatgcctataatttcaacactttgggaggctgagctgggaggatggcttgagcccaggagtttgaaaccagcctgggaaacatagcaagacccatctctacaaacattaaaaaaaaacaaaaactctgcaggagagcctactagatcctgcatataaaggacaataatggcaagcattaggagaacaagtctactctcagtggtggaaacagtgtggccacagaatgtctgaatgtcctaagtgagccaaatggaatatctgcttgcccctacagtgagaatatcagacagactgtacacacgtggagctaatttacatttctctatcaagagttaaaaccaagaaaatgagacagatcagtgcatccagggactcctggggttccttggtcttgtctagtaacccgatctaagatgaaagaagagtagaggaatcttagatatataattttataacttgctttgcagattataaaactgtcagagtttaaatactgtaaacacaaatacaaatctatattgttgaattatgtttatgtattaacaagaaaacaacattaaaaagtattctaaataactaacacatatgccttcaatagtgacccaaattatcaagctctgcagccctagttgtctgctggatttgtcccgtgatcaatttcgagtgagggctgcctcaggggaaattctgtgatcaaaaggctctgggtcacctgaaggatgagccttggggtccgtgcttttaagacagataaatgctgtatttctcatggagagtcagaaatcagaagatagaattttccaaactggaagagggagtatttcagtctgttttctgatgtttataacaatatctgaaactgagtaatttataaggatgaatttatttcttacagttatggaggctgggaggtccaaggtgggcaggtgtatctggtgagggccttcttgttggtggggactctctgtggcaccctgaggcagcacagggcatcacatagcaagcagagtgagcatgctaagtgctaacttaggtctctcttccacttcttataaaaccaccagttcctctctcatgataactcattaatccattaacccattaatccataatttattcatacagccagagtcctcatgatctaatcacctcttaaaagttccacccctcaatactgccacattaggcataaaatttcaacatgaatttcggagggggcattcaaaccataacagagggatgtggaatgcatgtcggtagtgtaaattaacccaaataaccaacataaagtgaggggttaagggggagaaacccacatccaccccacaaacataagatctgcaatcacaagggggccattcagcaaccttcagaaacttaataatatccccataaatgagggtgcagagtaggtaaagcactgtcatctcctccagaaatcatttctgatcacctctaccagtctgggttaaacacccctcttctgcattcccatatcaacctgggcttcccaccaccttgcacatcacaaagtgaattttaactgtctgcctacttgtctgtctgccctactagactgaaagtgcccaagcaataggatttgtttcttcattgctgtatccctggcatctagcacagaagctggcatataataggcactcaataaatgtttgatgaatgaatgaatgaatgaatgaatggacaaattctcgagtcccactcatcaggcatcactaggggaggcagccacatggagcttatctagagagctccaagctctggacaaatgaaactctcaaatcctatcagagctcacagtcgcagcaaccattgtcttgcaccatgcttgtagagaggaagagaccaaggaccaaatgatcattgtcatcacgtaggaggcttctttaactctgccagcgcccagcagttaacagttcagagcctaacacaatactcagcacaacgtcataggtactcaatgaatattcattgaaagaatgaatgaatcagtcactttagcacttcctttcccttccaaggtaatcctttgaaaaattaatggaacttcttaactacttcttgcatgaaacttcagacctcactcaaggacggggaagcatttcagttctgattagaggtctgacaccaaggcacactaatgccatgtcaatgggtctgacatgtgcgacttagaagattttgcaagctggcatgaatcatgatcacttctttgcatgagagcagggattgttccacccccaacacactccaccaccacatgccaccatcaccccaatcctgtctctactccagtggctctcaaccttggccacacattagcatcacctgaaaagttttataaaatctttggaccatgccctggaacaattaaaacagaatttctggaggtaggacccaggcattttttaaagctccctaggtgattccaaagagcagccaagcttgggaagtactgctgtcttgacagtcaatcaaactgcctcttcagttcacagttggctgagccctctccgcccttgcacatggtttggctgctggctgggtccgtccatctgtttggcggtggcagcagtcactgctgcttctgttttctcatcgttcttatctctgcatattcatatgcaatatttttaccctaatttagaggattggaataagacttttgtaagattttagaactcatggcagcacaacaaatgcacctacatttccttataagtgcacatgtgttcgtgtgtatatatagatgtcgtctacccagagtttcactttgctttagttatttcttcatgctcagaaaattgtatgagcagacttcagtttcaagaggaggtactagtttaggtttgtgatgaatcttttacaccctctagtggtactgctggggcatatcagttttgtgcaatgggtttattagactcctagtctcttcataaccaacagcatcaaaggagactaaccttagaggtcttttgctctttgctgctgtattaatcccagtgatgcaatctaccctcatgaagaaaagaagcagatgagtatgtaacttattcctcagccttttgctggtcctccaaagggctcgtcataggtacttaatgaatattcatgaaagaaaggatgaatcagtcacttcagcactccctttctcttctaaggtaatcctttgaaaaattagtagaacttcttaactacttcttgcatgaaactttagacctctctcaaagaaggagagacatagtaaaaacaggacattcacttagcaaaagtgtattgaacacttactatgtgccaggcacatgtgagtaaaaacaatcatatcatatcaaagtgtctttttcattgttgttattttgtgttaaagtatgaagatcttaatgttaagacaatagaggaaccttatgattaagagctcaaagctggagccaaactggttcacgtcctaattccacaattactggatgtttaacatcaggcaagttacttaacctctctgtgcctcagtttctttatctgcaaaacagggatggcaatagtacccttatcataggattatactataaagtgctatctaatattatcattttaatcattaaatgtatcttaaaggtcctaatttaactctagaatgatttgcccagaaattcctttctagtaggaaatacacaagtcatatcaaacttcttttgtaagcatgtaagaggccaccaaggtcttctgcttcttccccaggccagttcatgggctttcatttattcttggcttcagggcattttctcttagctcttcttatctaaaccaggggtcagcaaactatagccaggggatcaaaatctaacccaaggggcttgtttttataaataaagttttattgaaatgtagttacactcattcatttatttattgtcctatggctgctcgcatgctacagtggctgacttgagtagtttcagcaaagaccatacaacccacaaagcataagatatttactacctggccctttatagaagaagctttctggcccttgtctagactctgagtcgctctgggcttgctcccagctgtgtttagagagtaagacacagaaggtctgggctagcctatgtgagaactaagcatgaaaccaggtttcactcttctacctgccaacaaggactcccctactcctctggtctcccctccaccccctcatcctgtagttaaagcccttagtatatgaaatgcaagtcttagaaaaaaaattgaagaattgaaagaccttttgaattcgtagttgatacctactttgggacattttcctcaattttcagcacccacatattttttcctggtgtctagaattattgaactctgagcttccttgctccctgcaagtaacaagataatggcctactctctcctcttatcaaaggctaattgggtagctttttgctcatgatatacgttgggaatatattacatatatttgctggaaaatataccctgtaaagcaaaactaacagactccaatgagactgatgtatatatcctacaaatgaggtaaagtaagcagacagcccctaaaatttgtgataaaagggaaaacattacaattactggaggtaggtaacccatattagccatggactgattcccagaagggaccttatgagagaatgcaggtggccaggttgaaaggcagatgttttccaagtatgggatcccctctggaaagacaaggacagagatgaataaatgactaatgtggccttggattcatttgtgtgagaatgtcagagcatacaaggcagagtaggaggtcagatccatagacagcctaaacattctccttaatgtttacaaggttgcctgcctgggattcactctgtgttgcagcactgtgagtggaatggtaaaaatgtgagccttggcatctgcagtaaccttgttcttactagttctgtgaccttgaacaggtaactcaacctcctgagctttacttgacccaaatgtcaaaggtggaaaattcttagagttttaagttgacagaatgcaggtaaagtacttagcactgcaccagccatccagccaagcacaactcttggagacccactcaacattaagttgaagagagcaagatctatgtcttgttcacctttgtatccccgccatccagctctgtgtccagcagatggatagtgggtgcccaggttaagttcattgcatcatagagacagaggcagttccaggcattccaatgatgaccagagaaataagaaaatgctgcagggggcaaggaggacaatactaaatactcagagatgctttctcaaacttagcttggacacaaattttcctctctctaccttctattttgatcatgaaaatcgtgtactgtcctgaaagaagtgagaggggattgggtggaaagagggaggctgagataattgaataatgtaaacatgtcaagttatgtgaccccactgacctggcatcttcattcacagagtatgatggctaaaacaggagccccagagagcatccctcacacctggtcctgcttagagcaagacaggcacacgtgatttttggaagcactgatagcaatctcctaggaatgaaaaactgaggttgtattctttttagactctagccacatgttttccactgttttcttgatggtcttataatactgtaaatttcattcaaccaatataattccatcccaacaggctcttccctctcttttccctggacagttttgttttgctattaggtctttctttacttttgctgcttatcatgttgtagtattacatatttcttgacttccactgttcttgcctttctccttatttcctcaaaatgatatgttgttgcttgcaatgctgttgctttgtgtgatcctaattacgttagcaatctaaggaaaaagaaaattatgttttcatgattttcagtagcagttctatttaaatgacttttctgaaccccacatggtcctaactattgaatgagtgaacatttcttttactttagaaagtttttttattcatggaggaaactcagaggcttatgctctttctgaaatgtgcctgaagaacttcaatctattctaaggcattctttttagaagatctgtacaagagtctgccttgtcacagaacacaaacatctttgaactatggaatagcaaatcctcatttatttcttcagctagcatttaatgaaccccctaatacttgccagggattatgcagatgctgaagtaaagagcacagttcctggcatgaataaattccagtgggtgagacacactgccacagatttagctacctcacagtgcatttgaaagcacagagaaagaccatctaccccagtgagggtggttaggaaagatttcctagagcacttggtgcttgagctgaatctggaacaattagcattttaggtagagtgcaaagagacagaatcctgatgaatgagcactttggtgacaggaaaatccagatgggctggagagcaggcagcatgcagaggaatgactagagatgagtatttggagagagaaggggggaattctcaccattcactaccctcttccttctagagttgcccgaagtctccacagtagagcttctaaacaaataaacctcccatgttcattaaactctgggccaagttttgggatatgaagagtagaagacataatccctgcattcaaggttctcacacagtctggtggaggaagctagaatatgagtaaataattacagtgtggtgtgttaggtactaagctagaggttaacagagaagtgattaactgttttgttggaatcataaaaatttctatgaaagaagtgagctttttttgagacaaggtcccactctgttacccaggctggagtgcagtggcaagactgtcaaggctcactgtagcctcgacctcctgggcttaagtgatcctcccacctcagcctcccaagtagctgggagcataggcatgtgccatcatgcatggttaattttttattctttgtagagacaggggtctcactatgttgcccaggctggtctcaaactcctaggctcaagcaatcctccctcctcagccccccaaagtgctgtgattacatgtgtaagccaccacacctggccaaaagaagtgactttaaaacagagttttgaaaacacagcaggatttcaggaaaaagaaatagcaaatggaagtaattgaagtatataattgattggctagggtttttgtggacctacacatactttattgttgctggaacctaaagttccaaggacgaagtggaaggtgatgaggcaagagagatagaggccagtttataaacagccatataggatgtgcttctaggagtttgatgtttatcctataggccagggaaaaccagtgaaggactttaggagggaggtaatatgcccttacttgcattttgaaaggtttgttctttctaagcctatagcagtggagatgcaaatgaggggacagctttgagagctattaggacatgcctagtcttcttttaacgaaagtataatgacagggtcatcattctttatataaatcattgatttcaaaaatatctatgggccaagtgcagtggttcatgcctgtaatcccagccctttggaaggccaaggcagatggatcacttgagctcaggagtttgagaccagcctgggcaacatagggagaccccccctatctctgcaaaaaatataaaaattaaccggtgtgggggtatctccttgtaggcccagctacttgggaggctgagatgggaggattggcagatctgggaggtcaaggctgcaatgagccatgattgtgccactgcactccacctggcgtgacagagtgagaccttgtctcaaaaaaaaaaaagagaaaaagaaagacagtctatgcttttaaacattccctccacacttataaaccatagaacctgatttagaactttcatatctcactttgaatctctttaatgtttttgttttcaacccacaacacagccagttgagaaaatctatttgatctccatcttcaaaaacttaatccttaataagtaagattttttttagcatcagtaatgcactggtaaatgctgaacaaccagctcttcagaaggaaatcctgatttgtattgtttgccaatttctgtagtgtaaatactcctgtcatagctgttttcaaactaccaatgtgacatcactgagcaggaattgagaagacgagcaatattacattattagatagaatttccatggtacagacgcaatagatgtgaacaactcaagagcctagagagtaacatacagtaaaataattaggaaatggtgaggtttgagtacatattacctttatttttaatataatgtacttgattgtaagtctatgtaatttaatttttagtaacagctgtatttaataaccaccaaaattctttttttaaaatactttaagttctagggtacatgtgcacaatgtacagttttgttacataggtatacatgtgccgtgttggtgtgctgcacccattaactcgtcatttacattaggtatttctcctaatgctatccctccccctgctccctaccccatgacaggccctgggaagtgatgttccccgccctgtgcccaagtgttctcattgttcaattcccacctatgagtgagaatatgtggtgtttaataaccaccaaaattcttttttttttttttttgagacggagtcttgctctgtcgcccaggctggagtgcagtggcgtgaccttggctcactgcaagctctgcctcccgggttcatgccattctcctgcctcagcctcccaagtagctgggactacaggtgcccgtcaccacacccagctaattttttgtatttttagtagagatggggtttcaccgtgttagccaggatggtctcgatttcctgacctcgtgatccacccgcctcggcctcccaaagtgctaggattacaggcgtgagccaccacgcccggcctaataaccaccaaaattcttaaaagtagtcagtgcttgggagtcaatgcaaggttgctccaggcaccactgcacatactcctcttttctaaataattgaaatgatatttattaatccaattttcactatttaattctcatacataaagtaggaaaatctgtaagtaaagcactggaaaaaaggcaataccacctgaagagtggtatgatgtataaaaataaatgataaacctattaagagttttaaaatctactctgttttgcatacttatcattatgtgagtatattgaaataacataaaagataatcagtttcatttttagtattgatcacaattataaaccatggattttaattttaactttagctagctagctcataaatagcaaattatgtaagtaaaaatgaaattatttaaggtttgcataaactatgactgcgtgagtgctagagtgcaatattatctatcaaatgccttcaaaatgtactttctgttaaaacatctctgaaaggaagagagaaaagcaacaagcaacttttgatgaattatctgaaagagctcacataacatcccaccaagaaaaaatggcagatccccattagggcaaaaaaggcagttggaagtatgtaggttcacatctgggcagatgcgtcccaaaccacaaatgtgtgagctacagccagagagaacacactgacgtatgctgtagcttgcgcctcttctaccaccataggaaagaaagaactgccaaagatcccactcagacttctcaattctccagaattgatgccatgggaaaaccaggaggtaatgtggcagtggaaaccagacagatctgggtggaatcctgattttgcctaataccagttgcttgttttggggggcaagttacttaagttctttgaacctcagtttcccaaaatataaataggagaaaggaatatcttatcaagtgctattgaagacatacaaagtacttcacataacaagtggtagacagatgttatgaaaacacaaacaaccacacaacaacagcaaaaccaccttgggatatatgaagatgattttccttttttcctgcccacccagtcatcattagctactttgaagacagcaaagaagggttctaggctgttagattagctcttctggttttattcttaatatgactcaggttagagatcttctctttatctctttctttccttcctcctcttattcaacaaatattttttactgtgtcagaaactgtgcgaagctctaagcacacaatgtcatagtagaagtggtaacaacaatagctaacttttattaagcactgactgttgaacaaaagacatctaggccgggcgcggtggctcacgcctgtaatcccagcattttgggaggctgaggtgggcagatcacaaggtcagaagttcgagaccagcctggccaatatggtgaaaccccatctctactaaagatacaaaaaattagcaggtatggtggcacgtgcctgtaatcccagctactcgggaggctgaggcaggagaatcgcttgaacctgggaggcagaaattactacgagctgagatcatgccattgcactccagcctgggtgaaagggcgagactctgtctcaaaaaaaaaaaaaaaaaaaaaaagacatctatgtctgcctttacctaattgacagtctggtatatggaaacagatatttacataattgctcaggaccagaaatttcacatgtaacatattttgttatttttctcagtttttttgatacaggacactaagactctatgaaacctaaatgctggtaaaccaatttggaaccaaagctcaatactaagaggttaaattaaaacactaattttctttactttctgctgaataattttgcttaaatggttttggggggaaatacaaaacctatactgaataaagaagagattggtgaaaaatatgtggttagagaaagggagtaagaatattacagataaatgattcaggaataattaggatataattaattgaaagttaataatacaattgcaaggtagggtttaggctttttaacctataaaacaatttggattccttgaaatcagctgtcacctaagatagacaatggatgttttctttttcaactttacatttgttcctaatcttcccactttccaccaagtgacaacaaattttgtctcttagtgactgattcccagcctggaatctacaagtgtgataatggaagtctatgggccatttagtagctgaaaaacaccaacggatttaaatttacctgcaataaggctacacaaactaattcaaatgttatgtttctctgctttcatcagaaattgcatcaagttattgcaggaactagttatcttaggcagattagctattgatggcatcatggaatttgttgatgaaatatcattgtaaaagatggggcccatgttgcaggaggcattgttataagaggtccctggttctgaaaagcttaggctcccaagcttagttaagaaatgtgttatggcaggacccagtggctcatgcctgtagtcccagcacttagggaggctgaggcaggaggattgcttgagcccaagagttagagcctgggcaacacagtgagacctcatctcaaaaaaaaaaaaaaagtgtattatgtttaaaacaaaaagaacttggctagctaatccagcagtattctgcaggaataatttatgggaaaaaaaaaacacaaatttccatattaatgtacatttctctagagagaatagagtgttttgcaaacacatttgtatctcaaaaatgcatgtagttccataaaagaccattttaacagcctttatattttttaagggatgctattactagatgttgtatcttggacttctggagattgcatggaaaagttagaattgcattttgactttaacttacattcagggtttcaacggacattaaaaaggcaaaacacttagtgttcagcctcttttttagtgtgtttttctattcttaaggtgttgtctcacatgagatgttcttaaattgtccactgtaatctcaggcttttatattacacatctgcagaagccaaaaataatttgatgcatgacttttccccccagagtttcttattatatttactggtaaactattttggtaacttatattaacagagttataaagattaatatgtaatatgttctcatacagaattatgaaatttcatgttgcaaaacggaagtttaaggaaacattacgtccatatgatgtaaaagatgtcattgaacaatattctgctggtcatctggacatgttgtgtagaattaaaagccttcaaacacggtaagcaatggaaatgtcattccttgtaaaggaatgggcatagaacctatctaggaagaacttctctttagtagagtaaacctctgaactccatatttttcattcatttttagtgggcaaatggaatttgctttaaacattgattttattttgcttttaacatagatataactcaggcattcaaagcatccaactgtctcattttccttatctgtaaaaatgggaagaaagttagttcttgccttatagggttgtcatgaggattgaacaagttaatgcatgtaattcataacatgtaacaggcctggtactgtgtctaataaacatcaatggttgttgctgatgtttgaattattactgctgctgatcctaaattatctaaattccatttattatctaaattctaatcatcctttgggaataacgtactatttctccttcattaagtttcatccaaccatccaacctgtgaagacgggcctttctctgacctttatacagtagcagagtctactgcagagcacaagagcactcagaatctcggtgtgctgggccaaagttgagacttggcccttgtgttgtttcctggttgcaagtgtgttcaccttgctctggactaagactgaggtccttcattcatgtcctgtacggttctacaaatatactatcctcctagtagcatcttattgagtgattaaaagaaatgaattccacatgttaattccaaccacatatggttgattgtgattatctcaaagccaaaatattcagtaaattcagttttttaagagccttgctttattaccagcacaaattaccagcatttgtgattgtatagtgcccaaaatgcaaggactgagacttgaacttttttttatgccccccagcacacttagcccagtgtgaggcatataatgggcccttagtaaaatacctgttcatcaattgttatagaaataacaatttgttaattcatttagcaggtaattattgagcccatcatgtgtgccaggacctgtggacatccagagattgataaaataatgacccagaccttgtagagtttgcagtttagtaaattagatgtcatggcaggaagtgagtactgcctatgtttctcttcagacaaagtaaactggaaagttgtctatactcttgataattcaattctaaacacatacaaaaaaagaagaaagtgattctcatttaggctggtcaagttctcttggaaattgctttaattcattctgtaacatctgtaacatgaccagagattgtggtcatattgcaatctctgcctagatggccatggccttctaagttctttaataaaactgtctacagctcccaaggttttataaagttgaactgctacagaatttatagaaccaatcttgggtttctagctcatgtatcttctccaacttgaactccgaaagaaaaagaccatggctttcttatctgcttatctttcacacatgtacaatagatgctcatagaataatctgttctattaatgtaagatctctatagttatgatttttgtcatattttgaaatggttaaattcaggaactgcctgatcagaggtagaaacatattactttgtagtttaggacacttttacttccagaagatcacccataagtgatttcatcttggaccagaataatgagaaaattaatttcatgtgtaatctcatgttcaaataagcatatcaactggaacaagttctttcttatttcatcttacataaattgaagataactgtatttaatttttttttccaaaactcttcattctgacctagggcaatctccaccttcagccctcataatcagatctcctctttctctgatagtgttgatcaaattcttggaaaagggcaaatcacatcagataagaagagccgagagaaaataacagcagaacatgagaccacagacgatctcagtatgctcggtcgggtggtcaaggttgaaaaacaggtacaactcaactacgctgggtatctttttagccagaatttttttaatcaaaatttattataggcaattgtatgtattccagtgattattttaaaataaataaaatcacaaaaagagtgaataaaattaaattttctttgtgtgtagacagtgctctctgaaacactctggatttccctttaaggaatagaaaatctcatctcatcaattaatagttaattggaaacaactatagatttccaatagttgaaaatcgtttaaaaataacaaagatctattcttcatttgtgtttcagttgtttttattgtttcttttttaggtcattaatttttttttttttttttttgagacagagtctcactctattgcccaggctggagtgtagtggcatgctcccagctcactgcaacctccgcctcctgggttcaagtgattctcgtgcctcagcctcccaagtagatgggattacaggcatgcgccaccaagaccggcgaatttttgtatttttagtagagacaggtttcaccatgttggccaggcttgtctcaaactcctgacctcaagtgatccgcttgccttggcctcccaaagtgctgagattacaggcgtgagccatagcactctgcaggtcactccttttaaaagtaaaacaaggccgggtgtggtggctcatgcctgtagtcctaacacttttggaggccgaggcgggcagatcacaaggtcaggagttcaagaccaacctgaccaacatggtgaaaccctgtctctactaaaaataaaataaaataaaataaaataaaataaaataaaataaaatataaaataaataaaaataaaactttattataattctgatgacacattgaatgtttgttaacctcaagtctgttgcatcttcatatacaaagacaattttccagaaatcaaatggctcccccaatttaataaaaaatacttcatatattaattccggagcattttgtacctttatttttttatgtaactttaaattcagaatcacctagattgatgcttaaggtattggtttcattatagaataagttccttactagatttctgtagagtttcagaatgtcttcatagaggagacttaggaaagacaatctgacaggaatgggaagtctttttttttttttttttttcagacagggacttctctgtcacccaggctgaagtgcagtggcacaatcatggctcactgcagcctctacctcctgggctcagtcaatcctcccaactcagccttcctagcagctgggactatgggcatgcaccaccacacctggctgatttttgtattatttttggtagagacgaggtctcaccatgttgcccaggctggtctcaaactcctgggctcaattctcctgcctcagtttcccaaagtgctggcattacaggcatgagccactgcacccagcctggaatggaaagtcttaaagttgcatttttatagtgcttatatgacttttaagaggcactatttaaagaagtggtgggggagagatgctaataaagactgtatagaagccaaagtgtccctctcttcctaagtcctcctctggccccatcattgctaaatgttacattcactaagggtcaagactgcatcgtactttatattcaatatttctttaaatgtgttggcacaccttgacttcatttttcaaaattaaaaaatgaagtccattcttaataacagattatactcatgtgtaaccattttcctcacttctaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacattaaaaagatgtctataa

SEQ ID NO: 567 - DNA, 577003 bp, Homo sapiens; identical to SEQ ID NO: 566

SEQ ID NO: 568 - DNA, 577003 bp, Homo sapiens; identical to SEQ ID NO: 566

SEQ ID NO: 569 - DNA, 577003 bp, Homo sapiens; identical to SEQ ID NO: 566

SEQ ID NO: 570 - DNA, 577003 bp, Homo sapiens; identical to SEQ ID NO: 566

SEQ ID NO: 571 - DNA, 498224 bp, Homo sapiens
agggctgcagtcacggggcggcgcggagggccccagcccagtcaggggtgtggccgccgccaccgtaaggctaggccgcgagcttagtcctgggagccgcctccgtcgccgccgtcagagccgccctatcaggtgtgtttgcagccgaactggcagtgcccgcgggcggctgggccgaggccttggctcctacccgcgggggtcgggcgggctgaggctggagcaggccaggggcgggggcagagggggacggacttccagcatcgctcattcgggggcgtgacgggaggacctggctggggagcggcgggttgggagcctgtggctgccccttcggtgacagtggagtcaccgagcctagaaatggggaagctgtgacgtgggggtggtggagggtgctgcgggacagcagcgagcacggccctcagccgtccttcccaacacggtttcacttcccctcagctccagggctcagccccaagccgcccccttcatcccccatctgcaaacaatcctggtccccctgagcctccaatatgccttatgcagttcttttggggttcctttcgcattttaccgtgtactttcgcttttgatgcgtctagtttctgctactggactctcctagaatcgaagttccatgagggcaaagtcccatctgacttaggactcagagctactcaataagtaattgaatgagtacctatgccgtagaactgagtgaattaacaaatgagtaagtgaataaatgagtgcatacgagatacagctgaatcaatcagtgcatgagtgaaaataaagatgtatgaagtggaagcagtggagacgcaggcttacaactcctgttttttgatagctttccaaaaagttgtgtgaatgtcgcacttttgcaaatggaggcattctgattgggaccacttaaaaagagttctatgctgttcaaatggtctctggaaacgccccctggtatttccatttttgttggacttggctatatgtgtttgcttaaaacaaaatatgcctaggttttttcttgcttgtgttttgttcacttctactttggacgtttaaagaatcattgtcactataatattatttcatgtatttcttaaagataagggtgactctgaaggcagaaccatatgactctgacttgtttgtaaaaccaggcttttcttttgaattcagagttgttaagaatcttgtctgttttcctgagacaggtgctggctgatttgcaggtgactgaagaaggctacataaggcccagaaagacgcttatctgtttgtaaacaaataggcttagcacatagctttaatacagttggtcactgcagccgttcttacttgccaggtccaggttccagaagagctggatgaccttggacttgccacttgatctctttaggttttaatttcttaatctccaaaatgaagatgtttagctaggaaccctgcctgagttaaacctctgggattcttttgtatcagggttagaaggtgaaattacagatgatttcatggagttctgcttacttcacctcccatagcattttgtctctgctctcttctttgctgtttacagctcatttcctttcttctccacatctgcaacaagaaagcctgggagctcaagataagtgtaataaaccctaggctggtggggagaaaggagggtaagattttcttctacattgtcacaggctcctggtcctgggtctgacttttttccagtgcaacccagtctgacaatgccatatattcccagtatatctggggaactgcatcactatttcttcgcatgcatttgagattagttatcatagatcacattttggagctggaaggaccttggagattttttaaaggcacttcaaaagtcattatacatacatatttaaatatttttgcatgctacatttaacaaacacaaagttccaaatgtgttaagtaaaatgaaattaatgttacctacttcagtgaattcaagtttataaggagaagtggaatacacatgttgcttggtgaaaagggccaactttctcacactgttttcccaatgaggtcatgtgtcatacaggcatggaatgttacaaagctgatatttatggggcactgaccatacaccaggcactgttatatttaacctttttacttatattgccccatttaatcatcactatatatctaagagctagatactatggtaagtcctatttgatcttcttaactagaaacagtacatggaaaatgggagagttaggactcaaaactcaagcagatggaaacagggtttctcccagaaacaagacaatcctgccaggaaaaactgtgtgactttgaagaatgtggtctctgtgtgtgttcaagcatatatacaaaccctgggttatttgggtaaatgaatttagaatgagagcacagggtgaaatgatgaagactgaattataggggagttggttgttttatcattttgaaaattattgaattccattgagattccaggagactctgatactttgacctaggtgcccatgcatcttaattttaaatgtgttcagacttaccaatttagggaatataaaatgagtgacatcgacagctgccatcagtgaatggcacttaagggctttgaaccatgagtgctaagcagtgttgtttcttggactagctttgtgcccttggtaaggcactgcctcccaacctctttctttataagaccaacaacccctagtatagacaaagaacaatgcctacatctgtgtaatccagagacaagaatgcaggatgggtttccagaacccttataattaattgaagagagcaaaagacgaaaagagaggcccataaaataaatgggaaattattttgtttctttttcgtcagccaagtttagccccatggaaagcagagaccagttgtggccgcctgaaaaactaagagctgatgccagtttgatttagctcaggaggctgaaactttctgccccgaaggctggtgtgatggaatagaccttcccattgctcacaatattatgaaaaaaacattaaagcaacaatttttattacttgccctgcagctagagctttaaaatgtactttcttctcccctaccctccctaaaccacttagcttttaaaaacaaacaacccattcatgtgtttgttacagtcacattattagttctttctctttattcctgggcccttttctttaatgcagcaaagtatttggagggatgtacttgtggatctgtggaattttactttattttattcagaaaatattaatttcaataaccatttattgagtgtatactatgtgacaggtaaagatgaatgagaacaaatctaaataggagagtgacccatctgcaaacaattgcaccacagggtaatgtggaagtagtggccactcactcttccaggaaagaggtatgattggaactcaggaagactttgcagagaaggtgaattttgaactgtgttttaaagcctaaagaccaagcagagggagaagggtattccaagaatggagaacaacaagagcaaggaaaaggaggcaagtatgaacatggcattcttcaggagatgggagttcagtgtggctgtggtagggaggtgtggtaaggttagggccagacagtgatggtccttgaatgtcatgttatttaaactttatcacagtctagataatccttttcagcattatttttgttttgttttgttttgaggcaaggcctctctctgtcacccaggctggagtgccgtggcaagatctcactgcgacttccgcctcccggttcaagtgattctcctgcctcagcctcccaagtagctgggactacaggcacacaccactacagcctggctaatttttttatttttagtagagacgggactttgccatgtgggccaggttgatctcgaccttctggcttcaagctatctgcctgccttggcctcccaaagtgttgggattacaggcatgagccactgtgcctggctcttttcagcatttttaagctgaattttaaacagaggaatgatatgattggattttccttagaaaatagctacagtaataatgtttcagaagaattggggaaggaagagccagaaggccacaggaaaatgaagatgctattgccataggtctaatgaaataggataaggatctaaactaagataggtttgagagactatttgaagacagagcaggattaatgactagctggagctggatatgggaaatatgtttgaaaataatctgaggttttggaattgcttaactgggtgagtggagatgccactaatgagggtaagaaatataaggtgaggaagaagtttcgggagaaagacggtgagtgagcagaggtagctgtggaacatctgggtggagatcccaggatatagccttttctgtagctgtgctgtgatgtcacacagtcaagaccttggccaaacattacaatagggcctcagtctaaaaagacacatcaatttaataactcacttaaaaaatacatcatacttatctaatgaccattacattatatttcaggcaagttattagagaactctgattcttatgtaagtgccagtgaaggaaaaaagattggagactcaaacaatgaggagttattataagctgccaggagaaactgaaaaagagaaatacagaccagagtcattcaaaggaacaaagataaggaaatggcaggagtgttgcagaaagcagtggtttctgaagacacaggtataggcagatatgaaatacagagaagaaatttgagctggcgcttccaaataactgtacttctttaatggtaagatatcccaagctttgatttctcatcttattcagtttgtcaggaagagacaaacaggtgtgggtgctgggcagagggcttgatctcattttgcagagaaagtgtttggagactttgaactaagcaaagagtaacagggaaaataagataaaaatgaaaagggtaatgattcggagaaatttttcagagaatttaaggaattctatgacaaacaggtgttaaagaaaaaggcagatcaacgcagtgttctcttgatatagtggtattagacttccttggaaaaaagattcgcatagcgccttatatttaaaaagcaattttatatttgattgttacaagaacctaggaagcaggtgcagccaggcattattatctttcttttataaacttaaaatctggcatgaaggaggctgcagtttgtttcatggctcagacggctcagatcccatggctggcagggactcagagccttctgactttgggtccattgctttgtccattgtatcaacgccttgccttaccttggaaccttggccttctgcagtgtgcctccttcccttatcatatcatatcacataaatgtaaaagtaaagcagatggtatttgaagaccaaaagagccaagatctctggggagacaggcagtgatgtgaaaggatccttagcactgattatgctatatacaatagggatgttcatgaagagttgtgcatagagtgttatctacgtaaatcaaatgacactttcagtgcagtaggggagtccacaatatccaaagtgttatgattaaattttttatgaggcaaataatccctttataaaatgaacaatcagtcactccttgatatattatctgaataaatccagattttcaaatatggggttgacttaaagcaagatacatctctagtagcctacatctatatttatcatatatgaagatttttctgacttgggtattgaatatgaagatggggatctggagctggatcctctaattgttagagaccatttaaaatacaatggacatcatgacttgcagctaaatccattcagctacctttactgtttaccaagcacctaacaggtatgccattggatggggcaaaactcagctgggaaatggagagagaagcccagcactggcactgccttgagtctgacagttagaccacaagaaagtcataaatgtaaattcaccaatatagtgagccagggtaagaaaactagaaactcttatggtccttgaattctacatcagtattaaaatgaaaccaagtatatttcaaagcaaagactgttatattagacccagagttattctgtactgacaaaagataatctttgtaaggaagaagaggtagttgtgactctttatgcatcaaacatttaaaaatgcatatctttaaaacatgtaaaactaatgattagatctatgagaaataagcgaagctatttgtaggacactttagatctgttgttttacatgacaaatcaagtagacaaagtcaaatggtaatacacaagatttgaataatataactaatgaggttgaataatataatttatgagtgaatagggatatggaacatttaatagtatattttattattaatcaaaaaattatgttatgtatgaatatatatgtacatgatatatattgggatatatatggggtatatgtatgtatatatgtctccttttttgcattaataagttcttttttattttactgtaaattggcaaattatggttgtatatatttatgaaatacaaagtaatgttgatatatgtcataatacaaccttccatacaatgtggaatgattaaatcaagctaataaacatacccatcaccttaaatacttatcatttttgtggtgaaaatatttgaaatttgctctcttagcaattttgaaatatacaacacagtataattaactatagtcatcatgctgacaatataatctcaaaaaatttattcctcttgtttaattgaaactttgaaccctttggcattccccattttccccaacccctcagactttggtaagcaccattctactctacgcttcttagttctgttgtttagattccacgtagaagtgagatcatgtggtatttgtctttctgtgcctatgtctggcttattgcatttagcataatgtcctgcagcttcatccatgttgtcacaaatgacagaatttcctcatttttaaaggcagaatagtatttcattgtgcatatgtgccacctattctttagccatttatctgttgatggacacttcggttgattctataatttggctattgtgaatagtgctgcagtgaacatgggattgcatatgtctctttaatataattatttcaaatctttggctatgtacttagaagtgggattggtggatcatatgatagttctatctttagtttttttgaggaccctccatgaagttttctgtaatggctatactaatttacattcccatcaacaatgtataagagtttcctttacttcacattgtcaccagaatttttttttgtttgtttgagacggagtcttgctctatcgcccaagctggagtgcagtggcgccatctctgctcactgcaagctccgcctcccgggttcacgccattctcctgcctcagcctcctgagtagctgggactaccggcgcccgccaccatgcccggctaattttttttgtatttttactagagacggggtttcactttgttagccaggattgtctcgatctcctgacctcgtgatccgcccgcctcagcctcccaaagtactgggattacaggcgtgagccaccgcacccggccccagaattttgtttttgaggcaggatctggttcttttgctcaggctggagtacaggggcgtgatcttggctcactgcaacctctgcctcccaggctcaagccatcctccctcctcagcctcctaggtgactgggactacaggtgtgccactgggcctggctaatttttgtatatttgtagagaaggagtttcgccatgttgcccagactggtctcaaactcctgagctcaagcaatctactctccttggcctcccaaagtgctggattacaggagtgagccacagtgcctagtacatttgtcattttctgtctttttcataatagccattctaactggggtgagatagtctcattgcagttttgatttgcatttctttgataattaatgatgttgagcattttttaatatatctgttggccatttatatgtcttttgagaattgtctgttcaggctctttgtccattttttaatcaggttgcttgttttcttgctattgagttgtttgagttccttatacagttcatccttgagcaatgcggggcttagcggtgctgactccctctacagttgaaaattctagtataacttttgattcccccagaacttaactactaatagccaactgttgactggaagccttaccagtaacataaatagccaattaacacatattttgtatgttacatgtaatatatactatctgcttacaatagagtaaggtagagaaaagaaaattttattgagaaaatcctaagggagagaaaatatatttactatttattaagtggaagtgaatcaccataaaggtcttcactcttgtcatctttatgttgagtaggcggaggaggaggaggaagagaagggattggtcttgctgtcttaggggtggcagaggtggaagaagcgaggaggtgaaaggcgagggaggagaggcaggcccacttggtgtaactgtctggaaatacataataatttctgtatggctacttttctctttctaaaaatgttgtaaagtttatcttaaaatgtttctatacagtatcagtctttcttctgctatttgcattagcttcagtgcccatatcatagaagcgttcatgtcataaaagaagtcaaatgcagtcttaaataatcagaacgcttctgccagattgtctgatgttaatttgctttttggtacttttatatcctcctcatcatcataaggcactggttcagaagcactccgtcaagttgtcttctgtcaattcctctggtgtgtagtgtctattagctcttgaatttctccaagattcatatcttgacaccttcattcaccaccttttttcccactatatttacaatcgctttcattatttccttgaattggctttgtcataaaccctgtgaagtcatacacaacagctgggcacagttttctcctgcaggaacttattgttggcttgatggctttcacagctttttctataacaatgatggtgtcttcaatggggtaatccttctaggctttcatgatgttctctctatcggggttctctaacatagcactgacatcctttccatagagtactgtgtataatgagccttcaaggtccttatgatcccctaatctagaggatgattagagatgttgcgtttgggggcaagtaggacacttggatgtctttgatgttgaactcatggggttctaggtggccaggggcattgtctaatatgaaaataattttaaaaggcattcccttaccagcaagatactttctgacttcagagaaaaagcatcagtggaaccaatccagaaaaatagttcttgtttaagccaaaagactggtagctgatgtttatctttttccatcaaggcttggaggttagcagctttatagatgacagtcctgaccataaacctgactgcatttgcatgaaacagtagttagcctatgccttcctaccttaaatcttggtgctcacttctcttccttactaataaatgtcctttgtggctttttttttttttccagaatacagcatgttcagctgcattaaaaccctgtttaggcaggtatcctttctcctcaatgattttttaatggctttgcaatatagtttgatatcaggcagtgtgatgcctccagttttgtttgttttatttaagatcatcttggtgattttttttaattccctatgaattttagggttattttttctgtttccttttaaaatatactttctggccatttttctctctcttcgtcttctgaaattatgtgaagattagttcccttgactgtgattgtgtcacataattcttgtaggttttcttcatcttttccattcttttttctttttgctcctctgatgaataatttcaaatattctgtatttagctcattgattgtgctgcttaattgagtctgctgttgaagatttctattgcatttttcaattaagtcattgtattctttatctcttgggtttcttttttattgtttctacttcttctatattctcattttgtgtattgtttctcaaatttcatttaattttatatccatatattcttgtagttcactgaactgctttacaaggatttttctgaatcttttttctgccactttatagatcttcattttttagtctgttattggaactttgttagtttcttttgatgattacagatgctctttgacttacaatgggcttatgtcctattaaacccatagtaatttcaaaactttgtaagtaagaaatgtgtttaataccccagtaaaccaattgtaatgtcaaaaaattatgagttgaaccatcataagtgcagatgctccttgacttacaatggggttatatcctgataagtccgttgtaaagttgtatagttgtaagttgaaccatcataaattggggaccgtctatatttgtaatccttgtgttctagcattggtgtctgcacatttgaagagacagcttcctcctgagtgcagtggtataatgacagctcactgcagccttgacctcctgggctcataagattctcccacctcagcctcttgagtagttgggaccacaggtgtttgccaccatgcctggctactttttgtattttttgtagagaggggtttcaccatgttgtccaggctggtcttgaactcctgggctcaagtgatctacttaccttggcctcccaaaatgctggaataacaggcataagccactgcatccagccccaacagcttgctcttctggtctttacaggtattctttgtcagggattgacctttacttcttagtctaggctgtgattctagttgggtcaggtggtaatgaccccatgcaggcagagctcgctatagttggctgggtgctgcctttgctctgaggtctgatggggctgctggctcggctcccatgcttcggggagaccactggctgagctctgctataatttctgattggacaaggttgtagggtgtacttcctggctgggtggtactacttttttggttcaacagttgagcagggctgcaggctggactctgagtttaggtggagttgctgctcaggatggatggggtctggagtatatgctgcatagaactgcacagttgaggattgcctgtctctgggcagggccttagagtgggctctgagtctggattgagtcactctttggatttctgcgtcaggcaattccaacccctatgatccacagaaatgccctgtgatggtcatctccacatctcccgcctgggtaaggcattgaggtcgcctctgaggctggccgtctaaagactcaaagcaggctgaccttctcatcatgtttctgtgaacagtgaacttggctttgcaagtgagccataccattggctggtatctctgattgtgcaccaccactgggaggaacatagagccatcaccaaaatttgcacactggtccctgtgagctctgcctcctttctttgtttatacctaacccaggaggtctagccatgtcattactgccagtattccccatgaggtcagatgggagtgggctttctgggaagtgtctcagaatgctagggagctggatgtctagaaactctggttaccttttttttttttttactgtatgggcccagttaaaaagatcctcttggctgggcacagtggctcacgcctgtaatcccagcactttgggaggccgaggtgggtggatcacgaggtcaggagattgagaccatcctggcaaacatggtgaaaccccgtctctactaaaaatacaaaaattagctggacgtggtggtgtgcgtctgtaatcccagctactcaggaggctgaggcaggagaatcacttgaacccaggaggcagaggttgcagtgagctgagattgtgccactgcacttcagctggggcaacagagtgggactctgtctcaaaaaaaaatcctctctctgtgtgtcaccatgctgatctgggggagcaggaggggcagtgtagtcaacgtgagattgttcctcttctaatgtggtttttatttgattcagtggcctattcattcagctgtctccgtttctttctcaagtttgtaagttttcacaaaagtgttcttgtctttggattgttgcttgttggactttctgtagagggaagtgaagccaagtgaagcctgggacttcctattctgccatcttgctgatgtcatgcctacatgtttacagaaaattcacatcctcttataacatttatgagacattgtaaaaaacaaaacaaaacaacaacgacaacaaaacccaaaagccttaaatgaagactttagtgaattccagagtccttcttactcttactggccttgtgccttagccctctggtttagcccctgtttccagctagcttttaacaggttgagatgatgaaaagaaaacatacctctctcctttcataatgctgtgaagtagctcatataattcatcttccacgtttatatacgtatgtctcttttgtgcccagagcatcattttgagattcttttttcattatcaaaatacattggatctatgttattcataactaatctgaggctgtatttgttacatttgagtattttaaatcattaatgccatatgtattgtataccaaaatttaccatctaaaacacctggctattcttttgtagggtttttcttttcattagcttttttgagctaaagcttaaagaaaatcagggaccaaaggaaggttagaaagtggctggaggtatcataaacaccaactaagttctttgagaagcagaaggtgcatcatggaaatcagcattattctgacttcatttcattgcctactcagtccaaattttagggtttacaacttaaactaataactcactggcaccttgcatttcctgtggcttaatggttaagaacatgggctttgaagtcattgtcctgagttcaaatttgaggtctaccaccatcacctatgtgactttgggccaaacacatatactctttatacctccatttcttcatccataaaattgggataaaaattataactgtctgcagtgggcagaatactgtcttccctaccaccccctacggtgtccatatcttaatccctgaaactgtgcatgttagattacattgcaaaggggaattaaggttgcagatagaattaacattattaatcatctggccttaaaataggaaattatgctggattatcctggtgggcccaatgtaatcacaaaggtctttaaaagtggaagagtgaagcagaagaagtcagagagttaggaagatgtgattatggaagaatgttcaaagagagacagtgccactggctttgaagatggaggaagggggccatgagccaaggaatgtgggtggccacgagccaaggaatgtgggtggccactagaaactgaggaaagcaaggaaatagattctctcctaaagcttccagaaagggatgcagtcctgccgataccttgcttttacgtgatgcatacagtgtcagacttctgacctaaagaactgcaaaataataaatttgtattcagataccaaatttgtggtattttgttacagcagaaataggaaataaatgcaccgccatatggggttgttgtaagggttaggaaatgtaaacctttaagatagacctgccacatggtaaatgctcagttagtattagccactattattatccattggtactttagtttcccttctgtctttgctcttttgtggtagttgtcttgtaattacccaaatttgtggttatcttccctacaaagactatggccctaggtgtttttcactctcattttagtctatactcagcctccagtaatttgtcaaaattaccatttcagagttcctaccattttgtggttccagcagcttctgttccaggtgagtagatcttggctgtgactctctggatttgcctgtctctccagattttagggtggtagtttgccctgcaacttcagttctgtggggcatccaaggaaagtcgctggttttcactttgttttgtttcattattgtaaggacatgagtgctgacttccgagttctttacatgttggtactgaaattggaagtgtgggcagtgctctttaccctacggctttaataatctttctatacacatgagatcttcatctctacactttacttctttctgatttccattatctggttttcacttcattcatttcatttccaaacatgctttttctgtattttctatttaggttagtggcatctcaatccaagggatagtagttaatttgatgtgtctgaaatacagggtacaaaacaggctcatagtcggggagattgcccttaactctccacctttcctgaatccttttcttcagaattagtaagtcgccaagggctgttgtgtctatgaattttgcccacatccttgctgtcattacgctagtcctaactcttgactcggccatgcagaatattttaaaccactttatcctctacactgcctcagagttagatcataagttggatcatgttacttcctctctcagaagacctacattttgaaaaattgcttgtggaataaatcccaaactcctaatttggcatttaaggttcttaaagatctgtaattaaggtatatttctaggtggattcatagtgcatgtacctactgtatttgctagtgctaccacaacaaaatcctgcagactgggtaggttaaacaacagaaatgaattttctcatggttgtgggggctggaagtccaagatcaaagtgtctgcatgtttggtttcttctgaggcctctctttttggcttgcacgtggccatcttttctcgaggtacttacatagtcttctctctgtgcatgcacacccctgatatcgctctgtgtattccagtttcctcttcttatatggacaccagtcagattcttttagggcccaccctgatagtctcattttaccttaacacctctttcaaagccccattttcaaatagtcacagtccaaagccctgggggttagggctttaacgtatgaattttggggaacacaatttagcccataacaccgactgtatccctctatgtattctgtactcatgaatgtataatggatcacctaggaagatttagaaaatactgatttgggggtctcacccaacttcttgtaggttctgaatcagtaggtctgaaatggggctgagaatacatttggtgtgtgtgtgtgtgtgtgtgtgtgtgtttatacttctccctagtgctttcccagctttcctagactctttaacattattggtgaacatactataaatgttcatacctttgctcatatttgttttttaactgaaaattctcttcctaccatacctatgaaatttaatatctatgaaaattaattcagccttctaggctgatctgaaatatcatcttttctgttatctttttcttattctctccagagataatcctgcaatactttgttgtgattttattttactttatataagtactgaagaatttattttgttttatatgatagtcatttgccttcttctttcactagctttctgagaccaaagaggacatattctttatttctgtatatatgaaacagtggcagttgctctgaacatagtagataattaatcaatctttgcagtgtgaaaaatgaactagttaagaaatgctaatatttttattgtgactttttataaaatggagatcattgggtaaaaaatgaacatatcaaatgtaaaacaagtggcagacttttttttaaaaaagactttacttttttttgaaaagcagttttagattgagaaggtgtagaaatatcccatacactacctgcccctcacatgtgcattccctaccagagtggtacattcgttgcaattgatgaacccatatagacatatcatcatcgcccaaagcccatggtttgtattagcgttcactcttggtggtgtgctttctatgggtttggattgccctaaaaatcccctgtactctacttgttcatccctcccttcccctcactcctggcaactactgatcttttctctgtgttcgtagttttgccctttccaagatgtcatatagttggaatcatacagtatgtagtcttttcagattcgcttctttcactgagtaatatgcatttacttctcctccctgtctctttatggcttgatagcacatttctttttagctctgaataatattccattgtctgggtgtgctacagtttatttatccgttcacctactgaagatcatcttggttgcttccaaattttggcaattatgaataaagctgctctttacatccatgtgcaggtttttgtgtttacatgttttcaatccttttgggaaaatattaaagaatgccattgctggattgtatgttaagagtatgtttagttttttaagaaactgtcaaactattttccaaagtgggtgcaccattttacattctcaccagcaatgagtgagcattcctgttgctccacatcctcaccagcatttggtgttgtcagtattatggttttgggccattctgctaggtctgtagtggtatcttgttttcttttccatttccctgcttacatatgatgtgaagtatcttttcacatgtttattttccactttatatcttctttggtaaggtgtctgttaaggtctttgggtcattttttaattgggttgtttgttttcttgttgctgagtttttaagagttctttgtatattttggataatagtccttatatttaatatgtcttttgcaagagtggcagaatttttgttcattatttttttcttgaattaaatatccttaacattacacataaacagtatttttaatgtgtattttcaatttggaacttttaacatttaaaaatttctcttgatgaagatatgtgataataaaatggggggcaaagtgaagacattgtaacaatttttgataatcgcatcttcttctgcattgcatttttcagggcagagtattaatggtccagttcttaaagataaatggattcctcaatgtttatttgtagtatatccttgtttattctcctaatgaagaactgcatccttaaagctggcataattaggtagacttgtctattagctgagctactaagctttattttcctgggccaatgaataacagaaacaattctcaaaataattaaatctgttaagacccagttttggggtaaggagctggggtctggcatttcctttttgttggtttttcaaaaattattaaaacttcaatgcttggccaggtgtggtggctcatgcatacaatcccagcactttgagtggcaggcagatcgcttgagcccgggagttcaacactaacctgggcaacatggcaaaacctcaactgtacaaaaaatatgagaattagttgggtgtggtgtggcactcctgtggtcccagctacttgagaggctgaggcggcaggattacctgagccctgtaagggtgaggctgcagtgagccaagatcgcaccagcactccagcctgagctacagagcaaagccctgtctcaaacaaaacaaaacaaaatctcaacgttaaactttctagagaatgggtaatcacctttcaagtcatttttccaaacccatttctgaaccaggacaggcaataacagagattggcaggggaaggactgatgtctcctcacaagggaaaaaggactctgcattgaaaacacagatgagcctttggatgtggaaatttacaaggctcagagagccccgaaacatcttcagaagtggagcccagcagaataatgggaggctgtgtgctggcttggcactggagactgtctggcacaaactacactgtaaacaactcctcaaacattttcatctgcatacatgacattagattctccaaatgtccaattaaacacttgtcaatggaagaaatgtttgtttcctcagctgacctgttgtcagccttggccttcctgatggggaagcagtttcagctgatactgttgtatgctcttcctttctgggcctgatcttgtccctgttgagaactgtggagactgtgccaagctgtggaccatgggattaggttaggtaactaaagaaaatatccaggctgtgagcacttttcaaacctaagaaaatctttagtttcttttgcacagttgtaaaccgtttgtgcttaaaaaattataaaagtgattgcagttgagatagagaaaagagcagtgctgatatgtgtttatatacttctaagggctgacttcatttttttcaacatcttaaacttctattgaacaaatattgtgtgtgtaggtgtgtgtttgtgtgtgtgtgtgtcatcatctctgttgacagaaatgctcaatgataagtctctgtgactggaagagcagtgaaggacttggacacatgctgtagaaacataaaggaagtgaggaaggcaatattggagaagaatcaaaggagtttaaattattctttggaaaagttggagtttataaattaaaaaaaaactgtatgaccttgagcaaatttctatttttactagtgtcagtttcctaatccataaaatagggaatataatgtcaagaacatcgaaggttattattaaaattaaataaaatgatctatgtaaaatgcagcaacacttgccacattgtaaattctcaagaaatgctagctaatattgaaatatgaaataatacttctttggtccaaagatgtttaagcattcctatttggtaaagagaaggagcaaaagaacaagagaaaaattagataattggtacagtatgaacagagtatttggctttggaaaggagggtgggcagttctttcactgggacaggagctcagaatgactctataggtaaagggatagaagaactttaaggtgaggatgaagaaagacaaagcatgtcatggtcattctattgtctcttcagttacgtagaagaggagagctttttctgagcatgagggggaataggagtgaaatttgaggcttaaagagaatggaaaagtttcatagcagctgctgtggagaatttgatacgtgtcaactgaagataaatataagggttgtgcagcaatgcagaggatatggctgaggtcagacagccttagtttatagtggcatgattttgggaatgtagatgatggcattatgtaccctggagcaaacacagagaaaattcaaaattacctttgaggaataagaaaggaggtgaggagtaagggtaaaggcgtcctaaggtgctaatgaaaatgctgttgaaatcattaaccaccaagtaaagttgtgagccaagattaatctgaaatggtgatttgtgtggatagaagtacaaatagactggaggtggggaggcccttcactggacaggcaacattaatctagctgccattgtaccgcacacatgctgaatgatgatgatacaggaatgaaggaaacataattcacttgggcagctcaagagcatttttttaagctcttagtatatactggctagatcatccatatgacagcaatgcttcccttgaaaagctttaagtctagtgatatgctctggataatttaaactcagactgtggggtactttgaaggaggtaagcagagggtccgaggaaacaatagaagaggacattcaacatgacctgtgaaaagaaagggcaggtcagtaaaagtatcctggaaaatatcttgcttgagctgaatcgattgtagagagccagggtaaagaatggcagaaagggagaggcaaaagcaagggagaaaaagcaaggaaaaaacagagcaagggagtgatttggctagggcagacaaaagatttcagagaagggataattaagatgagttacatatgatactattactaagtgagagaaataaggaagacatgaatgaaagtgataaacaatgtgttggtaggaacagaagaaagaatgtcaagagaacagaatgatgagatttaatgactgattgaatacgtggggaatgaatgggtgattttacactcttgatcctgaattatagggacaattatggtttccttaacagaaagagggaaatcccgagttagggaagatttaggggaaggtgatgagtttggagatgttgaatcagaacatatggtttcaagtgaaagtaattcaaccaagatgggattaaaccaaatgagagaatttgtgatgttcataattagtaagttcataggtgcttctggatttaggcatacctggctctccagggttcaaatatgatatgggcttatctctattcctatgatctctgtctcttagattagcttgtcttgcttgttttcattccaaagacaggctctcagtatatggtaggcaaatgggtacctccaggttcacattccagcgatcccggtggaaataacttttatttgcaacatccatatattttaaatgtaggttttattattattcagatatggtgaggccaggagattaggagaaaattgccaatggaaaatataatttgttactcatatctcctatgatatgggggcacacaatgacatgcagaccacacagggaagcaccagggtcagttaggaagcagaaggagtgagggaaagagcctttattgtggggtttgtgggaaggaatggatgagtcaaagcaagtaggcttaggtttggctagtttgaatgattttcgtgggctctgggttgtagagttctttagcaagacgtctggtacctagccctgtggttataaaggcaggagaatattggctaggtgtatgaggatttgataagggaggtcatgctggtgggatgggctttggattggctagtttctgtatgaaaggcatgcttacaggggtgttatttgctatcactagcaattagctaatgctgtgagggacagtccctcctggtccattgagtccctggatgccagaacattaagaatacagaaaataagagaatatagttaatacattgtataccaacgccaggaaagattctgatttgccttacttgagtcattccagctctgtagtttaggtgcagagtacagggtgaggaatggtattgtgattgacagtcaacctagaccagagtgtagggatcagggaggactaccctaaagaaaataaagccagaacatgggaaagtatgctggtaaatcaaaaactgtatcgactggtctatcacaaggtggctagagccgtcttggttgagatgaccaggtggccattcaaatatggctcttggcctctagacttcgaagaggctaaggatttttatttttgttttagcagctctcgtacaccatgtattgctcccgggcttgatggccctcttctgtcctgcttttctaaagcctatatagttcctgagctcagtgttaaaaaccaaactggagttttaggcatcatttaggttttctgattctcttggtgaggtaccagtgttttcctcaatgcctacctcagaaaccttagctttgactcccttcctttcccttctatcaagtcatttatcttcttctgaaatagctcccagatttacttcttccttactcatattagctgttgcctttctagtctctcttttttaatacggctttctgaatattgccagagttatctcactggggaaacatcatccccacttctcccacaaaaaaatctaccccgccatttggacattacagagagtaaatggtgtgtacatattacatgggtgagtgtctgaagacctagattcaagtcacttcacgttcctcctctgcattttattaaagatatttggtagcttacataagaaaatgcatgttttaaaactttttataaatcataatgtagttcagatgatggtgattttttgatttctctaattttgaaattctaattttcaggcttatctttttctttttttttttttttttgagaaagtctcacactgtcacctgggctgaagtgcagtggcacgatctcggctcactgcaacctccgcctcccgggttcaagcaattctgctgcctcagcctcccatgtagctgggattacaggtgtgtgccaccacgcctggctaatttttttatatttctagtagagacagggtttcactatgttggccaggctgatctcaaactcctgacctcgtgatctgcccgcctcggcttcccaaagtgctaggattacaggtgtgagccaccgcacctggccttatctccttttctaaatgaacctctccgtcgccacacttaggccaagtttgtttctatctttatatctttctatattgttcccaacccgaaatccccttctttgctctactgtctgccaactaaatattagctatccttcaaagtgtgtctgaagtcctgtctcttatatgaagtcttgtctaattatctagatcacctgtattctctatttttcttacacttcaatttcactactgattatttacctttaattattatatatcttttattctccacaatatgtttgatgcttctgagggcagggatcctgacttttacttattttgtatcatggacagttctgggcataaatttaaaaaaaagttgctaatgattaattattaattggggaaaagtactaatttgcaataatcacactttggatatagtttgtgagcttcccttttcctcatggggagaaataagtttggattgattggactgacagatgttgaaacaatttggttcagttagacaaattcttattgagttctaggacatatgggtaactgctgaataaatattcatttgttcatttattcagtcaacaaatatttattggatatccattgtctgccccacactgtgcaagttaccataatatatgtctgcaatcagacatttagatattgaaaatctaaacatgaatcttacatggttctcatcttcaatttgctttattacatgaccaaggatgagatcattgggtgattataaagcattgcagaaaagtaaatgatatgcttgtggacatttgaagaagggagtaatttattctgactcgggtagctcagaagaggattcaaagagaccatattcaggaaaaaatgaaacatgtagaaaggaaatattaacactcatgtttgctttgtgaaaattttgcattttacacagtgtgttgttaaaaattaacgtgttggagagtttccatttccaggaagatggagtaaatgtagtttttcctatttgtctcctaagtgcaactaaaaacccttgacattatatatataaaacaaatataagaagactctgaaaggtggagagaataaggcaaaccagctggagacctcaggacctgaggaatgacacattactgagttccctgggtttttctttttgccttgtatatctcagacttagagctgaacaaatgggtaacttggagatgccaatggtgcagacaaaaaaaaaaaatctccagcaaaagcctgttttctctaacaaaggacccaaaaagggataatccagcaaaacaaaacttttaaaaagtaaccactctattgcaaacaaacagaaaaaattgtggccccacccttatgtattcagcaaagactgagtggatatcttagatgtctactctaataaggctgtgatgaggtatctgaatatccctgccagggtagggtcagagaagaccaagtagaggtactttccttcccatcaaccagtaatgagcctcctgctgcccccaccacatccccacttgtgatgtcagcggggatcttggacttgtggcctaattgacaataatgcacctctcccttgccctgctggcatgatgtcagaggagatctagtggacttttaccgtttcccagaagtattgaggccatcttaccacagtgtcagtggataccacatggaggatctacaactctcactttcactcagaatgtatgaggagaccctgcccctccttgagtgtcaatggaacctggacttgtacctctatctggcattgatgaggcagtgacacctcccactctccattgcccctgcagtagtgtcagagaaatccaactaaaatggatgtggagtctcataacataatataaatatctgggtttcaattgaaaattacttgtcacagaaagacaggaggaaaaaaaacctagagaaacaaaaaacagagaagaaaaatagaaaataagaaataaaattgtggacaagttctaatatatcaacaattacattaaatgttaatggcgtaaatgtaacaatttaaaacagattgccagaatggattgaaaaacatgatcaactctatgctatgtacaagaaacttacttcatatgtaaacatataggcaatttggaaaggagagaaaaacatatgtaattgattcttgttaatcatggtagttatgttctgtaaaactgctgtgaatgctgaatttgtaaatactaaactgctgttcctaggggaaatacagagctagattcctgcaagcctctggtcacatttttctcaactggtcaatgaataattttattttatgtgttctgtttaaagacaccttactgagtatatattatcgattcattaactttgaactcattgccaagagctctagaactcatatctgaacaaagcttatcgcacacacatgttttctctgtaaggtacatcagagctttcatttgcttaggaacaatagggctttagtactatgcttgaggccattttaaacagtaaaatcaccaacaaaaagtacaaacatatcaaaaccgtggcactaaataaactgtgagaacagttgtttacagcatgagagctaaaacaagaaggcaaagtatttacttgtttgacctaggctaggaacatgtgtatggagtgactcaatttttttttttttttttttttttttttggctgtactgcacttgtgcacaaatgactgcaaaagcaatgcaagtatgattttggggttacaaataaattttagtgagtaggcaaattagcaaatatggaatccacaaataatgaggatagatggtgtcatgcaaagatcaatcaaaggaaagcagatatattaatatcagataaagtagacttcagatgaaagaaaattaacagagacagacattatctaatgataaaagccttatgctaatgtttataacagctttatttgtaatagccaaaatggaaagaatccagttgtccttaaattgatgaatggttaaacaaactgtgatatatccatactatggaatactactcagcaataaagaggaaaagattatttatataggcaatgacctggaagaatctttagggaattctgctgagaaaaaaatcaatcataaaggttatatacacgtttctatttatataacaatctttaaatgacagaattatagaaatgaacaacaaattagtggttgccaggatttaaggagtttgggtgggggtgggagtagagggatgcgtgggtgtagctgtaaaagagcaacaggacggacggatccttgtggtgatagacatgctctatgtctggactgtctcaatggcagtatcctgcttctgataaagtactgtagttttgtaggatgctgcactggggaaactggggaaagtttacataggatctctctgtattctttcttataactcaatgtgaatctacagtgatcccaacataaaaactgtaatttaaaaaacttagcgtactttactgtatgtagctcctttccttgtacttgataaccttaagtctttttgtcaaccagtgatacactggtctacaaatatttattttgaattcctgcttcgttctcagcattatggtggctggaactattaggaatacaattacagaagcataagatttagagtacatataaaaaagcgtgtgtgtgtgtaaagcatatgcaagtatgtctgagagagtaaacataattctcatctttcaaaattttagtgttccactgtaaattgtaaaagctatagtgtaaagtagcatttgtaatcctattcagctcttaacttgccaagaatatcctctcaggatgtgttgcttcactacagtaccaaccattgtgttgtcaaatccatgtgaattatgcaaaacaaaagaaaaacaaatggcctacctaaggtttggcagctgcaacaaggaaactatcaatttgaggtttattgtaatacattaaatttgaaagaatattcttccaagtaattctagggcttggaatgaatgaaggatcatttgaaaaatctgcaactcatttctaaaagattaggaaaaaagagaaaagaacatagttgccaacttctccttggtttgtatttatggaatatatgaaggtttagcattttagattctttcctaattctcagttaatttacctgtagaatctctttgaagaactacttttacatttctttcattttgatgagaaaattgaaaacttggggcaactaaaaagaagtgtttagcttgagtgatagttcattaatatgatttttaggggcctggcagaaacaaatagatcctagcaggtcttgtgatttagaggattattagagatttgggtgaaatagataagtatttctcctttgatagaatcagataattgtctctctgtgcaatgtccaacaccagctttctatgtaataaaaataaactatgaaaacaaacaggaggcaaaaataaagcttcatgggcttcttaaactgtttgtgaaagttgttgttctagagatcataaggtagggagttaataaatactttgttccttgacagggctaccccattgtaccactccaaaaccatgggaatggtgtcctgtgaggttgtatagtacacagtcagccttgttctgtgcagcatccctgggacctgccatgtactagacactgttctaggtactggggatatagcagtgaacaaaacagatgagaaatatccctgccttgatggaatttccattctagactggaaattgagacaatgagccaaatggataaattaattttatagcatgcttggaggtggcatattctatgccaaaaaataaagcaaaggagttggaaaacaattgctaggattggggagttgtttcagttttaaatagggtggtcagatcacttgagtgcaggagttcgagaccagcctggccaagatggcgaaaccccatctctactaaaaatacaaaaattagctgggcttggtggtgcgtgcctgtaatcctagatactctggaggctgaggcatgaaaattcctttaacttgggaggcagaggctgcagtgagctgagcttgcatcactttactccagcctgggagacagagcaagactctgtctcaatttaaaaaaaatggggtggtcaaggagtgcttctttgagaagtgaatgttgtttctttaaaatttttttttaaaatgttagattcagggggtacatgtgtgggtttgttacatgcatatagtgtttaatggtgaggtttgggcttcaagcatagccatcacccaaatagcaaacattttcaaccaagatgaaggtgtactgttcactctgggtaagagtgtgccaggcagaaggaacagttactaccaaggtactgaggtgggaatattgcccttcagcaaagaggctagagtgactggagcagagaaggggaatggtagatgttaccagtggagtcttgactaggagtcatccaggttcttggcagtttgaacaaagaattggacaaaacacacacaaagcaatgaaagaatgcagcaacggaagtacagatttattgacgtgaaagtacactccacagaatgagagtggacttgggcaagcagctcaggagcagtggttacagaattttctggggtttaaataccatctagaggtttcccattggttacttggttacatcctacataaatgaggtagtgggccatgaccagtctgattagtcgcctttcatgatcagtcagagactgaagtggttacaaagttacacccctatgcaaatgaagactaggcctgtgaccagcctgattggtggtgggaggggacaaatcagaggtactttccatttttcatctgataccggaaggggtgtgttgtaaagggagtagcctctgatacttttgttacatgggcttggaaagttggggttttccttatgatttagttctaggaagtcagtgtgaattggccttagggtccctgcctcctggcgctattctcctgcctcagtagagatgagatctgaacataagatgggacttgtgggacatccataagacttcagcttttattctgagcaagatagggtgcaatctgagggctctaagctgggaggtgacattagctgactagatagctgtgggtagtgtgaacactatattgtctggctagttgggaagtggctcaaatatcatattgaataaatcgcaataaaatgctaaagttggagctgtaactgaggaaaatggtggttagaaaagagaaatgaaaaacaaataaacccgtgacaagacttttctattacttgtaagaaagtggaagtggaggaggggggatactgtcttgtaataaaaacttagtcttatttctaaaaagtaattgttcaactagaagcaacaaaactaatcatagggaatctgttttagtaggtaatgcagtatgtcaaccatttttagagtatctcaaaattttcaacattggcaaaatacccaaagctggcattacagcttggattcttcccagtggaaaaccaagttggacacaaagttctgaagaggaaaggagtctgagaaatagaaagaactgagatgcgtgtatttcctgaaccttttttccccctgtccttaatgatgttgtggttaaaacacttttgtgggtttattgagactgataaatacgctcatttacatctcattaatgtcaaattgatgtggctgaatagcatagtttggtagtctctaatgtgtgagacttcatgacttaagtaaacttttctattactctgaattagtgtcaccaagggcataggttttttaaagaaatgcttgtagagactttaaaataatgaaaaatattcaacacacctggctaagagtgattgtattacattcctgtttctttagataaaggtctgtcagcacatccattacaggcacatcttttcaggttgaaacttggcatagcagttctaaagaggaaagagattcaaacaaaatgtgaacaaaatgtttcttttgcttgaagaagacattcccttcataccctgatgcagctacatcccataaaactttgagaatcttattttcgttttgtttttggtaaaataagaagcgcctttgaaaaacagtttatctttggacacgaaggtaaagaaaaaccttttgatgtttggcaacagatttgcttaagaacaaaaatgatttaaaggactttttgaaaagagttagtgttgtctatttttattttctcagacagaccataatcacaatgactattgaaacaccgatacccttaagggctaaatttatcccgcctgtccctggaacaaaacaagaatatccacaaacatgacaccctctttggcagaatagacactaagtgcatatttgttgagaattgagaagatgcataagtcagagaaaagaaattatatttaaaaaggctttacaaatttttagtttttgaggtaatatatacaagtggaacacaactcaaaaagagtatgtagtgaaatgtaagtttccttcttcctccttgctctaagccaccactgggttaccctccacagagacaagcactgttatcagtgtcttatgtgtcatttaagagagcatattcttttttctttttagttaattggtagctttacattttattctgcaccttgctttgttctcctgacatttcattttggaggctgttcaatatatgtatgtagagagctacttctactgcattctttttaattagcttcatgttctaattggtacgttacatgtaccaatacacatagatgtaccatgatttacttagtctatacataaacatttaaactattcctaacttttcctattacaaacagtgtaacacaacatcctcgtgcacagatcattttgtgtgagtgtatctgcaggataatttctagaagaggaatatttatgttaaaagtatatgcatgtatgtagactcttctccatagaaattgtacacgcccagcagcaatatggaagtgtgcctatttctccattccctttccatcacaatgtatatcaaaaacttagtaatgtgatggaggggaacagcactctgttttagtttgtgtttttatcatgagtaatgttgagcatctttttataagtttaagaatcatttgtattttctatgaactgtttatatattttcttgcttttagaaaatattattgatccttttcttattgatatgtgaaaactcttttttaaaataagtgttttctcaacacacactagtgcatttttggtgtatgtaagttccaattggctttttatcataccaaaaatgtttattttttcctatttttatagattaataataattgtacatacttatggagtatgtgtgatattttgatacatgcatacaatgtgtaacaatcaaattgggatatttaggatatctattacctcaaacatttatcatttctttgctttgggaacatttcaattcttttagcaattttgaaataataaattattattactatgtcaccttactatgctgtccaacactaggacttattccttctacgtttctgtatataaccaatctctcttcatccctcccactgcctcacacccttcccagtttctggtaaccatcattctactctctatctccatgagataaacttttttagctaccacatgtaagtaagagcgtgcaatattttttctttatgtgaatttattcctgggttttctattctattccattggtctatgtgcctgacttatttcacttaacataacgacctccatttccatccatgttgctgcaaatgacagtatatcattcttttttatggctgagtagtattccattgtgtatatatatgccacattttctttatccagtcttctgttgatagacacttgggatgattgcatatcttggttattgtgaatagtgctacaataaacatgaaaatgtaggtatcccttcgatatactgatttctttgttttgtatttgcttttttaaaagtaatttttatttcaatagtttttggggtgcagttggtgtttggctacatggataggctgtttagtggtgatttctgagattttggtgtacccatcacccaagtagtgttcactgtacccaatatgaagtcttttatccctcatcccctttccaaccttccctactgagtccccaaagtccagtatatcattcttatgcctttgcatcctcatagcttagctcccacttataaatgaggacatacaatactggttttccattcctgagttattttacttagaataatggcctccagctccatctaacttgctgcaaagacctgattttgttcatttttatggctgagtagtattccatggtctgtatctaccacattttctttatttacttgttgtttgatgggcactttggttggttccatatctttgcaattgcaaattgtgctgctgtaaaaatgcatatgcatgtgtctttttcctacgtgacttcttttcctcttggtagatattcagtagcgggattgctggatcaaatggtagttctactttttgttctttaaggaatctccatactgttttccacagtggttgtaccagtttacattcccaccaacagttctaaaaatgttcccttttcaccacatacacaccaacatttattgttctttgaatttttaattatggtcattcttgcaggagtaaggtggtatctcattgtggttttgatttgcatttccctgatcattagtgatgttgagcatctttgcatgtgtttggtggctgtttgtatgtcttcttttgaaaattgtctatatgtcctttgtgcactttttgatgggatttggattttttttgatggtttgtttgagttccttttagattctgtatattagtcctttgtcagatgcatagtttgtgaatattttctcccattctgtgggttgtctgtttgctctgctgattatttcttttgctgtgcagaagctttttagtttaattgggtcccatttatttatttttgtttttgttacatttgcttttgcagtcttattcatgaattctttgcctaagccaatgtctagaataagttttccaatgttatcttctagaatatttatggtttcaggtcttaggtttaagtttttgatccatttgaggtgatttttatataatgtgagaaatgaggatccagtttcattcttctacatgtgacttgccagttttctcagcaccatttgttgaatagggtgccctttcctcaatttatgtttttgtatgctttgttgcggatcagcacttacttaatatatttggctttctttctgggttctctattctgttccgtcggtctacatgcctatttttatacccctaccctgctgttttagtaactatagccttgtaggataatttgaagttgggtaatgggatgcttccagatttgttctttttgcttatcttgcgttagctgtgaggccccttttttggttccatgtgaattttaggattattttttctaattctgtgaagaatgatgatggtattttgatgggaattgcattgaatccgtatattgctttgggcagtatggtcgttttcacaatattggttccacctatccatgagcatgggatgtgtttttatttgtttgtgtcatctatgatttctttcatcagtgttttgcagttttccttgtagagatcttttacctctttggttgatatactgatttcctttcctttggataaacacccaatagtgggattgctggagtgtatagtagttatatttttagctttttgagaaacctccatgatgtgtttcatcatggctgcactaatttagattcccaccaacagtatataagcgttcccttttctttgcatccttgccagcatttgttattttatgtccttttgaaaatagccattccaactagggtgagctatcttttatttgcatttccttcatgattagtgatgcaaagcattttttcatatacatgttttccacttgtgtatcttattttaagaaatgtctcttcagaccctttgcccactttttaatgggattatttgggcttttttttttttttttagctgttgagttgtttgatttcctgttatgttctggatattagttccttgttggataaatagtccgcaaatattttctctcatactgcaggttgtctcttcactctgttgattgttttctttgttctgcagaagatgtttagtttactgtgaccccgtttgtctatttttgtttttgttgcctgtttttgaagtcttagccataaaaatctaatgtcctgaattgcttctcctatgtattcttctagtagttttatacttttgggtcttatgttttagtatttaatccgttttgagtttatttttgtatatgtagtaggggtctactctcattcttctgcatggatattcagttttcccatttgttgaagaactgaatgctttttctatgtctactgagatgattcatatggtctttgtccctcattctgttgatgtgatgtatcatatttattgttggtgttgaacaatccttgcatccctgggataaattccacttgattgtggtgtattgtctttttaatgtgttgttggatttggttagctagtattttgttgagaatttttgcatctgtgttcatcagggatattggcttttagttttctttttattttttagtgtgtccttgtcttgttttgatttcagggtaattttggcctcatagaatgaattaggaataattccctcttctccaatttttttgaatagtttgagaagaatttttgttagttcttcttcatgagtttagtagaattcagcagtaaagccatctgctcctggtcttttcttaacttgagacattttattaatgattattactaatttttattctgctcaggctttctgtttcttcctggctcattctttgtaggttttatgtgaccaggagttatccattttctctaagtttttccatttgttaaaatatagctgtttataatagtctccagtgattctttgtatttctgtggtaccagttgcaatgtctcctttttttttttgtttctgattttatttacttgaatcttttctttctttttcttggttactatagctagcagtttgtcaattttacttatattttcaaaaaccaacttttcatttcatcgatcctttgtactttttcaagtcttgatttcctttagttttgttctaatgttattacttctttccttctgttaatattaggtttgatttgttcttgcttttctagttccctgaaatacatcattaagttgtttatttgaaatctttctacttttttgaggtaagcatttattgctataaacttccctcttggcactgcttttgctgtatcgaataggttctggtatgttgtattcacatcttcatttgtttccagaaatattttaatttccttctttatttcctcattgatgcaatagtcattcaggggcatgtggtttaaccttcatatatttgtacagtttccaaagttcctcttgttactgatatatagttttagttcattgttgaaattcccaactgatatggtttggctgtgtccccacccaaatctcatcttgaattcacacgtgttgtgggagggactcagtgggaggtaattgaatcatgggggcttgtctttctcatgctattctcatgatagtgaataagtctcatgggatcttatggttttaaaaacaggagtttccctacacaagctctttgcctgctgccatccatgtaagacatgacttgctcctccttcctttccaccattattatgaggcctcccagccctgtgtaactgtaagtccattaaacctctttattttgtaaattttccagtcttgggtatatccttatcagcagcgtgaaaacagactaattacagtaaattggtaccaggagtggggtgctgctgaaaagataccccaaaatgtggaagtggctttgggactgggtaacatgcagaggttggaacagtttagagggctcagaagaagataggaaagtgtgggaaagtgtggaactccctagagacttgttgaatagccttgaccaaaatgctgataatgatatggacaatgaaatccagactgaggtggtcttggatggagatgaggaacttgttgggaactgaagcaaaggttatgttttagaaaagagactggtggcattttgcccctgcccgagagatctgtggaactttgaacttgaaagagatgatttagggtatctagtagaagaaatttctaagcagcaaaacattcaagaagtgacttcagtgctgttaaaggcattcagttttaaaagggaaacagagcataaaagtttggaaattttgcagcctgacaatgcaatagaaaagataatctcattttctgaggagaaattcaagctggctgtagaaatttacataaataatgaggatcctaatgttaatccccaaaacaatggagaaaatgactccagggcaggtcagaagtcttcatggtagcccctcccatcacaggaccagaggcctaggaggaaaaggtgttttttttggccaggcccaggtccctctgctctgtgcagcctagggacttggtaccctgcatttcagcagctccagccatggctaaaaggggccaaggtacagcttgggctgttgcttcgcagggtgaaagccccaagccttggcatcttccacatagtgttgagtctgtaggtacacagaagtcaagaactgaggtttgggaacctcttcctagatttcagaggatgtatagaaatgcctggctgcacaggcagaagtttgctacaggggtgaggctgtcatagagaacttctgccatggcagtgtggaaaaaaatgtggggttggaacccaacacagaaaccctacttcagcattgtctagtttagctgtgagaagaggaccaccatcctccagactgatagatccactgatagcttgcaccatgcacctggaaaagctgcagacactcaatgccagcccatgaaagcagccaggaggggggctataccctgcaaagccacagaggcagagctgcccaaggccatgggagcccacttcttacatcagcatgacctggatgtgagacatggagtcaaagggcaccattttggaatgccctgctggatttcggacttgcatggggcctgcagcttctttgttttggccaatgtctcccatttggaatgactgtatttacccaatgcttgtacccccattgtatctaggaagtaactaacttgcttttgattttacaggctcataggtgaaaaggacttgccttcactaagatgaaactttggactatggaattttgggtaaatgctgaaatgagttaagattttgggggactgttgggaaggcatgatttgttttgaaatatgaggacatgagatttgggaggggccagggcagaatgatatggtttggctgtgttccccacccaaatctcatgttgaattctcatgtgttgtgggggggacccagtgggaggtaattgaatcacgagagtggatttttcttgtgctattcttgtgatagtaagtctcacttactcactcgtgatagtgagtaagatctgatggttttaaaaagagaagtttccctatacaagctctctctcttggcctgctgccatccacgtaaaacgtgacttgcttctccttgccttctgccatgatggtgaggcctcccagccatgtggaactgtaaggccattaagcatctttcttttgtaagttgcctagtcttgggtatgtctttatcagcagcatgaaaatgggctaatacaccaactattgttgtactggagtctgtctctccctttatatctgataatatttgttttatatatctaggtgctctgctgttgggtgcttgtatgtttggaattgttatattctctttctgaattgatcccttcatcattatataatgactttctttgtctctttttacaggttttaacttaaagtctgttttatctgatataactatcactattcctgcttgcttttggtttcatttgcatggaatatatttttccatccctttactttcattctatatgtgtccttacagatgagatgagtttcttggagacagcataaaattgggtcatgctttttatccattcagcttgattatatcttttaagtgaagactttaatctgtttacattcaaggttattattgataaatgaggaaatattcctgtcactttgtaatatgatttttggttgttttatatatcatttgtctctttcttccttttttattttttatcattgtggtttagtggttttctttagcggtaatgtttcacttctttgtctttctcatttgtgtatcttacttttatactttcatgtgtttttatgatggtagagattatccatttgctttcagatgtaggattccgttaagtatttcctgcagggctgatctagtggtgatgaattccctgtttttgattgtctgggaaatactttatttctttcatttctgaaggacagatttgctaggtatggtattcttagatggcagggttttttcttttggcactttgaatatatcattccattctcttctggactgtaattttttgctgagaaatttactgttagtcctaatcagacttgtatatgataatccccttgtatatgacttggcactttttctgtttttagaattctctctttgtctttggcttttggcagtttgcttataatgtaatttagagaagacctttttggattatgtctatttgtgagtttttgtgcttcttgtacctggatgcctaaatctcttgcaagatttgggaagtttttaagtattattctgttaaacaggttttctatgttgttatctatctcttgcccttctggaactgccagaattagaatttttttctttttatggtgtcccatatattatctaggcttccttcattcttttaaatccattttttctatttttttcttttctcttttgtctgactgagttattaaaaaaaaaaaacctgtcttcatgttcagcagttcttttctgtgcttggtatactctattgtagaagctcttgattgtattttttatttcatttattgaattcatcagttccaggcctttggttttgttctctttggatatctgtctctggtatttatcattcagctcatgaattatttttgatttctctgtattatttatctgtgttttcttgtatctcactgtgtttctgtaatattattctctggaattcttttttaggcattttataaatttcctttactttgggatctcttactggataattattgtgtttcttttgaagtgtcatgtttctttgcttttttgtgttttttgtatccttacattgatttcagtgcatctgacataacaattgcttctgattttatgcattggctttcatggagaaagactttttcctgtagataatctatagtgttggttgggtaaagtgctttggttttgattctggttgggcacggtagtatagtctgcatgatttctttggctgtaattagcatcagtgttttctctgagttcctcagtggcttagactgcagttgttaatggatgttgtggtgaggctttgctggagatgggcatgccatgcaggctggtccttgggtaccagtggtgttggtgaggcatgcctgtcctcaagtccctgatggtggatgcaggtgttagctgtggcaggtacggttaggactgatccttagacccccacacagtatgctcgggtgcaagcaatcatggtggtgggtgggatcggcttgtctttaggccccagatgatgtacttgggtgccatcagtggtggcagtggatagggtagccctgtcttcaggcccctggatggaacatgtgggtgccagtggcagcaagagggatgggttgatttccaggttcttggattatgtgcacagataccagcagcagggaaagtgagcctgtcctcaggccccctgatagtgtggggaggtacgagcaacagcaggtggagcagattgatttaagagttagctcagtgttggccagacttggtggctcacgcctgtctcccagcactttgggaggctgaggtgggtgtatcacgaggtctggagttcgagaccagcctggtcaacatggtaaaactccatctctactaaaaaaaaaaatacaaaaattagccaggcatggtggcgcttgcctgtagtcctagctacttgggaggctgaggcaggagaatcacttgaacctgggaggcggaggttgcagtgagctgagctcgtgccactgcattccagcctggggtgatagagtgaaactccatctcaaaaacaaacaaacaacaaaaaaacaaaaaacaaaaaacagagttagctcagtgttttatgatttataaatattttcttaattttctaggcatttgtgttttgattttttgttatgaaatactttttatttctatttttattagtcaaatttatcaattttaatgggttctgagttttttgacagaattagaaaatctttattgctctgagatcttttttataaaccatctcattttttaatggtactttaagggttcttatgtttaaatctttaatctgtctcagatttattttggtgtaaggtgtgttatatatatctagcttaatttttcttcgattagttatcaaggtttttttgtttttatatcactttttgaagttcattttttccgatgggattcaaatatacttatgacattaaaattttctaactatatttgtgtctatttctgggttctctgttctgtttcattgatctatttttctgtttacaaaccagcaactcaccattttaaataatagctttacaacaggtttttatatcttgcattgctaatcccgatcatttgtgttctttttcagaatgtttcttgttattcttatttttcctgtgaacttcagaatcaaatcaatttcttttgtttcaaatagtgttaattgtgtgtgtgtgaatatgtgtgaacatattaaatttatagaataagtcaggtagaactgacatctttaacatttagagttttcttatccatcaatatccctcacttttccatttgtttaattcttgtgggtccatcagtaacattaaaagttttattcacatatttcttgttatacatttttctagttactctataattttggttgctacttttaatgcaatctattcttactttggatctcctatttgcgttgtttgtatgtatgaaaagtagtggtgtcacaatattatttttgtattcattcacttaactgaattctgtcattatttatagttttccagttgattctcttgtgctgtccaggtaaataatcatatagtttccaaataatgatattttagttttatctcttaaaattttacctgcattttactgtctagttatgttattcaggacctccaaaaaattaatggtggtcatagtagacactcttgtcttcaacttattgttaataagaatactaataatagagttttcattaagcatgacatgctggcttttgagatgcaacagagatattttgtcatattaagagaggaaacccttttttcttggtatagtacatgataaggatttttgtcaaaaataacgttgaattttatcaaaagccttttcataatttattgagatggtattttagttttctctttttattattaacatggtaaattatattaatagatttattgttatacattattcttttatttggtgcataaacaccacttagtaatggtatattatactttaatgtgatcctggattctatttgcaaatactcacttagggtcttttttcatgatattcacaagtgagtttaggctatatttttattttttttctgtgctttttattgtggatttatatgttataaatatacatttgaagattttctttttttttcctatgctctacaacactttgaatggcattaaagttaggtgtttcttaaaaatttgtcagtattccgctagtgaaaccaactatgtgttgaactattttgttgggagtaaattgacaatttgtcctccttttaaaacagatagtgatatgttagattttcaaatttatctgggatgtgatttcttagaaaagcatcttaattctcaaatttactcacactgaattgatcaaactggtgttataggagtcttttaattttttttgtttctgggatcttcctcattgtttcttgttctttgtatttgtattttctatccttataattaaaaatgttttggcgagttaaaggttttgtttcgtgttatttctcctcctccacccatgaaacatctgttgggtttacttattctttcacattccatttttcttttcttttcttttcttttctttctcttctcttctcttctcttcttttctttttttctttttctttttctttttttgagacagagtcttgctttgtcacccaggctggagtgcaatggtgcaatcttagctcatcgcaacctccgcctcatagattaaagtgattctcctgcctcagtctcctgagtagctgggattacagacgcacaccaccactcctggctaatttttgtatttttagtagagatggggtttcaccatattgaccaggctggtctcgaacttcgcctcatgatctgcctgcctcggcctcccaaagtgctgggattacaggtgtgagccactgcacctggccacatgccatttttctaattcattatttcactttttatgtttattaatttctttttttctattttcctgtttttcattttattctaacttcttgagtgcttatattatctctttcattctttcttgtttattaatatttcagctatatcacctagataattgtatattgttctttcttcgattgttatttcccagatatcctataatttcagttttgattttatatttgatgcaaaacttaacagaattttaaaatatcctgatagtagattattttcattttctgggtttgttatttttaagttttattacattatgagcacagatgtatacattgtttttcctttttgaaaactgtcaaagtttttttttgtttgcaaatgggcagttttgtgaatgttccatggaaacttggaaagaaggtgtagtctctatttttagagtaatgtatatcacttaattttatttaggttttccatattctgaaaaaaatttttttttgcttattctgtcatgtcctgagagaaaagaaagtttcctattgctgagattttattttctaatttaagacttctgttttctgtaggtttttctttattgatattgcttctgtattactgggtaattagatagtcataacatttaatctacattttgtattgtgccctttagcattacaaggtgtttatcttttttcattgaacatatactatgctgcattaaaacccatctgatattaataccatgaacgttattttctttttacttgctcttgcctgttgtaatctttgcctttccttttattttcaacccttcttggttacttattgatttgtcgtattcttgtgtgcagcagatatttggattttgctttgaggcccacctcatttttcttttaatgagtatgtttaggccatgtgtagttgtagaaataagtgtttacttttaattctgtcattatatcttatcacactttgttcacagtatggactatttctgctttgtggggcgtgtgtgtattttctgatttggaagatttgtaattttatgctaccagttactttataattatatctttatgtgactctctatttcctactattagcatagatgaacttggcaatttccattttcttccttctactcctactgcaaaattgacggtactatatttcttcatgtatgcctctttatatttcaatgtactgtaattctgttgcttgacttaccagttttaaatgatctcttttgattgctagtatatcaattagaatattttcattgataagtaactgaaaagccatctagtggttgcttaatcaattaagacaattgctaccttaataataatgttaataagtccagaagtaggatagttctagtatctcaacaatgtttttagaatccagtttttccatatttttcttgaccattctcagcatgtaggctcttaacctcattgttgtttcttcttggttacatttataggcatgaatttatcctatagcagcataagagacagagaaaaatgctgtttatcttctcaaatttcttcataagaactgagaaacaaatgtctgctcatgactcattggacagaattgaatcacatgttcatgctaaaaccagccaacgttaagagaaatagatttcccaagactagcttatgctaatcacaaatcattctgtggagctggggagaacctcctagttctacaatacagaagcagaaaaggataaatttgtgtaggtctccagtggtgtctgctacctctgtctctataaaatgaagaaatcagcagaaatatactgccaccaattttcttgcccccttgctgtgtcaagttttgttaattacacattgttacatgtcaaggcttctaacctattcattctatcctgtaaccataatgtatttgttttggtcttcgttatagagaattcagtacaactattagtcattttgccagagatttatcatgcatttcttgattgactgaagttaatgcactagcaatttcttccagaaatggaaaaagggaagaagggaaccaaattctgtggattattgcatgttaaaaaaagtttgtcagcagtcattgtacttcagcaacagttcgattggatataaaattttttcttatttccttgaggacttttctctagatgggaaaaattatgtattgaaacctgttccttccattgttttgattacactttttggggacactagttgtacatatgcttgatttccattttctctctcttcctggccttttggctaacatcaagtgtaattgatttccattttctgtatatatccttttttctataatcattaaaaaattttacttttgctataatcctttttaacttggttatttacattttattctgatcactttttaaatttgtgtccttcataattcttactttgttttcagcagcatttactctgtttggattgtctccaatatgaccttcatttctctgatggttttatttttctctcctgtttatgagctctgccagtccaatcatcatctccttgtattgccttgccttattttacttgggctcttgtatacttagtttgcatttttaatttatagaggtatgtgcttatttttttgtttatatcattatatttggtcacaatttttatctgttctgtggcaatattttttggatgccactttcctctgttccctattttctccttttgtggctcttatgcaagttattccttttaaaaaataatcatctctaactgaggcacattttttctggatcagctacctgtaaaaggtttgtgtgagaggggcaccccattgtgttctaggctaataacaattgtccttatgatttaatgagtattttttttaatttagcttttactctcttccccattgccttgccttcagacagatttctgaaaatatagcttatacatgtgatttgttattcagtctcagttacttgctttctttagtgccaagttgtgtccaggaaatctattgccaagttatgcaactactatcattattcctaacaagggattgttagtttttctgttaggatgtgatgcttactttggaagattgttttctgctgtagccatatgtagtttcttttgacatcttcttgcaactccgtttgagctgtgatacaaagtttacatgcccagtgcaggggaaatgatgtgtgtctgccacttttgagtgctatgattgttcacttctttagattctcatagtctgtcctgataattgcaggaattagaaaaggctggcctagagtcctttcctcacctatgactttagggccacattatggcttccttttcccatttcatgaaaatatgactacatctatggtcttttatgaaaaacaaagtaaaatgccctgctagcaactggcaacccaaatccaagaggtaaccagattttctttaggaatataagtttttccaaggcaatatccatgtgtgagacatctttggaagaataaatgtacagaaattggttgtattagtttcctagggctgctttaacaatttaccataaaaccagtggcttaaaagaacagatatttattctttcacagttctgaaaagctgaagttctaaatgaaggtaacagcagggatgctgttccttcagaggttctaggggaagaattcttccttgcctcttccaggttctagtggctccagatgtttcttggcttgttgctgcataactctaatctctgcctcagtctttatatggctttcttccttatgttctgtcttctcttctgtctcttataaggatacttatcattgaatttagggcccatccaggatgatctcatctcaagatctttaacttaattatatctgtaaagtccctttttttgaataaggttatactcatcaaaagtactaggggttaggacatggatgtatattttgggggaccattactcaacccactccactagtgtttctgtgtcatctctcttcatacatttaacagttatatatatagcaatgtctttgtgagtaacactgttctgggggtttcagagtattgactatcttttccttaaaatgtttataatttacttgaggactcaagatctacatttggacaataatataagttaaaacaaaaaataaagcggagtcattttggtaactggtgtgagaattccattgctgggaaatatgttcttgatatgatactttgataagcttgggtagaagttagcctccaaagcccagctagtcctcaggtttctttgatgctggtatgagaagtggcttttcggtagaggcaagcctaatggggatttccatgtaaaatgctgttctgtgcactctgacccttccttattactccaaaatatgtccaaaaccatataaataacagtgaaaataggttgagtgtatttcttttggaaatcactgaacaccctgggcattatcaaaacatacaattacatataattaaataagacaataatactattaataagtcatacagttctggaaaacagtaaggtctctctggttggagttgtctctggaaaatgaatcttgagttgaatgttaaaattgggtggaatatgattgagaaagggtattctagaaaggagaatgatattggtaagtgcaggagtgtacctaagacaagcttgagacaccaagtgagtggtctgatcctgctgaattacagtaggctttcagtagaagtgcaagattgtaccttgcttgtaggtgtgtaatagaactattgtgaataaagttgtggttcataataattattgaaccctagggcattaagcaaacataggcagtggtcaggtagttacagcaggccttgggtgagacccagtgctatgctggcttcaggtctgacccagcacagtcccagtgttggtgactgcagggttgcttgtgccacccctctcccagctccaggcagctcagcatagacagactctgtttgtttgagagaaagtaaggaaacagagcaagagtcttcctggtaatccagagaattcttccggatcttatccaagaccatgaaggcgataactctacaagtccacaggagccacagttttactaagctttaggtgtcccctaatgcagatacagctgcaatgaccaaaaacttagaccacaacacccaagtcctttcaaatatttgaaaagccttcctaagaaggacaggtacaaataagtccaggctgcaaagacaacaataaatattcaattcttcaacagccagagaccaatgaacattcacaaggatcaagaccgtccagaaaacataatctcaccaaatgaactcaataaggtgccagggaccaattctggagatacagagataggtgacctttcagaaaattcaaaatagctgtgttgaggaaactcaaagaaattcattgataaggaattcagaatcctatcagataaacttaacaaagagattgaaataattaaaaagaatcaagcagaaattctggagtccaaaaaggcaattgacactctgaagaatgcattagagtatcttaacagcaagaatagatcaagcagaagaaagaattagtgagcttgaagacaggcattttgaaaatacgcaaagtagacaaaagaagaaagaataaaaaagattgaagcatgcctacaggatctagaaaatggcctcagaagtgcaaatccaagagttattagccttagaaaggaggaagggtagggaggggggagagagggagagagagagagtagggtagaaagttcattgaaagagataataacagagaactttccaaacctagagaaagatatcaatattcaagtacaagaaggttatagaacaccaagatttaacccaaagaagactacctcaaggcatttaatagtcaatctcccaaaggtcaagtataaagaaaggatcctaaaagcaagaaaaaagaaacaaataacatacaatggatctccaatacatctggcagcagacttcagtgaaaactttacaggccaggagagagtggcatgacatattaaaagtgccaaaagaaaaaatcttttaccatggaatagtatatccagcaaaaatattctttgatcatgaaggagacataaagacttttccagaccaaaaaaaaggctgagggatttcatcaacatcagacctgtcctacaagaaatgttaaagggaattcttcaatcagaaagaaaaggatgttaatgaggaataagaaatcatctgaaggcaaaggactcagtggttatagtaagtacacagaaaaaaatggaatattataacactgtaattgtggtttgtaaattacccatatcttaagtagaaagatgaaaacatgaggtgatgaaaaataataaactgcaactcttcaagatgtaggcaatacaataagatataaatagaacaataaaaagttaagaagcagggagacgaagtaaaagtgtagagttctctttttgcttgcttgttagtttgttaatgcagtgttaagtcaccagtttaaaataatgggttataagatggtatttgcaagcctcatggtaacctcaaatcaagaaacataaacaaatacactaaaattaaaaagcaaaaaattaaaacatagcaccagataaaatgaccttcacaaaaaggaagacagaaaggaaagaagggaggaaggaagagaagaccacaaaacaaccagaaaacaaataataaaatggcaggcataagaccttacttatcagtaataacgtttaatgtaaatggacagaactctccaatcaaaggacatggagtaactgaatggtttaaaaaaaaaaaagacccaattatctgttacctgctggaaacacaataaagaaatatcagacttaatctgcacagtagatcaaatggacctaatagaaatttacagaacattttatccaatggctggataagacacattcttctcctcagcatatggctcattcataaggatagactatatgttaggccacaagacaagtcttaaaacctttgaaagaacagaaattatgtcaaatatcttctctgactacagtggaataaaactagaagtcaataacaagaggaactttggaaacaacaaacacacagaagttaaacaatgtgctcctgaatgaccagtgggtcattgaaaaaattaggaaattaaaaaaaaattgaagcaaataataatggaaacacaacataccaaaacctataggatacagtgaaagcagtactaagaggaaatttatgtgtataagcagctacataaaaaagaggaaaaacttcaaataaacaaactaatggtgtatcttaaagaactagaaaagcagttttttccaattctgtgaagaaagtcattggtagcttgatgaggatggcattgaatctgtaaattactactttacagtgcatatggaaccaaaaaagagcccgcattgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaatatatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgagagaaaattttcgcaacctactcttctgacaaagggctaacatccagaatctacaatgaactcaaacaaatttacaagaaaaaaacaaacaaccccatcaaaaagtgggcaaaggacatgaacagacacttctcaaaggaagacatttatgcagccaaaaaacacatgaaaaaatgctcatcatcactggccatcagagaaatgcaaattaaaaccacaatgagataccatttcacaccagttagaatggcgatcattaaaaagtcagggaacaacaggtgctggagaggatgtggagaaataggaacacttttacactgttgatgggactgtaaactagttcaaccattgtggaagtcagtgtggcgattcctcagggatctagaactagaaatatcatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacatcatggaatactatgcagccataaaaaatgatgagtttatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggagtggggagggatagcattgggagatatacctaatggtagatgacgagttagtgggtgcagtgcaccagcatggcacatgtgtacgtatgtaactaacctgcacattgtgcacatgtaccctaaaacttgaagtataataataataaattaaaaaaaaagaactagaaaagcaagagcaaactgaacccaaaattagtagaagaaaataaataataaagatcagagcagaaataaataaaattaaaattaaaaaatagtacaaaagatcaatgaagtgaaaagttggttttgtgaaaagataaacaaaatttacaaactttagtcaggctaagaaaaaaagagagactacccaaataaataaaataagagatgaaaaggagacattacaaccaataccacagaaattcaaaggatcattagaggctgtgatgagcaaatatgtgccaataaacttgaaaacctaggagaaatggatctcattctagatacaaacaaccacaagattgaactatggaggaatccaaaacttaatcagatcaataacaagtaacgagatggaagccataatggaaagtctcccagcaaaccaaagcctgggacttgatggttccatggctgaattctaacaaatgtttaaggaaaaactaataccagtgctactcaaactagtccaaaaaatagaggaggaaagaatacttccaaactggccttctatgagaccaatattaccctgatacaaaaaccaaacaatgacacattgaaagacaaaaacaaaaaattacaggccaatctccctaatgaacactgatgccaaaattcttaacaaaacattagcaaactaaattcaatgatacactaaaaagattcatcatgaccaaggggaatttatcccagggatgcaagtatcctcaacatatgcaaaccaattcatgtgatacatcatataaacagattgaaaaacaaaaaatcatatggttatttcaactgatgctgaaaatgtatttgataaaattcagcatcccttcatgataaaaactctgaaaaactggatatagaatgaacatagttcaatgtaataaaagccatatatgacagatctatagctagtatcttactgatgaggaaaatctgaaagccttttctctaagatctagaacatgacaaggatgcccaccttcactactgttattcaacagtcctagcaagagcaattagacaagagaaagaaataaagggcatccagattggaatggaagaagtcaaattatctttgtttggaaatgatgtgatcttatatttggaaaaacctgaagactccaccaaaaaagtatgagaactgttcaacaaattcagtaaggtggcaggatacaaaatcaacatataaaaatgagtagtatttctatatgccaacaacaaacaatctaaaaagaaatttaaaaagtaatcccacttacagtagctacaaataaaattaaatacctaggaattaaccaaacaagtgaaagatctctacaatgaaaatgataaaatgctgatgaaggaaattgaagaggacacaaaaaatggaaagatattccatgtccatggattggaagaatcaatactgttaaaatttccatactgtccaaagcaatctgcagaattaatgcaatccctatcatgataccaatgactttcttcacagaaatagaaaaaacaatcctaaaattaatatggaaccactaaaggcccagaatagccaaagctatcctgaacaaaaggaaaaaaatgaggaatcacattatctgacttcaaattatactactgagccatagtaaccaaaacagtatggcactggcataaaaacagttagaccaatggaacaaaatagagaacctagaaataaatctatacatctatggtgaatttatttttagcagaggaaccaagaacatatattggggaaagaacagtctcttcaataagtggtgctgggaaaactggatgtccatatgcaaaagaatgaaactagacccccatctttcatgatatacaaaaatcaaatcaaaatggattaaagacttaaatctaagacctaaaaccatgaaactactataagaaaatattgggtgaaactctctaggacattggactgggcaaatatttcttcagtaataccccacaagcacaggcaaccaccgcaaaaattgacagatggaatcacagtaagtcaaaatgcttgtgcatagcaaaggatacaacaaagtgaagagacaatccacagaatgggagaaaatatttggaaactatccatctgacaagggattaatagccataatatgtaagcagctcaaacagctctataggaaaaaatataataatattatgaaaaatgggcaaaagatgaatagatatttctcaaaagaaggcaaacaagtgttgcaaaggtgctcaacatcactgatcatcacaatatgcaaataaaaactacagtgagatatcatctcaccccagttacaatggcttttatccaaatgacaggcaataacaaatgctggcaaggatgtggagaaaagggaacccttgtacactattggtgggaatgtaaattagtacaaccactatggacaacagtttggagttttctcaaaaacctaaaaatagagctaccataagatccagcaatcccactgccagctatatacccaaaaggaaggaactcagtatattgaagagatatctatgctcccatgtttgttgcagcagtttttcacaataagcaatatttgggagcaaactaagtgtccatcaacagatgaatggataaagaaaatgtggtacatgtacacaatggagtactattcaaccacaaaaagaatgagatcctctcatttgcaacatggatggaagtggaggtcatttatgttgagtgaaacaagccaggtacagaaagacaaacatcacatatttccacttatttgtgggagttaaaaagtaagacaattgaattcatggacatagagagtgggatgaaggttaccagaggctgagaaaggtagtagggggctggtgggaagtgagaatggttaattgctacaaaaatatgtttagaaagcatgaataagacctagcatttgatcgtacaacagggtgactatagtcaataataatttaattatacatttaaaaataactaaaagagtataattggattacttgttacacaaaggataaatgcttgaggtgatagatactccacttaccctgaagtgattatacacattgtatgcctttatcaaaatattttatgtaacgcatatatatatatacctactatgtacccacaaaaattaaaactaaaatcccaaaataatataaaccacagtgtcatatttgtgcttcactgcattcaaacaaattttgaaacatatggtactgagggcccaagctgaggacaaagagacatcaagcacacctattctaaagtgaactataaataactggggtcagacacctcccccagagatcagtgagaggtggccaaactgtccttatcactctaaactgtcacccaaggcctttcctatcatttcccaattgataaaagaagatgtggggtagagaggagaaagaagatgacattgttacatttgtgagtttcttgccaaatgttgtgtttccctccctttcccgtgggggcttcctgcctacttcaaagccctgtgaaaagtggactactagacaagagcctgggagtgtcaacaggagactggcttctcactcctggctagatgttgcatgaggtgaggcagcagaggcttagcttggtgaggttgttagcatgaagtgaagtatggtgaaggaagaaaaggacctaccatgggtccttgatgtgtgggggcatgtatgtacttggaaattgatgccttctgcttgcgtggctgcactactctgccaaggctgatagacaatggaccgcaggtaagatgtctaagaagaagacagagaaaatcccccagctcacttagaaggtctggaggaggattttcatggttcctatggcttgtcagaataagtctagcaggtagaatgcaaggcatgagtttgggaactgatcaagtggcatctagttatgagataccccatttggtgagagggttgagtgcgtggaccagtgactgagacacaaaatggagatgcagttgtctcttgttttgagggcattctcagtcatgtatagtgctggcttgaagcagaacatctctccaagtaaactgcatgcaccttctgggtagatagcaccacattggtaaagaccaccagcatcagaaagaaccagacctagctagaagggaactcgaaacagctgcccacttcttccagacagccagtctcatatgtcaacctctgccacatctgaaatttctctcccactgctctaatgcgtgggtggacttacagcctggaagctggaggagggaggaggtacagaggacacagagaacatctctttccttcctgaaggatggagggagaagaactttccccctgtctgctccaggcctgacctgaagcttggctggccccagggagagcaaagaagagctttatactagctatgaaactggaatttaaaatatatttgagtcttaaatactggaattagactcttctaataactgaaagtgattggaattttgtggaatattcccagatgttactaagggatagtgaaatatgattcaatgtaggacagctgtcagcagggattgggaaaatgaaaccattttaagtttattttacatcaaatacagactgtacaataacctggttatatacaatatagtggaaagaaaatagattaagtcagactgacttgggtttgaatccttgctcagcaacttactttccacatgatttttggcaaattactttcaatagttttcttaactgtgaaatggggataggcagtaacatcattcttccaaggatttgggagaagattaaatgaaataaattctaggaagcgtctagtgtgatgcctgagacatatagacctctgaaatggggattgattattacagctggagacaaatctggtaaatcaaggactaatggctgatgtagctatcaaatgtaatttgaagtagttagatgggtgggatctgatgagtatttgatgttttctaaatcccaaactatctttttcaatgaagtcaatgcattttcaaagcatttttctgcttaatttggaagattaaatgtatctaactggaagcgcatactagaaaagcatgagaaagggcttcttgtcctgatcagaaagatgaggaggctccgaagagatctgaggtaggacttctgccagcctcaaaatgtgccacacacatttaactgggaagatgctctgaataacatactcttggccatgtgaatgcgttccttggcagccctggccctgcaaagtttggcaggaggggattttcgggttgccagctaaagccctgacactcagagcaggcctcagtgtctctgttcccaaccctgtccccatccctaactgaaggaacttttgtttgtgcaatagctgttgtatctcactcatcccttctactaattggctctgaccctaactttccatattctccagcttggagatgcctgtgggaggtttgctttgagaaggccccagctttggcattgtcagtttttcatctggctcctaatctatttcactttgtctcaagcttcccttctttggtgacccactaaaaactgaagttgtgctggcaagatggtgctttgttgtcatggaaagaggctgtttgcagaactgcggggttaacaagaaggcttctttggcctgtggacggttggtttgtctttggcagtagccagttggagtacagcagggaggcatgttcattccagaagccgtctagtcttcagttgaaggaagtgccatcttaattttgaagtgagagcaacttacatctagagcaaactctttgaaggagggggatcttccaatatcccgtgtgggcctcccgaaggcccgaggcatagacaacaaggaagcaaggaagatgaggaagaaaaggggtgggtagagaaagggagaataagagagagaaaggtgaacgaaagctacagctgctgaatcctcttctgtatccatcacatgtttttactgaaagtttaagataatatcccattgccttatgtttatttgtttattttgatagctaacacttaaatagtgcttactacctaccaggtgctgcattaacactatatatattaagtcttttaagcttcaccacaaactcatgaggtaggcgatggtactatgtttatttcaagatggtaaactgagacatggagccattaagtaacttttctaagatcacacagctagtaagtggtagagccaggtttcaaatgcaggatttatattttctcttccctttccttcctgtccctccctcccctttctccttctgtaaacaagtgtcttctttgaggtgtatttagtgtcacatattttgcatttttgtgctttttttgggggggttgtgattttgctgtttaaaatggcccccaagtgtagtgctgaagtgttgtctagtgcttctacatgcaggaagattgtgatgtgccttatagaaaaaatgtgtgtgttagataaccttcattcaggctttagttgcagttctgttggttgtgagtacaatgttaatgaatcaatagatagatattaaatatgatatttaaaagaagcatacataaaacaaggttatgtcttcataagttgatgaaagtgttatgaccagaggctcacaagaacctaactctgtatttcccaagaagccatgattcaataatctctaattcagtgtttgtgacaactttatagaacataactccatgaataatgagactttgccatattttttttggcaaagattataataaatatgtcttgccacctaagtttagcttgatgcacagtcttctaagctatgtggccatttgctaagaaataccactatatatgttttgtttcttcagttcataaaatctcatgcacaatatcttatgtggtgcctgagaaatagtcagtgctccataaatgcttattgaatgaatgattaaatgaatgaaaaaagtaacactcaaaatttacaagataatctagtctagtactttacattttaagaaatacatgaatggacctggaactaatgtgtgtgtgtgtttttctttttaagtaagccatataacctatgaggcaagcaagttgttctaattgccttctggttgattacatactatttgttgagtactagctactgggattttcaaaatggaattttgcatagtttatttccctcaatcctacctaataagattaaggtccatctgttttgtataagagtccactgtttacttatcaagagtgctttgataaacgaagaggttatcagccacttgtatgggtatcctatactctgtttggctatagtgaggttaaaaggtcaagaatctgtaaggggattcttatccatgaggatattatgtatgcctagggaccatggaagtgaagttttgtttcatttattcatctattcaacaaatattttgaagacgtgctggtgatataatttggaatacaaaaatatgatgtccctgagattgttctttggcatcttggaaaatagtcctatgtagaaagcaacatccttcatactttcagttcttaagtattcatcaagcacctattatgtcccaggcactggggatatagcagtaagacaaagcccctaccctttgaaacttatattccttcaggaagaccaagcactgaacaacccatttgaggtaatactctcccctttggcccggattctgattcagctgctctttatttattatctccatattatgtgaaattatcttgcctttttgctcatttgcttattgtctgtctcccctcatgacaaatgtagctctaaaagagcagaaacttcgtctttcctattgctgaatgtccatcactgagaatagtgtttgatccaacagtagatgcttaataaatgttcgttcttatttaattatagttatggtaatgctaggaagtgtatttctggagattttgaattagtatggacaatcaggaatactcctttaaggaaatatggattgagttgaactttgaaggagtaagcagcaactaaatggagcaaagagtatatattctaggcagagggatcaggtcaaagaatggaacattagaatgtgtgatataaaattgatatatctggagttcaagagtaggagagtatattaggtgagtctagagaggtaggagagggcaggatagtcagggattaggaggctatatagggatttggagttttatcctaagagcattgggaagttattaaagaactacaaacaggaaatcaatctgttgttctgtggatgggagagagactactgagtggatagtgcaaccattcatggtcttgaagattaggtgttcagtctgggaaatctttgattcaaagtacctgtgaaacatccatttggaggtattaagtagacaattggctatacatatttttgggttcagagaaggaggtctgaaatgaatacactcatttgagtgacaacactgtgaatggtgtttgaagtcaagaggactgatgaaattgtctagggggagagtgtagagtaacaaaaacagagggcttcattcaggctaatctttgaggaacttcctcttttaaagatgataaagaagggtgaacaggaaagaatcttaaaagcagaaaagtttaaactaaactatctatgcttatttatatggcctttctgagtggttttattgtcaattgcccaagcatatctctctaataagactctatttaatttaccatattttaatcacttattttcttgtctttttcttctattgtccttgagagtagagattttgttctttaaaatcatgcttgaaaccctagtgcctagcatgcttccagcttaataggcatgaaatatatctgttattgagtgggaatacagagctttcttaggaaagatgagcaagagcggaaagcagatttttcctcacagcctcttctatgtgggacaccataaacattttattttaagccttttgtctataactgtgaaatggtgatttaggtatcaggaagcagatgggaaactttttgaggggtagaggcatttaaattctgcatctgtggtttctttgcatggatttgctcctacccctagacctgtggctgctaaaagttatttccagaagctgttgcagccaagagtctggtgtctacttcatcactttggaggttggcctgcctaggtctcccaatagtccctttccttctattccctctctcttgactatctgtttcccatttcctctaactttatcccaattcctctttgtccaaagaatcccagggcatgtttcataattataggcattattttactcaggatttattaacattttgtacagttatcacctttccccatttttccattatgaaatacatttttttatctcatataatttttacctttgataatgaagtgtgtatattctctttgataatggatctaatgataatgtgaccagtgtgtgaagatcagtgggccttcctctcctcccagttactccacattctggctaggtgcctctgctactaatagcttagcctgctgttcccatgtttgaggattgattctttttcctaggctgaggcaaacagttgtaatgttaaaggcttgctgacagcctgtctttgttgcctggaccgtgttttaatacgtgatctttgctgcctgaattttcttttttctagactacttgatttttcttgacctgtggaattttatgattacttgatttgtgaatttatctcaagcccctggttttgaaccaatgactctattattttaagccaggtgtattgtttttttagcctgtgtctattatactgtgtgttgcttcttatattccctatatctaagtaacttggctgactgggcattttgttaactttggggaggaaaagcatcaacatgacctgcatagggctggagaagagtgcagttagcccttgagggttgggggtgaatgtgttaagggtattaagggtggggagatactgctaagttggagaaaaactttcagcgaatttcactgatttcaaatcaagctgaatttgaagttcttgtctacatgagtgaacaatttttaaaacatttgaaggcatgcatttaaagtgacagcttaatgttaaaatgggaagttatgattcataagcagtagtaaaattttgaataacatgactttattcattgacagtaactgctttacattttccggtttcattatatcagtactgtgaataaaatccagaaaagttatagaggaggaaatgactttgagtttttattcaatagtcattacttacgtctttccacatttttttgcaaattttaagtttcagtaatgatcttgctattcaaattttctatttcttacaaccataatcttctagaatagccacaaaggtaggagtaagctgaagtaaaaagcctgtaggtcagtgtaaatgcctttcataaagcccacagcttgattcagtaaaacccagattgacgtctcttttcttatgataggcccagaatttatttgatttagttatatctatgacattttatttattttctcctggcaacatatagtttccacttttgatctaggggaaaaaaaggaggcttatagctgtaaaaatagccctgtacaaagtaatagaccctaaagtataactgtgcagagacaatgaagaaacagatcactgttgcttagtaggaatttctgcaatgacagaagtttttctatgcactgcccaatacagtggtcactagccacaaggagctgatgagcactggaaatgtggctattgaacctaagatactgaaatttaattttaatttcaatttaactaacttagtcacatgtggataggagctactacactggcctagtgcaagtatctacttcaagcttgtccaacctgtggcccaggacagctttgaatgcccacacaaattcgttaactttcttaaaacattatgagattttttttttcctaactcatcagctatccttagtgttagcatattttatgtgtggcccaagacaattcttcttccagtgtggcccagggaagccgaaagttgaggcacccctgatctagatcattgtattaactttctactggtattacaaaaaaattaccatggacttactggcttaaacaacacaatttcattttaatgaatgaatgaatgaatgaatgaatgatttttttttttggcttaggacaacacagatttattattttgtagttctgggagtcagaagtccaaaatgggttttacttggcaaaaaataaagtgccagtagagctgcattccttctggaggctctaggggagaatctgtgtccttgccccttccagcttctgaatgctgtctatgtttttggcttgtggctctttcctccatatttaaaggcagcaatgaccagtcaagtattgtcatattgtgtcactctgacactcaagttagaaatctagcactgttctcactgggctaaaatcaaggtgccctcagggctgctttattttctggaggatttaggagagagtccattttcttttcctttctagcatttaatggctgcccatattccttagttcatggcccccttcctccatcttccaagccatcaatgttgcatctctctgtccccttcttctatagttccatcttcctttgcctctcttcttctgcctctcccttacacttataaggattcttgtgattacactgagcacaccttgataatccaagatagtctccttattttaaagtcagctgactagcaatcttaaatcccttttgctatagaacctaatatatccgtaggttccaagaattaagactggatatttttgtgtgggccattattctgcctaccacagcttctaaatttggagccatttaatgaaaagacaaggtaagccatatgtgtgtgtgtgtgtgtgtatatatatatatatatatatacattgtttgttgggcctatacctatatttcatccaacacagtatagggtctcaaaataatttaagaacaatagaaacttaattttaaaagaggactgatatgatatctgctccaatcttctatcccttgtagttttattctcttctataatagaatctctagtttattaattttctgtcattagtttcctgtgaaggatactccctacttaacaacaaaatcagctgcattgttgtatagctatggttgttctagatcatcctatcacctagcctttacaatcaccacagagtagcacgttggtttctgacttttggaacaatgttaacctgctttttcgcagagttacgtatctcaataaatggaattactacctacatagttgtctcggcaaaatcttgggaattcttctttatcacccaccattcaccactgttgaatattcttaatatataactcctaaaatatctttcagatctgtctacttcttttaagtattttacttttcagttttagaatttaatttttttatagtttcaatttatttgctgagattctcatttgtttatgaatcaagaccatgttttctttttctgtcattgttctttatgtatgttcattttttagtttttaaatttatctatatttaactcatttccatagcttttgaggtacaagtggttttgtttacatgaataaattgtacagtagtaaagcctacgattctagtgtacctgtccctggacattgtacccaatatgtggtttttttaatccctcacccctctcccaccctctccgcttctgagtctccaaaatccattataccaagctgtatgcctttgcatacctacagcttagctcccacttataagtgagatcatacagtatttggttttctattcctgagttactttacttggaataatggcctccagctctgtccatgttgcttcaaagtacattagttcattcctttttatggctgagttgtattccatggtgtataaataccacattttctttatccgcttatctgttgatgaacacttaggttggttttatacctttacaattttgaaccgtgctgcgataaacatatgcatgcaagtgtctttttgatataatgacttcttttcctttgggtagatacctagtagtgggattgctgggtatctactttactgcatactcatttattctgagtacacataaatgtggttgtgtattaacttgtgaatgcaaaaccatctctgcatccttgggataaaacccacttgatcatggtgaattatctttttgatgtgctgttggattcgatttgctagtactttgttgaggatttttgcattaatgttcatcaggaatattggtctgtagttttctttttttgttctgttctttcccggtttgggtatcatggtgacactggcttcatagaatgagttagggaggattccttctttctcaatcttttggaatagtttcagtagaattggtaccaatttttcttagaatgtctgatggatttcccctatgaatctctctggccctgggctttttcttttgttgttggcaatttttaaaaattactgattcgatgttactgcttgttatttgtttattcagggtttctatttcttacttattcaagctaggagggttgtatatttctaagaacttatccatttcctctagattttctagtttatgtgcatagaagtgttcatagtagtctcgaaattttttttgtatttccgtgctattggttgtaatgtctccatttttatttctaattgagcttatttgaatcttctctcttctgttttgtttatatttttaaagaaccaactttttggtttattggttttttggtttcaatttcatttagttatgttctgatctttgttatttcttttcttctgctagctttgggtttggtttgttcttgtttctctagttccttcagatgtgacattaggttattaatttgtaatctttcaggctatttgatgcaagcatttagacctataattttcctcttagcactgctcttgctgtattctgaggttttgaaaccttgtgtcactattattattcattttgaatcatttttatatttccattttgatttcattgctaccgcaaaaatcattcaggagctgattgcttaatttccatgtatttgtgtagttttgagggttccatttgaagttgatttctagttttattccattgtggtctgagaagatacttgatttgatttcagttttaaaaaacttaatgagatttgttttgtggcatgtcatatggtctatcttggagaatgttccatgtgttaatgagaagaatgtatattctgcaattcttgggtagaatattctgtaaatattattaggtcaattttttttatagtgtagattaagtccggtgtttctttgttgactttctgcctctatgatctgtctagtgctgtcagtggagcattgaagttccccactattattgtgttgctatctatctgttttcttaggtctagtggtaactgttttatgaatgtgggagcgccagagttaggtgcacatatatttaggattataatgtcttcttgtgaccttttttgccccccctttttttcttactattattgctttagtctgttttatctgacatcagaatagctactcctgcttgcatttagcttccatttgcatggattaactttttccacccctttaccttgagtttattagaacccttacatttaaggtgatctcttgaagacagcagatatttggctgtgatttttttaaaatccattctgccaatctgtatcttttaagtggagcgtttagacaatttacattcaatgttaatactgagatgtgtgtactgttcagtcatcatgttgatgttgcccagatgctttgctttctccactgtgcggttgttttataggtctgtattagtctgttctcacactgctaataaagacatacctgtgactgggtagtttataaaggaaagaggtttaattgactcacagttcagcatggctggggaggcctcaggaagcttacagtcatgggagaaggaaaagaaaacatgtccttcctcacatggtggcaacaaggagaagtgctgaggataatagggaaaaacaccttataaaaccatcagatctggtaagaactgactcactatcataagaacagcagcatgggggtaactgcccccatgattcaattacttcccactgggtccctcccatgacacatagggattatgggaactataactcgggatttgtgtggagacacagccaaaccatatcattctgcctctagcccctcccaaatctcatgtccacatatttcaaaacacaatcatgccatcctaacagtcccccaaagtcttaactcattccaacattaacccaaaagtccaagtccaaagtctcatctgacaaggcaagtcccttctgcctattagcctgtaaaattgaaagcaagttaattacttactagatacaatggggatacagacattgggtaaatacaactattccagatgggagaaattgaccaaaacaaaggggatacaacccctttcaagtctgaaatctaatagggcagtcattaaaccttaaagttacaaaatgatctcctttgactccatgtctcacatccaggtcatgctgatgcagaaggtggacatccatggtcttgggcatctccacccctgtgactttgcagggtacagcccctctcccagctgctttcacagctggtgatgagtgtctgtggttttctaggcgcatggtgtaagctgttggtgaatctagcattctggtatctggaggacagtggccctcttctcacagctccactaggcagtgctccagtggggcctctgtgtgggggctatgacaccacatttcccttccacatcaccctagcagaggttctccatgagggctccattcaagcagcaaacgtctgcctggatatccaggtgtttccatacatcctctgaaatctaggcagagcttcccaaaccccagttcttgacttctgtgcacccgcaggcccaacaccacatgtaagccaccagggctttgtgcttgcactctctgaagcaacagcctgagctgtacttagcctccttttagccatagctggagctgaagcagctgggatgcagggcatcatgtcttgaggctgcatagagcatgggggccctgtacatggcccacagaatcatttttccctcctaggcctctgggcttgtaatagtaggggctgccatgaaggtctctgacatgccctggagacatttttcccgttgtcttgatggttgacatttggccccttgttacttttgcaagtttctgcagctggcttgaatttctcccacaaatttttttttctattgcatcattaggctgtaaattttccaaacttttatgctctgcttcctcttgatcgctttgccccttaggagttttttctgccaagtacgctagatcatctctctcaagttcaaagttacacagatctctggggcaggggcaaaatgccaccagtctctttgtgtaccaagagccaccattactccagttcccaacaagttcttcatctccatctgagaccacctcagcctgcacttcattgtttatatcagcattttggtcaaagccattcaacaagtcctaaaatattccaaacttctccacatcttcctgtcttctaagccctccaaatctctaggaagttttaaacttttccacattttcctgtcttcttctgagctctcaaaactgttccaacctctgcctgttacctagttccaaagtcgcttccacattttcaggtatctttacagcagcgccccattcccgttaccaatttactgtattagtccattcttgtgctgctaataaagacatacccaagactgggtaatttataaaggaaagagatttaattgagtcacagttcagtgtggctggggaggcctcaggaaactgacagtaagcaaacacatccttcttcacatggtgccagcaagaagtgcagagtgaagtggggaaaacctccctagaaaaccatcagatcttgtgagaactcactcactatcatgagaatagaagcatgggggtaactgcccccatgattcaaatacctcccactgggttccttccacagtgcatggggattatgggaactacaactcaagatgagatttggatggggacacagccaaaccataccaaggtccttgagttttatgctttcaagaggtctattatggagcatattgacctattgtttcaagatttagaactccttttatcatttgttgtagggctggtgtggtagtgacaaactccttcagaatttggttgtttgaaaaagactatttctccttaatttatgaaacttagttttgctggatacaaaattcttggttgatagttattctttttaagaggctaaagcggacaccaactccttctggcttgtaaggtttctgctgagaagtctcctattagtctgataggttttcctttataagttttctgatactgttgtctcactgctcttagaattctttccttcatgtctacttctgaagcctgttggccatatgccttggtcatgcccttttttcagtgactctcttaggagttctttgagattcttgtatttggatacctaaatctctagcaaggccaaggaacttttccgcaattattccatcaaataagttttccaaactttttgctttctcttctccctcaggaacaccagtgattcttaggtttggccattttacataatcccatatttcctagagactttgttcatttcttttaattcttttttatttctatttttgtctgattgggttaattcaaaagccttgtcttcaagctctaaaattcttctacttggtctattctactttttaaactttcctctgcattttgtaattccccaaatgtgtctttaatttccagaagttttgattggttttcctttaaaatatctatttctttagagaatttttcattcacatcctgattttttaaataaaaaaattatgttggtttttatctttctcttatatctcctcaagtagcttaataatcaaccttttgattttttttatctggtatttcaaagattacttcttggtttggattcattgctggagagctactgtgaccttttgggggttgttatagaaccctgtttcgtatttccagaatcattttctggtttcttctcttttggatagataattttttctaattattcttgaatttatttttgattctactgtgttttcttttttttccctcttgatgatgcgactttagtatttacagtttattctagcctaatgaagctcttggtgctttcaggggtgaagactctgtatgaaattcgttgattatagatagtctttgtattatggctttctcagatgttgattgtagtagcaatgtgttcagtgtgtgagcaggttcatagtctcttgtggggttgaaatggcagaggtctcttgaagcttatcttattccccagtgatgtgcacattttaatttatttttttccccagtattttacttactgggttgaagaattcaggcttcaggccagtaggggaggtgtctgtgggtaaaaaaccagtgtggccaaagcaggtgggtaaatgcaatacccagtggtgggcagaggtcctagccttgatagaggaggctgggggagctctcagtgaaacacagtgagttctctgcaggggaaatttaggcagccacattagcttcccagccaggccagcaggaaagcaatctacctcccagtcatactcctgacccagtgttctagctattcacatcagacaggtgcctctttccatctccaagaatgttgattctctaagtagatagggattgtgactctactccttgtgcaagcctgaacctggagggcactcctcctgtgaggaaggagttactctgaaccatttcagaaaggctgtctataggtgtacccacacgaagctcccatgaaagaatccccagctgtatctgcaatggtggatgagggggagaagaagtccccttctccaagacccttcatgagtaccagggctgcccaagtattggatagagctgcagactttccctgtggagtgcagcacttcacttttgcctctgctgaaagaaacttcccacaagcagaaagttctgggactcaagacctgccatctggattcttttgtcccatggggtgctcccttgatgtggtgcagtccccctttctgcaggaataggagtccctgagggccagattactgtgaatgatgctgctcctcttagtttagccacccagtggggctgtcacactccaagctggtgctagggaatgtctgcaagggttccagtgatgtgaactgtcctcaagtctctgagcagcaggtaccagcactagctctgatgcaggtggcaggggagtgacatagactctgtgagatcctttgggtatacatagccttagtgtgttggctttctcaaatgttggctgtagtagtaatgaactggtcatgtggacagaccaggaccttctcattagctagggtgatgcaggcaatggtgaaagctgaggtcatgcacaagttttctctggcctgggcgctgtgtcattttaactgcagatggtgtaatggactgtgttggttggcttctagtaggtggtggcacttgcaaaagagtgccagctgtggtggtagcagtggattttttgttgttgttgtttccatgagcaaatatacagatttattttttatttatttttaaattttaaatttttattttaatagattttaagggaacaggtggtgttttgttacatggatatgttctttagtggtgatatctgagattttggtgcatccatcacccaagcagtatacactactacactgaatgtgtattcttatttctcatcccacttccaccctttccttggagttcccaaagtccactatatcactcttaggcctttgcatcctcatagctttgctcccacttatgagtgagaacgtacgatgtttgcttttttattcctgagttacttaacttagaataatgatctccagctaggtgcagtggctcatgcttgtaatcctagcactttgggaggctgagatgggcagatcacctgaggtcaggagtttgagaccagcctggccaacatggtgaaaccccgtctctactaaaaatacaacattagctgggtgtgttggcgtgggcctgtaatcccagctacttgggaggctgagggaaaagaattgcttgaacctgggaggcagaagttgcagtgagctgagatcacaccattgtagtccagcctgggcaaaaaagagcaaaactccgtcacacacacacacatacacacacacacacgcaagaataataatcttcaattccatccatgttgctgtgaatgtcattattccgttcctttttatggctgagcagtattccatgatataaatatatatatatatatatatatatatatatatatatatatatatatatatatacgtatatatacacacacacacacaccacattttctttatccactcattgattaatgggcgttggggctgttacatatttttgcaattgtgagttgtgctgccataaacatgtgtgtgcatgtatctttttcatataatgacttctttttctttgggtagatagccagtaatgggattgctagatcaaatggtagatctacttttagttctttaaggaatctccacactgttttccatagtggttttactagtttacattcccaccagcagtgtaaaattgctcctttttcaccacatccatgccaacatctattattggcacatagccactggtctatgtgcctatttttataccagtaccgtgctgttttggtgactatggccttatagtatagtctgaagctgggtaatttgatgcctcaagaacaatatgatttattcttttcgcttagccttgctttggctatgtaggctcttttttggtcccatataaattttaggatttttttttctagttttgtgaagaatgatgatagtatttttctttgctttatgttacccaggggaggtactcagacaatggattgggacatagagctccccaaaagttccatcatttgtgttaagctactaggacacatggaggggcaaagccaagtcgtgggcgctgggtcaggcaagtatgtgttctggctctccacgtgtgggcacaagcagtggctccagaggggattgtagggcagttctctagctgctggggtaatgttccagggaggagcacaactgcctctgttgtacagaagagtcttcatggggagtggggagtagcaggtgacagtaagccctacttagctcctatgcacttggcaaggctgttttcacacttgcagtgttccactagcagcagctagctagtttccaggcagtctgcatcaggactcaaaacttccccaggccataagctttctccatggagacagaaaccactgtgcccaggccatgcccctcccagcctgccctagaagcaggggcacactgcttctgtgcttgtggcttcagcccacttcccactcacccctcagttctggccaagggagttcatccgtacttgagattatattgtgaatcttaactgggggcttctcccaacctgttgtgtccggaattggtgggttcttggtctcactgacttcaagaatgaagccgcggaccctcacagtgagtgttacagctcttaaggtggtgtgtctggagttttttccttctgatgttcggagtttcttccttctggtgggttcgtggtctcactggctcaggagtgaagctgcagaccttcgcggtgagtgttacagctcttaaggcagcgcgtctggagttgttcgttccccccagtgggcttgtggtctcgctggcttcaggagtgaagctgcagaccttcgtggtgagtgttacagctcataaaagcagtgtggacccaaagagtgagcagtggcaagatttattgcaaagagcgaaagaacaaagcttccacagcgtggaaggggacccaagtgggttgccactgctggctcgggcagcctgcttttattctcttatctggccccacccacatcctgctgattggtagagccgagtggtctgttttgacagggcgctgattggtgcgtttacaatccctgagctagacacaaaggttctccatgtccccactagattaactagatacagagtgtcaatacaaaggttctccaaggccccaccagagtagctagatacagagtgtcaattggtgcattcacaaaccctgagctagacacgggtgctgattggtgtgtttacaaaccttgagctagatacagagtgccgattgctgtatttacaatccctgagctagacataaaggttctccatgtccccaccagactcagaagcccagctggcttcacccagtagatcccgcaccggggctgcaggtggagctgcctgccagtcctgtgctgtgcgctcgcactcctcagcccttgggtggtcgataggactgggtgccgtggagcaaggggtggcactcattggggaggctcaggccacacaggagcccatggagggggtgggaggctcaggcatggcgggctgcaggtcccgagccctgccccgcaggaaggcagctaaggcttggtgagaaatcgagcgcagcgctggtgggctggcacttttgggggaccaagtacaccctccgcagccactggcctgggtgctaagttcctcattgcccagggctggcagggctggccggctgctccaagtgcgggcccgccaagcccacgcccacccggaactccagctgttccgcaagcaccgcacgcagtcccggttgccactcgcgcctctccctccacacctccctgcaagctgagggagtgggctctggccttggccagcccagaaaggggctcccacagtgcagcggtgggctgaagggctcctcaagtgccgccaaagtgggagcccaggcagaggaggcactgagagcgagtgagggctgtgaagactgccaacatgctgtcacctctcactgtgaccactgcctgtgtcagctggcagacttctgtgaggtccctcccctgtgaggtaggatcaggaatggcttccctctatctctcctggagactgggaatgcacacaaagcatgtctcaatgttactctttctcatatactccctactgctccctataacagctccagtgctgtatagggttaaggccttcccctgtgcttgggttgccaggttccccagtaggagtgtatatcctggaggtagtttatccctctctcacattcaggggacttacggttttctgcctggctcatggtgtaggctgaagcctgccacttcattcaaagggtctgtggtttcttttagttttcctgttaagttcctgtattgcttcttggagaaaagttcacagtgtgaatctctgtgcactattttgtctttccaaatggaagaagcatgccaccaataactccaatctgccatcttggaaaaaaatgtacatatatcaagacgatattttcatttcattctttgaacatattttctcttaattccttgaacatatttaaaatagctgtctgaaagtcttctgtaaatccaacacttgcggcatcttgggattggtttctattgattacttttttaaaaaaaactgtggatcacgtgttccttttttctttgtggatctagtcatttttttattgtatgagggacattgtagacaatatattgcagacactcaaatctgttatttttctctgaagagtttcatgtgtgtgtgttttgtttgtttagaaggcagtagaattattggctgatcacattgaacttagataggcatggttttatgctttgctggaatggttctgtggaaagctctaggtgctgcctaagcccctataaattactaggacttaacttacaaattacttcctctgaagatcttgtcaagacttagttctaggcttttcttggactagtttagtctgtattcatagggcagtgtttctctatcttttttttcattactataaaagagatttttaagacatttttttcccagttttgctcccccctcctccatgaagttttaataccacagatataactctatatctgtttatgtactgtggttctttgaagaggtacaaagcattgtaatatctaagattctttttgctccccgcctccctgccaagaactaattttcatccgttggggatgatattccccttgttgcgaatgcattttctatggtgtggtcctaaggtaaagcctttctgatatctctgctggatgctccaaagattaataaggtgttcatgggttttttttttttcttccctggctgtgccagaatgccagtatcttccaacaatgctcaaaatctcatacatcttttatgtttttaatcctatagcagccactctataagctttgggtagtgctgtcctgcccacgtacagcccatctctcagcaatgtacttgcagggggctcctacacggactttgaggaccccatgttgcatggtttcttcctctctggtgccctgccctgcatgttttaacttttagcactttgaattctgccttcttatctcagtaagactgctgtcctctgcttggactctagctcactttactgtggttgggagttgtcctggcacaaagagatgggaaattgggattactttgtgagtttttattctctcagagattgcagtcttacactgcccccttcccaatgcctgaaaatagttgcctgttttgcccagttttatggttctgtggtcatttatggagggacagtacacctataccaataactacagtttctctgacttcttttggaagcagaagtcctccttctactactttcaattctcatctgcacctagtacaggtgataagcattctatcagaattaggacaataattttctaacaggtcttctgatctccttactttcagcctccatactacctccagagtgaactttttgaaacacaaaaacacaaatctcctgtcattctcctgtttggaacccttattaggcactcctttatccttaggataaagttcagtcctttaaagtagctcacaggtccccctctatgatctttcttccagctctctctccagccttggctttcactctcgaccttgaacctttgtgcatgtcatactacttttttcagtttgtcatatgtgcagtggttttacttgcctccttgcctttgcacatttatttttctttttccggaattcctactctgtctccccactttacttggctaactcttgctaatcctttaggttgcagcacagatttaacttcttctggtagtcctataccaggatagaggccctgttttatgtttcatacactaccctggtgtcattattaacagttctttttttcttttccttacttccacaagaaataagctctataaaggcagggattttatttgtcttgtccagtgctatatccatagtgcttagtacaatgcatggttcacaagtaggtattccattaatatttatttattgaatgaataaatagagatagtgtttattccctttttcatatgattgctctttaaatatataggataactcttgtgggttccttatgtctttactttttgaggctacatattcagagatcataaaggaaaggtttaaatatctatagcaggagttggcaaactatggccctgggaccagatctggcctgctctctgcttttgtaaataaggttttattgaaatataaccataccagttttttttttcacatattatctatctatggctgcttttgaactaccatggcagaattgcgtagttaggatagagacatatgacctaaaatatttactttctagtcctttacagagaaagtttgctgaccactggtctacatgaagtttcctatgcatcctcaatttatttaaatgaagaagcataggaaagtatgctagagtatatgttgtaagtgatatactaggctagtctgaggtcagcaactaaccttaaaatcttagtggcttaacacaacacagatttatttctctctcatgcaaatttctttgatgcttggacaattttccagtgtactcctctccgtatagtgacttagagatccaggcagcttccattttgtgttccatcaaatcatctattttcttgatttccctggcgcaggaagaggaagctagagggcctgcaattcttgggactgaaagtgacacatagagcttcttctcatagctcattggccagaagtagtcatatggccctgcttagtgaaagttggttggaaagtaaggaaagacatataaatatttaatgagcgatgagcatctctgccatagaaagattgccttaaaatgattaaatgcttgttttttggggaaagttttcaacttaacattttcagcttcagttatcttgaacatgcaatccttccaagtaacacattataattatgtttttattttacagataccataccccgaatagtaaaatattatcaaaagtaaataggacaaggatttttttcttaaaaaattgggtctactggtttttaaaaattggattttatttaaaaaaattcactgacataattttctaagaatatatcaattaagcaaattaaataaaatacagtaatggttgaaatggcctgaaggatctccctgacacaaggggatccttttataaacacttacatggagactgaaaatttatcctgctaatggagtattgttatttagagtggtggtttttcactactccctccacccctttggtttgttttatgtgatagaaccctcttaggagagagcccaatttataaaacatacaaaaaggagctattgtgtctgaagaaggcttgcgttggattctgtctactcaatctctcttttattacccccatctctccctccctaaatgagtacctttttagtatccttgaggactgaaaaacactgctttaagcatctataggacataatttcgagctgtagaaccacagattttagaactcaaagggaatttagagaccatgtactctaattttactatgatttagtagatgttggttagcaactgtggagctgcaggacaacaaccaacttgtgtgcctgattttctaaaaaactaggggcatctcaaacaaaactaactctaaagtgattatttattcccaagagacctcttatattaggggaagactaccaatttacatcaaactagattccgaagggcattttcaggatctgtacttttcattttaatataatataatttttaatatataagtacccaagaacctaccctaaacaaaatctgggatcttgacagtaatctgtctttatacctcaccaacctatctctctgcctacccctatttgaactaatcatcattctggaccctatgtttctatttgcttgcttttctttttatatagttttattgcatctgtatgcattctctctctctctctccctgcccccttgctgtttttaactaaaaaataggggattgtgttgtttataatcttttgaagtacatttttaaaattcagtattatactgctcagaatcatccatattgttgcatattatagtcattcataccttttgactgctctgtaatattcaatgtgtgaatataacagcttgctatggcttgaatatttgttctttccaaaactcatattgaaatttaatccccaatgtggtggtatttagaggtggggcctttaggaggtgatttgcagtagtatttctgtgcataacattcaagctgagagccaagtcaagaatgcagtcccatttagagtagacacacacacacacacacacacacacacacacacacccctaggaatacatctaacaaaggaggtgaaagatctctataaggagaaccacaaaacactgctgaaagaaatcatagataacataagcatatgaaaaagcattccatgctcatgaattggaagaatcaatatctttaaaatgtccacactggccccaagaaacttatggattcaacattattcctatcaaactaccagtgtcatttctcacagaattagataaaaacaattctaaaattcatatggaaccagaaaggagcctgaataaacaaagcaatcttaagtaaaaagaatgaagctagaggcatcacattatccaacttgtttatactataaggtagtggtacaaaaacagacacatacaccaatgaaacagaatagagatcccagaaataaagctgcacaactacaaccatctgatctttgagaaagtcaacagaaataaacaacggggaaagaacttcctattcgataagtggtgctgagataactggttagccatatgcagagaatgaaactggatccctgcctttcaccacatacaaaaattaaccaaaaatggattaaagacttaaatataaggcctcaaactgtaaaagtcttagaagaaaacctaggatgtaccattctggacattggctttggcaaataatttttggctaagtcctcaaaaacaattgcaacaaaaacaaaaattgacaagtggtacctagttaaactaaagagcttctgcatagccaaagaaactatcaacagattaaatagacaacctacagaaagggagaaagtattcataaactatgtatccaacaaaagtctaatatccagactctataaggaacttaagcaattcaacaaaccaaaaactaataacctcattaaaacgtgggcaaaggacgtgaacagacacttatcaaaagaagacagacaagtagccaataaacatatgaaagaaatgctcaacatcattaatcatcagagaaatgcaaatcaaaagcacgatgaaataccatctcacactagtcagaattgccattattaaaagacaaaaaataacagatgctggtgaggctgaggagaaaagggaatgcttatatgctggtggtggaaatgtaaattggttcagccactgtggaaagcagtttggaaatttcccaagaaacttaaaacagaactgccattcaacccagcaatcccattatttggtatatacccaaaagaaaataaatcattttaccaaaaaagacacatgcactcatatgtttaccatagcactattcacaatagcaaagacatggaatcaacctaggtgcccatcattggtggattgtataaagaaaatgtggtacataaacatcatggaatactacacagccataaaaaataaataatgaaattgtgttatttggagcaacatggatgcagctggaggccattatcctaagtgaattgacacaggaacagaaaaccaaataccacatgttctcacttataagtaggaactaaccatttggtacacatggacataaagatgggaaaaatagacactggggactagtaaagtgggtagagaggcagggggtcaaggggtgaaaaattacctgttgggtactctgctcactacctggataatgggatcattcgtaccccaaacccatgtaacaaacccacacatatgccctctgaatctaaaataaaagaagaaattatagaaaaagaagtgattgggtcatgagggttctgtgctcattatggattaattcattcatgaattaatggattaatggtataacagattgattgcttatcatgcatattagtctattcttgcattgctataaagaaataactgaaactgggtaatttataaagaaaagaggtttaatttgctcatggttctgaaggctctacaggaggcatgatgctaatatctgcttggcttctgaggaggcctcaggaaacatacaatcatagtggaaggcaaacagcgagcaggcatcttacatggcaggaacaggagcaagagggcgaggggtaggtgctacacactcttaaatgacccatgagaactcactcactatcttaaggacagtgccaagagggatagtgctaaaccattcacgagaaatccacctccataatccaatcacctcccaccaggccccacctccaacaatagcgattacaactgaacatgagattgggtgtggacatagatccaaaccacatcatcatgggagtgggactggtggctttttgagaagagaaagggagacctgagcaaacacttttgacctccttaccaagtgatgccctttgctgccttgggactatgcagagagtccacaccagatgtgacctcttgactttggacttctcagcctccagaactataagaaatacatttattttctttataaattacccagtttcaggttttctgttataagcatcagcaaatggactagtacatagtttattcatcctcttttctgttgatgggaaattgggttatttctaggttattgctgttgagtacagtgatggctatgaacattcttgtgcatatctctttttgtacatgtgcaagaggttcttttgggtatacacttagtgactaaattactgggtcatagagtatgtgagttttccactttagggagtaataccaaatcattttctagccctttagccaatatataatggaagcaacagcattttttttcttttcttatgaaagagcaagcagctatttagtcctgtccctacagttcccatttcgttttcactgggacctgcattaaaacacatctgagggtgtctcactttgaaaacaggtgtgttcaatcatctactttcaccttaggtcatcctcagtctagttagcagtccttgctcctgacataaggtataaaaacactctcaggaccacttcaggttttatctcatctcactgctatgttctgtggcagtaccaccttgattttcctagctgctttagtccttatggttcttttacatctcacctagctttctggctttaaaatccctagcttgcacctacatgttgaggaaagataactcttaggcctccctgacttccagattccggattttttttctcacctttgacagctgagagctccttaaacgatgggtgacacattcaaatgcttatataggccagggtgggagcactaatgagtgactcaggattccaggattaatataacactatcaggagcagtgggactgtggtggcctgatgatgggggtagcttctccttatggggttgctcccaggacttctgatttttccagagaaaaatagttatctagatttttaactgaaatctcttgacctttgagtgtcaacaatagatttaatatttagaaacactatgcaggccaaatgaaatatttctgacctggattcaacccataggtcgcccgttggtgaactttgcctcaaactttggcttatctgccttttgctttggccattgcctcacctgcctgttcctgccaaggtgtgcccctctctctggaggagacctcattgtgacatctctcaggtttaccttgacttccaagtgacctgatactgacagcaggcagggcaatgtctgattacttaccctttcctttctctcactgcttgccttaaatgcttctatcaaattctggttcttggaggcctgacttgttttgataatttttagaagagaaatgttatatggaatgatatttttttaacttgaaaaaagtatgacaagaggccaggattttattatttaatggctctcaaacttatttgcagttttagggcttctctgcttgatcttgctctggtgttgatcaggtggccctgacttcactggatgctggatttgtccctactcttgtcctaatggattggtgaactaaaacagcagttttttgatttaggaaaataaggtctttgactttcccccgtcttagaaacggtcacaatattttgatttgagattctaggcttttgagcatttgagaatatccttctcaaaacagaaaacctttgctttctttgcaattatttggcacattctaagggtggatatggtcagtatccagttgggaaataaagaaagtgcttcataaatcacacaactttttctgttgctgagtcagtatcagacacagatattttctgagtcaagcctgctgttctgtcaggtgggagattatgggtaaggtctgagattgagtggagttcgttagagcaagatgctaatgagcacagggtcatgggtttgatccccatacaagtcgattagcttaaaccataaagggactcctggctcatccatcctggcaaatatgtggtcacaggcctaaggaagactaggttagagagtgagaaaaatccttcatcatcaagaggaaaaaaaacaaacaaacctcaaagcccatgtcctattggatgtagtaagtgatatcatctgtggttgtagtcagtgcctatattacttatatgtagggagaagatttgcatcccattaaatctcccaaaatatgtaatatagcatgcatgaggttaaataaccaatgggaactatagtgacatccaaaaactctcgcaagagaagtcttatagctaactgagatggggtggaacctccatggccatggtggaactctgtgactgtgctgaagacctcttgtgcaattaattccttgttgggcatgaagccatgcacatataccctaagacaatgctgtcttctcctggaggatggataaaagggcagagaggattgtgtgagggcctaggattgtagccacttgtcctatggctgtcttattcactctgtatatttgcacaccctggtttcacattatctgagtgttttcctatggaaagaggttttcctatcttcattataagaaggacagtattttctagccatacccatttttcaaggatgatctatttaaaaattatttttcccaatgaaaaatttcaaatgaagtaatcagaatagaataatgaatgtccatatacacatcatctggatttaacaattgtcaacattttgccatatttgcttcattattttgtgtttttttgctagtgttatctcacctttacatatttttcttaaaaatgacaattttctgcataactgtaatactattatcactcccattaaaattaactatataatttcttaatgtcctgtagtactgcaaattcaaattgctcaattgtccccaaattgtcttttgcagccagtttgttcagtcaggatctaatcaaggatagtgaatttcttatgtgtgtgtgtttgtgtgtgtgtgtatgggcatgtgacatggagctgtggaagagacaagccagttggtctgtacaatgtctcatcttttggatttgtctgagttttcaggatgagttttgaagatttgtatttagtgttgaaaatgggcttgggtctggagattggcagtggccaggacaccctgtacagggaggaccttcgaaaatgagggaggtaaacacaaaggcagtaggaatgttccatatttttgtgtcttgcttcccagcagggctgacagacacaaactcatgtgaacacacagggacatagacctttataaaagaactgggtaatgtttttctctttgccaggccatagatagcacagaacttgaggatatgataatcctattggctgtatattttgaatagtgtatcctgaataaacaagataaaaccaagaggcagaaaaatgaatagaaattaaagctatgagaaagtcatagaaaattcttagtggtctgacattttgagtttgttcttctttggttaagttcactcatctctcttgggagtagagagaacccatatttgggataaacaactgcagaggaccaagagtcttgggagaagctgatgacaggcattcagaggtaagacttgggaagaaaatagccacagaaggaaagtacagggaggcaaacagtgggaggggccagctcatctcttttctccttccccccaaagactgctggttgtcagtgggcctataaaatcttttatgatcttaaaggtattttggaagactaagtcaatctttagcattcttaacctggagcaggggttctgaaacttgaactggcacattggcatcacctgggaactctaaaacacactgatgtctgggtaccaccctcagaaattctgatagaatttgtctcaggtgtggccagggcaacgggctttttaaaagactttccaagtaattctaatgagtatctaagtttgaggaccactgatctagatcaattaaccatacatacatatatatatatatatatatatatatgcatttttttttaaaaagatacatttaacacctccccccacccaataaaccttatggaaacccaatgcataaaaaagattaaagtggaggtgctttacataaggtgctcttgaaacctggctgagtaggcaccatttgctacacccactccccgtttctttcaaaccctctcatcttcctacagcagtgtcttcaaagaattagggtctgaagagtaggactatttgaaaaataactggtccagagtttaaagggttttaaccatctacatctagaactctggctctttcaattaacttattaactgtatgactttggacaactataaactctctgaacctcagttctcttatatcttaattagagatgatacctatctcacaggttgtaatgaagactaaagttggatatatgctagtgtactgtcagtagagattagttccttcagtagttcaggctttcctccaggctactgcaagctttcaggtctgtcctgggatgggactgatggtttggtttaatctgggaacttcagttaccttcatattatactcatatggtagggtgtacacagattccctttactcatgaggggtctaaaattcctgattgacttgcagcatcataggaataaatggaggtgggatgggggtggagtttgttcactgctgaatgctaagggagaagccaggagcttccatgaaatgactcaggaaatgctctataattcagataaactgttaatcaatggggagggaaccaggcaaagtccattttaaaatgaaaaaggtattaagatccataataggcatagtggaagggctgggggtgttgaggtgggaaggagttctctatggaccagaggagcaggttcatgactgagggaggagttattgattttttttgtaaacaatagatttttaagcaggaatgaagaaacatgaacatattcttccctatttttttgttccaatatggttaaacaaaactcccagataatatagaaaccttgcttattccccttatgaatattttaccagtattgctaagaagtgaaattgattgatattaatttaacttcctcctcttcccacccagacattagtaaatagtgaaatggttgtaagtgttcagggagatgacaaaagagaagtctgaggcttgaggaattacgaagtcagatgatctgtaattgaataatattgagtagaatacacaaatcaaaagtggtgtaaaatctattacaggaaaaactcatttgagtctggccctgtcacagtcattgaactagtgattcaagtctgaacatggccagcagtggtatttcctgtttatctttcacaaagctggcaacaatttccacattatgttctctgcacatctccaacctctacggaatgaaaaatgcattttagtttcctcagcattcacaatgtagaaccttccagagaagctttcttttctttctggcatctggataaatggaggaatagcacgaagcggtaggtgcttaggccaattaagatgtttggtgggctcagtggggatgacccttagtctttaaaacatttttttgtaattatcttattcacatattattatccaaaataccatgactgtggttttggttgctactgcactttaatatagtagatgtatttttactttctatttttctttttttttctttaaagatttccattcttaatagatgagaaaaaaaattcctaagaagtaaaatgttaaagatgcttatttgggatcataggatctcttttagcaatttgcaatctgaagcggagaccacacaatttctggccacattgggatactgtctatactgctgcctctttctcacattatcttcctgctatctgacatacctatgctcacatccaggtactgaacaggggccctacatggctctgaggtaatcagagttcacttgtccacaacttgccattgaaaggctatgccctttagaatttcgtattctgaagaaaatttctattttttttaaatgtttcaatgttagtgagttgcctgaggaaagaatgtgataaaggtagttctaatcaaggtatatgtgagagactaattaatggtaggactcaatgttttatcctgatatgagtatactcatttcaaaaggagtctcctgtaaactccagctaaacaaacacaaaggcattttcaggatttcaggtatacatttgatggctggggcagagtggtgtatagagtttttcatgtagaccctcctcaaatctcaacacatgacttctatttcaaatctattttaaagaccagaactatttaaattttaccctaacatgactaaatttactttcctttatacctccacattgccaggacatttaaaagcctcttccaatcctaccaaagataagacactgatgacatctcatctcctgcctaacttgtgactattctcagtattggtgaagaggtgaaatttgtagatgagggattttaatccttcactttgtatttgatacatgactttatgtattatggtgctgatttttcagcacatctttattttcccttttccagttttaacaatgaacttttccaatctatcgttacttagtgaagacggttaatagtgaatacatggttcaggtatttcttttaacagccctgcaaatagaaatacagtgtaagtcccatatatgattatatattttcctataatcacattaagaaaagaaacaggtaaagtaaaattttaataatacatttaatccaatatgtcagaaacattatcattttaacatgtaatcgtgtaaataatgaggtatctcatttttttcctgaaaaaaaatctttgaaatctgggatttctttgaaatctaggaggtattttacaattacagcctatctcaatttgcaggccatattgaagtgctcaatagctgagtgtggctaccatattcacagccttagaaaattttgagtaagatgaatataagctgtgaacccgtacttagtttcagttagactatcttctttatgaaaatgtttaaatctaaactaatttttctccccacatatgcttctctgctagtgttctccaattcagtagttggccctgacatgcctgtcatatgtggttttaaaggcagaacatggtagacctctaagaggcattaattacagtgcgcacagctgtatgtagcagtatgggctcaataacactacttagttgtccatgccagaaaaagagttatttgagacacatcatcttcctcatttctacactccatcttccaaaattgtctttcactaagtcctttcagttccacctccagagtacatctgggaccggatcacattactccatctctacaatcttctctttaagtaggctgctacctcctagatggctgcaatagcctctaacaggcttcccacatcctctttggatattctccagtccattctccatgttgcaacctgttttgtgaaaggcaaatctgagcatgccacactcccacttaaaatcctctgacaggctgggcgcggtgggtcacgcctgtaatcccagcactttgggaggcccaggcggacggatcacaaggtcaggagatcgagaccatcctggctaaaacggtgaaactccatctctactaaaaatacaaaaaattagctgggcgtggtggcaggcgcatggagtcccagctactcgggaggctgaggcaggggaatggcatgaagctgggaggcggaggttgcagtgagccgagatcgccccactgcactccagcctggatgacagagcgagactccatctcaaaaataaaataaaataaaataaaataaataaaataaaataaaataaaataaaaaaataaaatatcctctgacaacttcccaggcttttatacttgagtccaaaatcctatggtgacctacaaggtctttgtgatctggctctatttatctactactccttccttctttattttgctatgctactcgctcttcctgtgtgaggattttcacatactctcttacttttatctgcagtgcttgtttgcatgctctctctctttctctctctttctgtttctctctctctgcctggctaacctctttttgctgttctgcttaaatgtgactttttcaggaacaccttctctaacttccttgacttttgggccccatcctgtatgtttttatatcaaacaggaccactatgtttttttcaggacacttatcacaattttatctatatgattatttgtgtaattttagtatattatctgtctccactgatgtaagcttcatacaaatagagaaccaaatctcccttgtttattccttttatgtctgtagtactagcctagggcctggcatatattaagccttcaataacttccagctgaatctgcgaatgcatgtgctcagcccattgtctgtagcagcttggtagttttaagaggcttctcaagcttgcagaaacccttgtgggtatgactaagtgttccagcttctgtttcattgtgaagattttagaagtgtagcctttaagaggcatactacaatccttccaaaaacaaagaaagtctgaaaataaatttgggagaggatgtggaacaaagtaatttctacactaataggaaaaatgcaaattggtgtaacttctttggactgtgtccccaaacaaaagctgggtcatgtcaactggctgttattctgtcttcttggttattgggtgtttctttgtgggggtattccttctagtgggtcataacatatgccataaaaatccacattgtggccacttccatagacccatctgcagacaggcctttactcagatcttcttgtcccagatctttcaatctttcttctttcaggtgcctgcccaattagccagggtattcttcactgtttattaatccttatatcttctaacagcaagtcacttcttgtccacacaaagaggatgatttagtatactgccttcgtccattgggaagattttcccctcttcgctgtctttcgaggccatccctaagggagggttgttatgcaacagcagtccatttttgggtcacaccgagatactgagctgattcatttatgagctagttttccctctttcagctggccattagggactcaacacagggctacaggtatcgtttgaagagaaatggatgatatgggtttgacagtcatgcaatttgcttgtgccccctggccctgcctttgtccaatcctggaagtatcatttccatcttatgatggagtactaccagacctgcctaatcatatgaattattgcatttgttagaactcagcttaatgtggttatttcttattgtagggtaacttgaggttctatggtcagatgctcagtctctactagggctcagtagtattccaagagctgctgtttgaatgttatatagttcctggctgaagatggcatgctttgttttagaatcctggggaactgcttatgttatgattctactatttctttctataaaatccacatggtgtcttttcaaaccacagaaaccccaagaaccaaaagttttgccgtatcatattgcataagtcatagggtcacttttatgacaacctgaacctgctggagagccctttggtgttttgagctccactcacagctggtaaatgtgtattgttgcctaacctatgtaaatgggtactgcttctgatcttcttactgatagggatggaaaagaatgcatttgccagataaatggctgcatactacatgtcatatattgtgttaatctgctgtaatgaagctatcatatctggcccagcaattgcaactgtggctactacttggttattatagaatgttgtagattttatttctttaataattaatggacattagagattttctaaatctttaatttctaaattagagattttctgaatctctctgagcccatattggtagttcatactttcctaggaatatgtctatttcacctaaggaatttagtaaatttctcttattacctttttaatatctgctacatctgtagttgtgtccctttttgattcataatattatttgtgccctctttctgtatttctcattcacttttgccagaggtatgccaattttattagtttttgcaaagaaccaatatttggctctgttgtttccttctagtctatctttgctttctgttttattaatttcttcctcttgtctttatcttctcaatttttatattattcctatttgctcttttcttaacttttctaagttgaaggttgtattagtcagggttctcttagagggacagaactaataagatacacacacacacacacacacacacaaaaaaaaactaataggatatatatatgtatatatacacatacaaaactaataggatatatatatatatatatacacacactcacacagaactaataggagatatatatatatatgagtttattaagtattaacttacatgattacaaggtcccacaataggctgtctgcaaggggaggagaaaggagaccctgtccaagtcccaaaactgaagaacttgtagtccattgtttgagggcaggaagcatccagctcgagaaaaagatgtaggctgggagactaggcatgtctcacctttttcacgtttttctgcctgctttatatttgctggaagctcattagatagtgcccaccagattaagggtggatctgccttccccagcccactgactcaaatgttaatcacttttggcaacacccacacagacacactcaggattaatactttgtatccctcagtccaatcaagttgacactcattattaaccatcacagaggtttagcacattaatttttcaccctttcttgtttcttattataagtatttaaggctataaatcttcttttactttggatttaaaaattatgtatatttaagttgtaaatggctctaaatctgtctctatctgcatctcacaattcttgatttgtagttcttttgttatctttcagttgtatgtattttctattttttagtattttctaatttttattcttctatagcccatgagtaatttagaagtatgtttttgaattttctaatgtgtaattttgtttgatagttcgttttgctgctgattgttaatttaacttttttgtcagatattgcaatgtatgagatatagattctctgaaatttgtcaatatctattttatggcctgaaatgtggttaatttttataaaccgtgtgtgcttgaaaagaatgtgtattctcaagttgttggatgcattgtttcatagacacacattaaattaaccttgtgctgttcaaatttttatatcattattgatttgttgctgtttgacatatcagttagtgaggaggtatgttaaaatcttccatttatgtggatttgtccatttctctgtagtccagatattttttgccttatactttgaaatgtgttattaagtgcatatatatgtaaattgtttttttttccaggtagttattcatttttattttttatttttttattttttatttatttatttttattatactttaagttttagggtacatgtgcacaatgtgcaggttagttacatatgtatacatgtgccatgctggtgcactgcacccacaaacttgtcatctagcattaggtatatctcccaatgctatccctccccactccccccaacccacaacagtccccagagtgtgatgttccccttcctgtgtccatgtgttcttattgttcaattcccacctatgagtgagaatatgcagtgtttggttttttgttcttgtgatagtttactgagaatgatgatttccaatttcatccgtgtccctacaaaggacatgaactcaccattttttatggctgcatagtattccatggtgtatatgtgccacattttcttaatccagtctatcattgttggacatttgggttggttccaagtctttgctattgtgaataatgccgcaataaacataggtgtgcatgtgtctttatagcagcatgatttatagtcctttgggtatatacccagtaatgggatggctgggtcaaatggtatttctagttctagatccctgaggaatcgccacactgacttccacaatggttgaactagtctacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcctttgagaagtgtctgttcatgtcctttgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatgtattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagcctagtagtatagtttgaagtcaggtagtgtgatgcctccagctttgttcttttggctcaggattgacttgatgatgcgggctcttttttggttccatatgaactttaaagtagttttttccaattctgtgaagaaagtcattggtagcttcatggggatggcattgaatctataaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctttttaaagcaattgtgaatgggagttcactcatgatttggctctctgtttgtctgttgttggtgtataagaatgcttgtgatttttgtaccttgattttttatcctgagactttgctgaagttgcttatcagcttaaggaggttttgggctgagaagatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttatgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttatgcatctattgagataatcatgtggtttttgtctttggttctgtttatatgctggattacatttatagatttatgtatattgaaccagtcttgcatcccagggatgaagcccacttgatcatggtggataagctttttgaggtgctgctggattcggtttgctagtattttattgaggatttttgcatcaatgttcatcaaggatattggtctaaaattctcttttttggttgtgtctctgcccatctttggtatcaggatgatgtcaggatgatgctggcctcataaaatgagttaggaaggattccctctttttctattgattggaatagtttcagaaggaatggtaccagttcctccttgtacctctggtagaattcggctgtgaatccatctggtcctggactctttttcgttggtaagctattgattattgccacaatttcagctcctgttattggtctattcagagattcagcttcttcctggtttagtcttgggaaggtgtatgtgtcaaggaatttatacatttcttctagattttctagtttatttgcatagaggtgtttgtagtattctctgatggtagtttgcatttctgtgggatgggtggtgatatcccctttaacattttttattgcgtctgtttgattcttctctctttttttctttattagtcttgctagcggtctatcaattttgttgatcctttcaaaaaactagctcccggattcgttaattttttgaagggttttttgtgtctctatttccttcagttctgctctgattttagttatttcttgccttctgctagcttttgaatgtgtttgttgttgcttttctaattcttttaattgtgatgttagggtgtcaattttggatctttcctgctttctcttgtgggcgtttagtgctataaatttccctctacacactgctttggatgcgtcccagagattctggtatgttgtgtctttgttctcgttggtttcaaacaacatctttatttctgccttcatttcgttatgtacccagtagtcattcaggagcaggttgttcagttttcatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattaagtaatgtccttctttgtctcttttgatctttgttggtttaaagtctgttttattagagactaggattgcaacccctgcctttttttgttttccatttgcttggtagatctttctccatccttttattttgagcctatgtgtgtctctgtccatgagatgggtttcctgaatacagcacactgatgggtcttgactctttatccaatttgccagtctgtgtcttttaattggagcatttagtgcatttacatttaaagttaatattgttatgtgtgagtttgatcctgtcattatgatgttagctggttattttgctccttagttgatgcagtttcttcctagtctcgatggtctttacattttggcatgattttgcagtggctggtaccggttgttcctttccatatttagcacttccttcaggagctcttttagggcaggcctggtggtgacaaaatctctcagcatttgcttgtctgtaaagtattttatttctccttaacttatgaagcttagtttggctggatatgaaattctgggttgaaaattcttttctttaagaatgttgaatattggccctcactctcttctggcttgtagagtttctgccgagagatctgctgttagtctgatgggcttccctttgagggtaacccgacctttctctctggctgcccttaacattttttccttcatttcaactttggtgaatttgacaattatgtgtcttggtgttgctcttctcgaggagtatctttgtggtgttctctgtatttcctgattctgaatgttggcctgccttgctagattggggaagttctcctggataatatcctgcagagtgttttccaacttggttccattctcccggtcactttcaggcacaccaatcagacgtagatttggtcttttcacgtagtcccatatttcttggaggctttgctcgtttctttttattcttttttctctaaacttcccttctcgcttcatttcattcatttcatcttccatcgttgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagcttggagtaatttgatcatctgaagccttcttctctcagctcgtcaaagtcattctccatccagctttgttccgttgctggtgaggaactgcattcctttggaggaggagaggcactctgctttttagagtttccagtttttctgttctgttttttccccatctttgtggttttatctacttttggtctttgatgatggtgatgtacagatgggtttttggtgtggatgtcctttctgtttcttagttttctttctaacggacaggaccctcagctgcaggtctgttggaataccctgccatgtgaggtgtcagtgtgcccctgctggggggtgcctcccagttaggctgctcaggggtcaggggtcagggacccacttgcggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctcctttgtttacccaagcaagcctgggcaatggcgggcgcccctcccccagcctcactgccaccttgcagtttgatctcagactgctgtgctagcaatcagcaagactctgtgggtgtaggaccctctgagccaggtgcgggatataatctcctggttcgccgttttttaagccagtcggaaaagcgcagtattagggtgggagtgacccgattttccagatgccgtctgtcaccactttctttgactaggaaagggaactccctgaccccttgtgcttcccgagtgaggcaatgcctcgccctgcttctgctctcgcacagtgcgcgcacccactgacctgtgcccactgtctggcactccctaatgagatgaacccggtacctgagatggaaatgcagaaatcacctgtcttctgcgtcggtcatgctgggagctgtagaccggaggtgttcctattcggccatcttggctcctcctcctagttattccatatgtaaattgttatatcttcttgatgaattgagatttttatgtagtcatctttttttatcaataatccttttgccttgaagtctattttgtctcatactaataaaactgtaccagtttttaaattagtgttttcttgatttttctataaatttgacattaaatttttgttttattttaaatttttgtatgttaagctttagatggtgtctcttgcaataacttagagttgtattttctttttaatccagtctgacaatatttgtcttttaaccaggtaatctaggcagtttacattgatcatgattaatattatatttggattcatttctatcatcttataatggtttggactgaagtgttgatctggattgttgcacatcccttggttgaaagatgttacagccactgaatcacccaatcactgatccacatcctattattttgaactatccctatggcccccaatagcatagtgacttagggttaaatggcagtgtaaaaggatacaggaggctgggtgcagtggctcacgcctgtaatcccagcactttgggaagccaacgtgggtagatcacaaggtcaggagttcgagactagcctgaccaacatggtgaaatcccgtctctactaaaaatacaaaaattagctgggcatggtggctcatgcctgtaatcccagctactcaggaggctgagacaggagaatcacttgaacccaggaggtggaggttgccgtgagctgagatcacaccattgcactccagcctgggcgacagagcaagactccatctcaaaaaaaaaaatgtatacgggaactggagatggtaagtgggctgaagagcagtttcaggaaagaagttcatcatcatcctatatttaaaggactatgatatgtgtataaaagagggattaaaacatgagcagcaaatgacagaactagagcaaatgagtggaataataccttattccttgagcagctgttatgtgccaggaaaattgctaaatacttttcacatatagcttaattcatacaacaaaccactgagggaagggctcatcatccttatttcataggtgagaaaaatgaggctcagagagattaaagaagatacttgaagtcaaacaactagtaactggcagaattgggaatcatactcaattttgtatgactctaaaacccttgttctttttactgaattacatcacagagaggtgaactggtaaataccaaatgaaggaagaatactttttataattaaaattcataaaaaagtaatgaactatcatttgaaatggtaagcatcccatcactgggcatttctaaacagaggtaatgtggtcatgtgtcaggactgttatagtgagagttttactttgagtgggaagttgtactttagaacagacgcttggattagatggtcattaattatggtctatttcagtttccatgaggttattgaaactgtgccagagcttaacaaatgcatgattttcaaaactctccctaccttctgaaactagccgcaatgtgaacttgtcctttcttcacttagcctccttaactcactgcagtgttatgtgatgtgtacaggtggggactttaataaaaccctatttgatgatgacttgatgaaagtctatttggcctgtttagataggagaaaaacaagtcatgtgtataagtgcagtgtaaggttctttaatttgaaatactggagccaagcaatgcaaaagctgagagactccatttaatagcatgttaatatattaaaacccttaataataaattcatagcacttaaaatacaaatatttctacaatgtaatattattttacagatggtatttagtaaatagccagtatttactgggaagtggggaattcattgtcctttgtgccttgctttgttgacacattctaccatgtgaaggccaagagcccgtaagaatagaaaaacctttctgtcagcagcagcctcatcaagctggtccctctgtagactctgctctgtccacttattttctttatccttactgctaatccatcaagtaaccatttcgccttcttttaaagcccagccacaagcattatttcttcccggagctttcattgacctgtgcctctccctgcactgtacctctcgaggtatccagtagtggcagttgaagtatatgaagaaggattttatacattatttacttttgttctgagtagttcttttaaaccttgtgaaagcaatttcacaagtgtttcctatagtattgctctgatgtggataggaaagacctcattatagcctttggacatgaagaaactgagacatcaggaggctgagaattgccaaatagtggtagagttttagcatctttcagctccacagctctactagccaaatgtgcgttccaaaatatttcccacaggtttctgactcttggattttaagtagtatgttatggctggtacctgggatttggtgtatttaaaatttgtttgggccagtcgcagtggctcacgcctgtaatcccagcactttgggaggctgaggcgggtggatcacctgaggttgggagttcgagaccagcctggccaacatgttgaaacgctgtctctactaaaaatacaaaaattagccaggcatggtggtgcacacctgtaattccagctactctggaggccaaggcaggagaatcgcttgaacccaggaggtggaggttgcagtgagcagagatcctctcactgcactccagcctgggtgacagagcgaatctttgtctcaaaaaaaaaaaaaaaaaacactgtttgactcattatttgaatgggccaagcaagggctgaccaatgcatagagagaagtatggttattgaatccctactagaatgtgaacaaattttgagaaaggcctaccattgaggtgagtgtgctgtaacctgagcacgtgagaccaaaaaaacacctgagaaaaatttttgctttcaaaattcatccatgtgactctatagattggatattctggtttcatccatttagccccaaactgacagagggttgtcttgggcagtcagagatgtgtagtgtaaagattattgggcactacttaggagccaaaggttctaattatggagcgtcttaagattagattcatcttttttactttcctggcctcagctctctcttatggcaagtgaggggtttgcaatgaggtcagtggttctcagaccatagcctttggagtacatggaccagaatcgccaggttatttgttaaaagttgagatgctggactccatctaggcctactgaattggaatctctggagtggcacttgtttatctgccttttgacaagctgaccaaatatgcacactaaagtttgagtacctctggatgatgtagattctaaggttccttccagctctatgatactttgaatgagaaagacaaagacagacagcaattacggatttcatttcaggtttctttactattctttaatgtcagagcctttagtgattttaaatttgccagaaatcacctaattagcatgtgatgacaatatactattttcattttttatgtctgcctcccccagcttattatcagcattgtttctatttcttttgtgcattactacagtaatcatcaatctcttcttattcacttccatcctttgtatcatcatcagagatttttggtgttgtttttgtccataaaacaacaaacacaaaaaatgtccctcacatgattaataagttgcttttttttctggcaataaaaacccttaatttctcagcatggcttactagacctttccaagtattatttatctttgtagttttatctcccaaatttttacccacatccagccaggaatcctttaattctcaaactagtttaggtagctgattacctagagtcatcttgtttctttctttcttattaaatatgaaatagctttatagttaacttcattgtacgatctggtacaattttattcatagaaaatattactatatgataacattttagaccgtaagcatttattaataataaaaaaaaaccaagcactggatttagtttggctctctctgagttttttacctaatatattttctatcttttttaactgtttgctacctctttctgttagaaaagtgaagaaaaataccaaagaaatatttttgtaagaataacttaaaattaagagtattccacatatcaatttaaaaacaaaatttcaacagattgctacagattgcttttatatggtttaaataataaattactttgattccatttatggagcactggtgttttttgtgaacgctgttaggtaacaggacctgtgtccctgtggttctctttctggaatgcctttctgaagcttctcctcttaaagaattcctgctcatttttcaagacccagtagatttgtcaccaattgcaaagccttttctgaccctcatagaaataactatcaactctctcctctatattttccagatttcttggtatgttcatctctacttaaaaaactaatatctaacatcattataataataatgattattctgtttatctcctctcttcctctcttgcctctatgggtcctggcacaaagtttatgttccataattgatgttaaatgaatgtcttgttttgactaagatatttgttccttaagaaccttatccgtcttacctttattctgtaggaccaagaacacaagatcttatgtgtacccatttagcgatgacagactgaccaagtgatctggcttttctccacgctctgggaaatagtttaactctgtcaaagagcagtcaagaaaagttcatatattgagagtgatgtgatgatggctgtttgaaaagcttggaactacctttttagatcaaataggcttggttctgtctcaaatctggattagggccaatactttgataacccagtcagcaaagatcagaagtcaagaattcacaatctttcatcgtgctctgaaatcatttgtcaataaacaacaaagaccttctagggctggatattagagagggaagtagccgagagcttggaaggggagcttttctatcagctgaggactctggatgggaaaaaggcttagttcaggtctggtaaagaatttgagaataagcgaaattcaaggacacagtagtcaagaaagtgtttagtactgggtgttggctcggatgtgaggaaaaaggcactttacactgttagtgaggacagaagtagaaattggtacagcctttctggagtgcagttctgcaaggtgtattaaaaatgttaaaggtgtttatactttttttcccaccaattctacttctaagaatttttcctaatgacatactctaataagtataccaggatttttgtataaagaaatttatttagaacaactataaaggtcccaaaatagggaactgattaaacaaattgattaatctatacaaggtaatatcacacaggcattcaaataatgatgtagagatatatttatagaaaaggaaaggggtatatgatgtattatcagatttaagaatctatttatgaaataataggtagattatgattattttttgtaaaacagatatatacatgtatatatatattttatatatacacacacatatgctacacaatttatggaagttgtcaatgagagattttttttagtttaccttgatgttacaaattttctacagataatatataatactcaaattataaagaaataattttttcaaactatatttttcaaaatatttcaaaaatttcaaaaataattatttttcaaaataattttgaaaaagttatttcttatagaagggataattctttcagattggtattctccaggttgactgaatagtgcttggaacagagtacatgtgtgatatgtattagcaaatttaatgactgagtgaataggcaaatgactttactccaaacttggtagtgtaggttttattggtgagaattttctaaattttatccattcatcttccactggaactgcatctgtaggatagctgatttttgattcctgagatcttttctttttttttttttcctggttttcacttttttttttctctcttcaacttttattttaagttctgggttactagtgcaggatgtacagatttgttacgtaggtaaacatgtgccatggtggtttgctgcacagatcaacccatcacctaggtataaagctcagcatccattagcttttcttcctgatgctcttcctcccctgaaccgctctcccaataggccccaatatgtgttgtttcccccagtgtgtccatgtgctctcatcattcagctcccacttataagtgagaacatgtggtgtttggttttctgttcctggattagtttgctgaggataatggcttccagctccatccatgtccctgcacaggacatgatcttattcctttttatggttgcatagtattccattatgtatatgtaccacattttctttatccagtctatcctggatggtcatttgggttgattccatgtctttgctgttgtgaatagtgctgcaatgaacatatatgtgcatgtatctttataatggaatgatttatattcctttggttatatacccagtaatgggattgccggatcaaatggcatttctgcttctagatctttgaggaatttccacactgtcttccacaattgttgaactaatttacactcccaccaacagtgtaacagcattcctttttcttcacaaacttgccagcatcagttgtttcttgacttttcaatgaaccaccattctgattgcataagatggtatttcactgtggttttgatttgcatttctctaatgaccagtgatgaaaagctttttttaatatacttgttggttgcatgaatgtcttcttttgagaagtgtctgttcatgtcccttgcccactttttaatggggttgtttaattttttcttgtaaatttgtttaagttctttgtagattctagatattagacctctctcagattattagattgcaaacattttctcccattctgtaggttgtctgttcactctgatgatagtttcttttgctgtgcagaagctctttagtttaattagatcccatttgtcaagttttgcttttgttgcaattgcttttggtgttttcataattaaatctttgcccatgcctctgtcctgaatggtattgcctagattttgttctaggttttttatagttttgggttttacatttacatctttaatccatcttgagttaatttttgtataaggtataagtaaggggtccagtttcaattttctgcatatggctagccagttctcccagcaccatttattataaagagaatcctttccacattgtttgtttttgtcaggtttgttgaagatgagatgtttgtaggtgtgtggtcttatttttgagttctctattctgttccattctatgtgtctgttttttgtaccactaccatgctgttttggttactttagacttgtagtatagttttaaggtgggtagcatgatggctccaactttgttctttttgcttaggattgtcttgactattcagcctctttgttccatacaagctttaaaattttttgttctaattctgtgaagaatgtcggtagtttaatggaaatagcattgaatctttaaattagtttgggcagtatgaccattttgatgatattgattcctcctatccatgagcatggaatgtttctccatttgtttgtgtcctctctgatttatttgatcagtggtttgtaattctccttggaggggtccttcacttcccttgttagctgtattcctaggcattttattctttttgtaggaattgtgaatgggagttcattcatgatttggctctgcttgcctgttgttggtgtatagtaatgctagtgatttttgcatattgattttgtatcctgagcctttgctgaagtttcttatcagcttaagatgcttttgggctgagacgatggggttttctagatataagatcatgtcatctgcaaacaaagataatttgacttcctctcctcctatttcagtaatctttatttctttctcttgcctgattgccctggccagaacttccaacactatgttgaacaggagtggtgagagagggcatccttgtcttgtaccagttttcaaggggaatgctttcagcttttgcccactcagtgtgatattgcctgtgggtttgtcatatatggctctgattatatcatgatatgaggttacatcccttccttggtatgagtttgtgccccttcctgtgtctgagtgttgacgatatatttctgactggtcattagttgtttttgttcatttcattaagggttttgagagtcaggttccattaaccagtgtcattccaccattttattctgtgacttcttttggtgctattacatttagaaaattcttcctctctaaaatgtggtaaatatttacctacttagcttttaaaatatattttcatttaattctaaaatgtatttgaaattaatttttatatgatgtgaagtgagaccacaagttgatatttttcttttgaaatacataaccagttttacacaaaccgtttatagagtagtccattttttccatattggtttatgatgtatgttctgtcacatattaagttataatgtgtacaaggctctatttcaggcctgtttgttttgttgtgttaattcgtctgttgattcttataccaccattacactattttgtatgtgttataaaaggcagtttaatattgagtttgggtacatttccactgattttacttttttaaacagttgaactattttcacacacaatatttgccaaatgcaatgcttgacattatatcaaaaatataaattaattttggaataattaacatgttttattatgtagtctacctctccgggagcatattttatctttccatttgtttaagttttcttctatcttgcatccctcaaggttttacttaagaaatttatagtttgtaagtattatgtattgacctttccctcattacattttctaattattgttagtatatagaaaattgaatcttgaatatgtattttataattagtgattttcttgagtattattattgattttggttctttttgtatcttttagaaaagcaatcataccttctgcaaataattataacttctattctcttttgaaatagttgtatcttgtttcttttcttgcatgttagtatgatcttggacatccttaccttcctcctgattttaatgagagcagctttaataatttgcagctaagaggtaactggcctaaaagaaattaggaaatacacttagcttcctagtgaggcttaaaaatcagaaaaaaaaacagtgttgaattttatcaaatgatcttttgttctttttttaaaataattatgtcctcttatttgacctagtgatgcaatgtgttatattaatatatttctaatattaaacaatccttgcatttctgaggtaatccctacttgattatgctgggttattgttttaatatactttgacttaattttccagatttgttatttagaattttcacaactgtattcataaataaaacttgtttggaagaacatttcttgaaatgcattctaagaaggaatgttatgaggaagaaatggttccgtggtcaaatacacttgagaaaggcagattaaaacattttaacaaatttctttgctttaggtttctcagagactttaatatgctaatacatgctgtaatctctgagggagtgcttttcaagcacactcacaatagattccattcccccctcagaaagtgacactaatttccacagaaccctctttggaatattaatcattgtcatattttgttatgagggttatgtcaacgtcataaagtgagttaggatagcttttcctactttaacctaccctggaatggattatataatgcgggtctcataagtttcttgaaaacgtgaaaggcctagaaccagttttgcaaattatcccttaataacatttgctaaattttccatggctattcagctttcttataatattgaatcaatgttattaattcatatttctagaaaatggttcactttattgaaatttttaaatttgttaaaacgtgattgtgagtggaattctcttttaattcttaaaatatgtttcatttacctgttggtaaatacaatgaaatgaaatgatctgtgccaaatacttgaaacagtgcatggcacatggtaaatggtaaatgttttatttcctccccctttttcttattctgtatctttctttttcaaaaaatttagatttgtcagaactttgttgatttaaaaactttgtttcccagataataacctcttctgcttatcttttaatctacttatctcttccatctatttatttgattgtttaaaaattcatcactgttcaccctagatttatattttattcttcctgcttttttatagtttttttctttcttttctagctagcttcttgaattgattgaataattcttttaaaacaaaattcttgattagtaatgaaaatattcaagtctatcaatttgatttaaaaatagttctgtattttgtggtcctttatgcacattgtacaaaactcaaagcatacaaaagggcttacagataatagtgaattttcttcattctcctgccttagtcttcttgttcctcaccaggaggtaaccacaattatgatgttcttgtgtttccttccagaggtattctaagtggatttggctattgagtacagctttgtcagaactatatatatttttatttaattattactttcattattttaaaatagaatttgctattaatttaaatttctcacttgatacaataattaggagggtcaaattaaaatacttattcataggacattttttgttattaatttctagttttgctgcattgtgattaaagaatgtagtctataatttctgctactttgaaagtcctgaggttaatcatgtgaacaattacaaggtcaaatcttataaatattttatgaaatattttaaaatttataatcttcaaagggcacaaagtatataattaattcaaaataatttttatttattgtggtttacttgatctattacagacagcaataaatttatttccttctcaaatcgaaattttgttgttttatttatccttataataacttaaaaatttgtatgccataatattttgcataaattatgattatgataaattatgatgctatgagaataaacacaagcataaaagcaaactctggcttgtaaattttattaaataaataagtcctgaaagtaacacctatgccaggatataaacattcaattagtgcagcaggatatcaaattagaagtaaaatttttgttcagactccccatttctaatctcacatttcagtcataattacttttgaatgctttgtatttcttctaatagttacctccataactctaaataatgtgtttagatctttcattcttaattagtaactatagactttatctattgattcttcgatatgaaagagtaaggctcaagttatttatactaccctaagctttccttttcaaattcttcccaattgtaatttttttcttagatgaataacttttgtaatttttaaaaatacttaagcttcaacttcttgattcatcaactttaaacattttttggactcttggttattttttgactcttggggaatgaatttcccaatttagcattctctatgtcttcctttctctactgtctgactcctgttagctatgttatcactttatgtggggaatgtttagagcattctgttctctaattctaattaaattttctatactttgtaggttaattctgaaagtcaaatactggtggaattttaatataatagttatataaatattcatttcatgtttgaggaatattgggtatgtagagaaagcaatgcaactcaacacctacgcccctttaaggagaattttctaaaggtcaagattaaatggattttctctttctattttaatatttcatccattattcagactattgtcatgatttaacttgtttcatatttggaccattcttgggaaatgttttgggtttaattgccttttttcttgagaaaagaaacacatatctttttaccatattgccaatatcttgcaattgtttaatgctttagtaagtatcactctatttctaggtctgtttcaaagctgtcaccctgatatttctctttattccacttctagattagtttcactatttcttagatcctgtgtactcccttttaagaacatttctttttcctccccttcaggacatttattcaagtgattttttttccataaagggtgcatgggaggtaaacttcctgggtccttgtttttctgaaaatgtatttatttttccctaatccttgactgatagttttggtaggtacagaattctagatttaaaatgatttccagctgagcgtggtgactcatggcgtaataccagcactttgggaggctgaggtggtagatcacttgagatcaggagtttgagaccagactggccaccatggtgaaaccccgtctgtgctagaaatacaaaaatacttagctgggcgtcgtggcgcatgcctctaatccaagctacttgggaggctgaggcacaagaatcacttgaacctgggaggcagaggttgcagtgagccgagatcacgccactgtactccagcatgggcaacagagcaagactccatctcaatgataataataataataataataataataataataataataataataatttcttattagtaatttgaaggcattgcttctttgtctttcagcattgactgttcctaataaaaagcctgaggccaagtttattctctttactttctaggtaacctgaagtgctctatcacaaattatattttcttcagtttcattctgttcttcattattgtcaatatgcttttaaactcttgattttgttttgggtttccttatattttcatattttagccaattatttttttcagcttgttctctatttattgtgttctgaccttgtttcatagagatgatgaccttttacatatttatgaagacagcaaaactggtttaaattttcactgagaaaactctttttagaagtttctctttctttgaggttttagagagttatctattttttctgttgttgaagtatctttttttccataatcccattgttggctctttttctactttttcattcttgaattgtgtgagatttatccaggctttgtctttattaacaaaaataataggtgaattattttttgcttcacttgccgttcacacattttgcccagatttaaactaaaattttaatttgatggttttttcaaatgtctaacgggctttcatctgtcatggatttaggtgaattaatacaactcttgcattttttaaactgtaaggttacatgtaatttgaagttgtttgaatagtgtaaaacattaattagttttttctaaataactgtgcttccactcatgctgattattttgctaagttaagagatctgaggtcttttagcaaaagtaaaataagtagagctcatagaatgggaagactggtttgtgtaggagcccatgactgcagtaaagaaagttcccataagactgattgctgctcactatatttctcaccactgtagcccctgtcttctgaaacatggtgtaaactctatgggtaatcaacatcttttcttatatttttttgagaccagaatggaaggaagcacccattttatgtggttgtaaaaataaaatatgtgatgtatggtctaaaactacacctgccaacctattactgatgatacattaaatggaatttttatactcatagtaattctgatctttggctttctgtactttgccagtcaatgaaggtgtgtgcatgtgtgcatgtacatatgcgtgcatgattttttcataatgggagatgggggaggccctatcatacataatagcctgctgcctgctgccatgttaagaagtccaaccattagtctgttttgataagctaggcatctcaagtagccctattgatttttctttagttcttcttcttttttgttttctgttcatttttgtgtttttaatttatcctaggcagttgaattaaattgtcttccacttaattcatctcagcttccctcccagtctttttatgtccaaagtccttcaccagtcttcctattgcctccagattgtgagccaatttcttgaaggtggagccaagtctcactctttatatctccgtataatacatgtttcatacatacctactgataagctgatcagcttaatgatggggatagaagtgagctcctactcctgttttttccgtcaaaggtaaaccctggaaaaggacaaagttcgagtaatattttctacggagagcttggaactcagacgtcttctatggagttctcatcttcttgctcccttgccttttggtgagggaaagaatatgccacctgtcttgtctcctgggaccatgccaataagtgtgctgccccaggggctctgcaggatgggtttgttctcctgctcaccttgctccatccctgccctacctttcatctgctttcaggaggctcaaattgttttcttgtttccttctttccctttcccccaaacctccagtaaagaagagattttggtattaagaaaatgggctgttgaattccaaaatcagaaatagaccacataaatatgtatgaagcattaaaacccttcttcgaagtgtgatttcctggctaatggatgcttctgggatgattattatatatatttttgtactcaattaagccctattcagaccaacttattttttggtgaacttaaggaccttatgattagcatccattagcatttccattacatctatattgtaataataccatctaaaatttctatgctgtatctctcacagagtgcttttatgccattattttatttgatactcccaacaacaccatgaagaatgttgagattctcttaacatttttgttttatagatgaggagactgaggtgcagaacatttaagcgacttgtccaaagtcatgcagtgagtaagggagtggaatgctgactaggagccatgtcctcagctagtatggcaagggcatgctccctatcactgctagtaatagcaaatgatcactaccactgagtatttgcatcatgccagctactatattaggctctctgtatatattttctcatttaatactcctcataaccctgcaaagtaggaattgttattattccccccgttacatagaggggaactgcaatttagagaggttacgtaacttggtccaagtcacacagctagtcctagtatacctaggactatactgcagttggaacccaggtttccctgatttcaggcctcagccctagccacgtgggtccctcatggttttactggactgagctatgaagatattcaacatagcatagctcataaaggctgttccagttctcatgattccctgagctgtgattacgagctctccttgtgactcctatggctctggggcatattgccagaggtaaaattgggagctgtatggatcagaaaggcagagaaagtgaagggactaatatttactgaatgcttactatatgcccagtggccattaaaacccatatcacaggaaccttgtaagtctggtattatcatttccactttatggaggaggaaacacaggttcagagaggtaaagaaacgtatgcaagattgtaagtggaagagtcaggatttttagtcaggtctgtcagaccttatagcccatgttttctcctctatgcctaagtaggagtgggctcagtggtgatgttttaagggctaatgttgatgttttaagggctaatgagaaggagcagtatttctaaagggcttaaggaggattataaggaacagagatgaatttagaccctggtggttataatgcattataatcagtactctggagccctataaaggaactcataagagaacccaaagagaagaaaaactgtggcaagttttaggctacattgcctagcttatatcacaatgccagcagccttcaactgcaatacgtaggaactgggacttaaaaaccagcagaaacacattggtaaacatcataatgacacgcatatttaggaaaatgatgtttttaatttcaaaatctatgcagccttgccttatatagtcagtgctaggaagttgtggtgtaccaggaaatgatttacattttagccttaggcaaaaatatggaacttgtaattatgtcagagagaggcaaaaccttccagattttacagctttaaagctgtaaaagtctcagttaggatgtgtgttgattaaactgtggtgtggctgagcattttgcctgaaacttcatagggaataagcatctgttaatgactttcaggtaaaaaccttccttctaaacctttaatgcagtattgtcaaaatgtggaagtggtgggtgacaagcattttcttgttccttctaaggccttcctgatccaaggtagttttgagcacaaacggctgtgctggttaagcttttggcttgtgggaagaaagccgcacatcaactcctgatacgcacgagctagcctgaactctgtgatgaccatcagatgcagataaactgccagacagagaagctgtcttgtagatgtgactttgctgccttcaagagcagggctttctgcacctatgctctaagcgcccttagtgttcctctcccagtggtcctggattgatttctctaatggggagcctcctctgtagggtctacaaggtgactggtggattgattgccctactccacgtaatgtgagtaggcgattgtaaaggggaggctgaagagcttgcctgttttctttgttattcttcttactgagagaggtggactagagtggtagttcaaagatctggctctgcagtcacagatctgggtaccaatcaaggttctgtccctgattttctgtgtgaccttgagcacatcatttatcatctctaagcctctttctcatcttttaatgctttattcacaatacctggttcacaggattgttgtgggaattaaatgagataatgtgatattaagtccttaggacttttaaagttgacatagtattataactgttacctccgctaatagcgtcaaaccttgggtctaatcagggctcagtctctttactatttgtgtgaccttcctaaccattttgccattctgtctcccttctgaacatagcaaatataactagcttgctttggccttcaaattaatagaattcatcagccacagatctctgtgagccacttgctctgtaacagggaaggagtatgtgtgtctggcatgggagcttgccaagaatatttgctcaatagctatgctattataccatcacgtgctgctgtggctttataggaagtatatcctggatggttattacatatttagctggaatttagtttcctagggaaataaaagtttcatattttaagaatagacaattattttgaacaagtggtttatgtccacagaaagttcatgttcttatcttttatgtttgaatgaaggcactgtgtatgaggtgtccctgaacattggaagtctaaagagcatggatttggatgtcaaaactgggtccagattgaagttatgacatggaccacctgtgagagccttaatttcttcctgtgtgaatgtaaataatacctacctcatgggattaaaagagaaaataatataagaaagcatatatcatattatgtaacacatagtagcctctcaataaaagttactggttactattttgggcagatccaaacattatgttaataaatttcaatggctcccacattttattctttggggtggcacattctgtagagatatcttaggggctacagagggacagtgatggagggactaaggaaatagtatccaggctctctgccccacttcccaagaagctctgcttatgtctgttttatatctagggcatctgagattgttttacgggggagaaagaaggctttataagtgctttcagttcaatttattaatttttccctcaatgaaccgtagttttagtgttgtatctaagaaatctttgtatatcccaaggtcacaaaggttttcttctagaagtttttatgatttagagttttaaatttaggcgtatgatcaattttttagtccatttttgtttatggtaagaggtgtggtgtattagtttgctaggactgccataaagcatcacagattaagtggcttaaaaaatagaaatatattttttcacaattcttgaggctggaagtctgagatctaggtgtaagcagggttggtttcttctgaggcctctcttcttgccttatagatggccatcttctccttatgtcttcatgtggtctcttctctctgcctgtccctgtccaactttcctcttcttataaagacatcagccatattgggttaggacctacccaaatgaactcattttaacttaattacttctttaaagactatttccaaatgcagtcatattctgaggtactggaagtcaggactttaacatatgaatttggggggtacataactgagcttataattcatggatgaaagtgtttttttcccatatggatattcaattgtactagtgtggtttgctgcaaagaacctcctttttcactgaattgcctttgtacctttctcaagaaacagctgtccatataaatatgggttgatttctgcactccctgtttcgttccactgaactatttgtctatctttgctctaatatcatactgtctggattacttccattttataatatgttttagaattgacaaactggacttcctcaaaatgaaacatttctgctcttcaaaagacactgttaagggaatgaaaggacaagtcacagacagggagaatatatatatatacacatacacatctgcaaaaagtagagctgatatgggactactcatatccagaatatataaaaaactctaagatataaataataagaaggtaacctaataaaaaaggacaaaagatttgaacagatacttcaccaaaaaagatatgtgactagcaaataagcacatgaaaatatactcaacattattagtcattagagaaatgtaaaataaaaccacaatgagacaccaatacacacatattaggaatataaaaagactgaccatatcaagtgttggtgaacatacagaggaactagaactctcatatacttttggtgggaatgtaaactggtacaaccactttgaaaaacaacttggcagtttaaaaaagttaaacatacacttacatggtccagccattctattactagaaatgaaagcatatgcccatataaagagtacaaataaatgttttacttgttatagccctccttgttataggagttttacttgttatagccccaaactggaagcaacccaaatctccatcaataagtgattggataaatgaactgtgttatatctatattattcagcaataaaaaagaatgaactattagtgaatgctaccacatgagtgattgcaaaataaatatgctggatgatagaagccaggtataagacgcaaacatgctaaatgattccatttgtatcaaactctaaaacatgcaaactaatgtacaataacagaaaacagatcagtgccagtggtagaagggtaggaggaaaggaacaccaaggagcctgaagaaccttctgggagtgttccttataatacgttcattatcttaacatatattcattcagttaaggaacacatgttcattattttaactgtgataatggtcttatggatgtaaacatatgtcaaaacttattaaattatatatgttaaatatgtgcagtctattatatgttaattatatttcagtacagctgctaaaaaagtgataaaaaacatttgggccaaatatgaaaaacccaagactaaagtgaaaaattacaagactgttactgatcaatgttcaggcctattaaaatttcccctatcccaatggcacttgggcaactacttttcttgtatactttaggaagtatctaattcagacaggggactaagaagagactcttcacagtgcttgctgatagccccaaaatgcagcatgaaaccacccaaatgccaagacaaattgagaaaggttgacctttaaaatatgtagagttcagtacctttgaattaaattgcatgttcagctttggttctagttgctagaggctacttttttcaagtccacaattggctcccccaactgcgtttgaaattcagtaaaaccagcctttgcacctgcctttgttaaaatctgtacctaaattgtttggaacaagaaagaatagtaactagaagcagatttactgcagtctggacttagttgtttgggtgacctctttttgctggttttctgggttgattagactttgctaattgacagagtgtttggcgcaatagcccaggcagagccattctgctctggacttggatttggtacaagtattcctggtggtcaagtcatgtattttctagtttggaaacagacgttggaacaggactgctggagcaggtttgcaggattctatggtggagaaactataatgactttcaaaaacatgggccaaggtaatttggctgtcttttcattcccatctctaaaagaaagaacccaccaaagttcagagcatcttaaacattttgaagttgtgacagtgaatgtgaataattggtgtctgtgggactctaagggtagaaagcagggcttactagtgcttcttcttatttaacagagaagagcctggaaaaaaaaaaacctatagtcagacataaacatttcagccttatttattttcaaccagggaatagctaataccacgatgctgtaaagttcttgcatttaaatgtcctatttcacaggtccaaacccatgttccacatagtagtattataatagcaccatggagactatccagtaggatcctgaaagtcttcttacccactcttttccattttgctaagcacctggttaaattaaaattccaaacagtattattcagagacagcatggaacagcggattcttaattctggcccccccattcatcaagcacacataggccaggcaatgcatttagcactggagatactgaagtaagggattgcctctgccttcaatgaacctttggtctagagatggagactgagaaataaacaggaaattctaagcagagtgctgtgtacgatggagaaagtcctaaacagagtaatattgggacctgtaggaggccctcccactccaaaccatgagggtcaggcaaggcttcccaaaaggtaagagttacctcctcaaagaagcgggggaaattgtctcttactactctatgacaatgagcaaatcactcaaattctctgactctctcttttggaagaaataacatttactggttgcttttgaggattgaatcagatgagatatagaaaagcccttagcccagtgcttgctaggggaaagatcaatattggttttcatctttcctttcttttttcctcccctcctacctccatcaggtggggagtgtgacttccggagcacactacacagaggagacttttggagggtttttagttgtcatctctgtcacttggtgtttatcttcctgcttctagttcattagggcctttttcttctgatgctggcttgggctgtgtttatgtctttcatgtgcttctgtgacacttcatcaggggaagtggctggccctctgagcaactgctggaggcgttgggaagatgggaatcaaatgcagcctctgtaggtgggtgtggaacagaacagcagtgtggccctgtgcatgtgtcaggggcaggcagcagccatcatctgtcctcatgtcctgcctgtggggtctgatgagaaaagaatgagttagtaatgaagtagagaggagagagagctgagtgctaagtggagaataaaatcatcttcaagtataactcaggtttactctggagctgtgtatcctgcaaatagtacagtattcccactcttggccaggcactaacagctgtggaagcaaatggtgtaactgcctttagggggcgttctgactggccagcaggcattactgatgcagggaagcaatgcagaaaactccacggcaagctgggcacactttgctctctgttgctctgtgtgtcctttggtttatttttctgtgtactctcccctcctaagaagactgtgctctttccaaacccaaatcaccttcttatgttgcaaatccacctaaccgtcagaattttttcctgcacagctgtcacaacaaacttcccctcatctgctactaaatgtatcagacactgttgtgcagtctgtgagctgccgactcattatccgagggctttccaatagaatctgatgttatccaaagcttctcatctgtttcaaagggaacaatttcctgcgttctctggagggaaatcaaacgcactacgtttaggaagtaggacggtccttcacagatttagtagatcgcaaggcaattatgggctgattattcccaacttagtgtttcctcacctcatttcccataacagcgactagagtgacctgaagatgggctttttgtctttccagtgagacatcgggaaataaatcacaaaaatcaagataagttgtggtacctttgatttccctctgtcctcttcccaagccgtttttggcactccctagaggaaaccagttctcctctcctcttttacttctgcagtgggcacttgggctccaagtatcttttttttttttaagttcatcttcatcatcctttaaattaaacacctactcccctgataaatatgatgctctttttaacaattagtctttggatatagaagttgctgatgaggaaaaatccctttcagctggttacctatgcttttttttttttttttttttttttttgagacggactctcactccgttgcccaggctggagtgcaatggtgcgatatcagctcactgctgccgatgcttcccagattcaagcgattctcctgcctcagcttcccaagtagctgggattacaggcatgcgccaccatgctcggctaatttatggtatttttagtagagacagggtttcacatgttggccaggctggtctcgaacccctaacctcagatgatccacccacctcggccttccaaagtcctgggatttcaggtgtgagccaccgtgcccggccccatgcttctttatactagttctttcctcccttctcacctccagcctgggatgtggtctccactatggtctttattccatactccaaatttgtctctttccaagtatcttcctaattcctttttttaaagttacctttttaatttcctgccgtgaaacatctgctgtatcatcttgcttccgccacttcctagaaaacttgttttatgaatgttctttctcctcagtataattttcctggctgtgccctgatgtagtgctacaatagttttattttacattgactgattaagcactttgaataattgttttagctccattatggcaaatctatttggcttaacacttttttttttttttgcaacctttgattaatgcctgaccattgggacagaaaggaattggcgcattaatttccccttgacgccacggagagctgctctttttcctgtgcaagagcctgaagcaacagatgctctgtgttcgtattgcaggggagagcacacactgttgcaaataagtatgtgtgtgttcccggtcagtgtttgctaatggtgctgtgtggcagccatttcatagcagagagcaaatgttaggatttagggaaaattgtaccagcatatcagattttaaaacggaatggtgaatttttgttgagttaacagtgtgtagctagacgatgttttctttctaagctcatgaaacttaacagctgtttagtgaagcagtattttcatatatgcctgtttgacaggtttaatagcaaattttgcagtaagtgacttgctgaacaggacttctggcttgggctgtaacaagaactgtatttgcagcaagattcattgagggtctttgtgctttagtgtttacgggaaggggaagcctggctaaagtgaggaaaactgaaaggcataatccaaaggaaattactaatatctctaccagagtattcctcagaacttgttattaactagtttagaggaagataacatggggaaaacatgctgtttagcaataaaaacacatgagtacaatcagcttactgtaacccattattgctgcatagtaattaaatctatatatctccaactttatagttttctgcagcagaatctctgaaagacttctgcacttcatctgattcaaggaagcctatattctctcccctgtctctggaaaggctactgtgccttgtaatagctttttaatattgccagatcgaagacaaatgcttcactggttttactgggagaaataaagcacttcctattacacttataggggggatccaagtcttgggaaactagcactttatgaggttagaatcccttttcctttcttcccatttttgagttctctcagatcgtaggacctcagaatcactcattcctagggctacccactttgtatttggctcctaagtgcatttttcaggatttatctgtgcttttattgattgcatgtgcttagttatacctgctgattgtgggtgtgtgcatgtatgacagaatcacagatcatagacccctgttctccagggcagccaccctcatggtcagcccagcatcctcagctaacaaaaggaccaagagctgtcttacatcctctttggatttccgcatagattttgcaagccgtaaatacaaaatttgtctagagttcatagttggttctgtttactggatttttttttttttttttttttttgagacagggtctggctctgttgcccatggtggaatgcagtggtgcaatattgactctgtgcagccttcgcctcctgggctcaaacaattctcacacctcagcctccagagtagtggggactacagacacgtgccaccatgcctgcctaatttttgcatttttgtggggggtgggtagagatggggtttcaccactgtttcttaagcagcatgtaagggagcttcatatttgtttgtctcagtcccatcatgatgtaggtcaaaagcaagttacattcagctagctgtatgacaaagatgcctccttttgaacagtaagaatttaggctttgttgttttatacactcaggcaacttgaaaaggataaaagaaaggtggagaaaagaatagtaaagtgagctcaattaattttctaagaaggcaaactaaaaacttctcacatgtaaacagtaagatgtcagggacacaaaatgagttagcccgtgttgctgggatgaggagggatagcagagaaatggccatatgatgtctgagagtgtggccagtgggaggagaggggtctactggtggacttctctcagcaggttgtcacctccacactttctcatccagagctcctgggattccctctaggaaggaatcattataccatttgccctgctcccatcatctcactaacctgctatcactgtagtaactccaagaaccagtgagacaagaaagagggatgtcatgagctgcctctgcacaactgttgaattcaattttctttcttcaagactccttcccccatgtttctctaatgcccacactttattcaggatgttgtgttcagtagcagagacatttgaaatgaagcttccttatcatggcttttaggaaaaataatggcaaaactattggatacaggtgaattctagtccaatatggtaggagaggtgagcctggaattgccctttttacatatcctgcagtctgattctaataaaagtagacacagttctggtacactactatgtggttatttccagaaatataaatgagtgttattttatatatatatattatatatatataaaatatataatatgtacatatatagtattgaaccgacagtaggtacttatgccttctaaaaatgtagtagtaagtgaacataggcaggcaatataggaggtgatacctgaattagttttgaaaggctctagcacagccaccaggcatacaattagggaggagaagtggatgtacattctataccgaagaatagttccctccttataacccaaagaacagtgctgaatacatcttacatgctttgtaaataggtactgtcttgagctgttgtaacaaagagaacatattggagaagaggaggctggaggcagggagatcagttaggagattattgtggtagttcaggttgaagcaatatatatatattatatatatataaatatatatatttatatattttaatgtttataaatatataaatatataaaacattatattttaatgtttaaacttttaaaaaatcagataggtaggacttcctttttcttttttaaataataactatggaagtgcagaaataatagagattctattgtgctctttacctggcttccccattggaacatctctacaactctagtagaatgtcaaaaccaggaaattgccattggtacaatctatagactttatttaggtttcaggagctgtttctaggtgggactttctaaggattgcaaaccccatggctttttctttttaagcaggtagaattgagggtgcagtggaagcaaaggctcatgtctggtctcttcctttctttctgtattgccctcctatcccccatcatgtgaaaaatagatactagaaaactcatatcaaaaagtacagtctggatgcttactttgcagggtagtatgttaggtgcccaggaggacatgaatgactataagaagaaatggttctgtaatttggaatcgtttgtttatacagaaagattcagctcaagacagtacctatttacaaagcatgtaagatgtattcagcactgttctttgggttataaagagggaactattattcggtgtagaatgtacatccacttctcctccctaattttatgcctggtggctgtgctagagcctttcaaaactaattcaggtatcacctcctatattgcctgcctatgttcacttactactacatttttagcaggcatgagtacctactaactgtcggttcaatactagatcccaggggttcaaacatggattctacacattctctacccacaatgagttcacagtttagtggaagagagagacatttaaggaggaaaatgcagtagagtgttatcagaggtataagtagaggtatgagtagggtatatcttgaatgctgtggggtttgaacaaaggaggaaaaaatgaatttctttagaagagagataactgttgtaacaaagagaacatattggagaagaggaggctggaggcagggagatcagttaggagattattgtggtagttcaggttgaagaaagataactgaaaccaaggtggagaggaagacctaggggaagggatgggtttgggggctacttaggagctaaatttaagagcacttactgattaactgactatagagttgaaaagagtgaggtgtccaaaatggtcccagatgatggggtggtggaagtgccatgcaccaagagggagagtctgggagaagatcagactctggaagaaaactcttgacggggtatggatgtattgagtttggggtgtctgtgggatgtccaaactgagagagctcactcagttatagatgagctcaaatgatatatggtgccttgatgtgaatgactttgccagttaaagtatgtagtaggacaagaagatcaaggagaagccttaggaatcactaaaatttaaaggacagatgggggaagggaccctgcaggagagattaagaaggagagcagagtgagaggaagaagagtgtttggaaaacgagaggcagtcaacaatataaaatgttttagatgtcagatatgatagaaattgaaatgttttcattggagttagggacaaaggacattcttattgacctgtgtgagttcaatttcagctggctggttgcaggagacagcaaaacagtagatcaagtagtgatttttaactatgaaacaattaagagtttggtataaggcaatttagttaagtgctaacatggagtgtaaagaaaagtgtaattgatattaattatttaagaaaatccataatagaatgttagagcagaaatgccaccccatttttaaatataaagagagatttcaagtaaattgttcaaggtcatgcatctaaagaggaacagccaggaccaggtcccaggtctgtttactccctttataaaagaaaattctggatagactagtttaaaggagcaaatgaatgtctgttgcaggaaaagtgattgttaaaatgatgaatcagagctgtatacttctattgtgaaatataactacttgtttgatgaatttattcatgtattctataaatattaatagatattgtgctatttgtttaatatgcaaagacaaataaacaattagttgtagagaacatgcttggtgaattttataaaagtaaaatattatcgccattaagtgatatagtctagcagggtgacagacacaaaaatggtatcatacaatgtgcaattgaaaaggcaggaaatagttttgcctaggagttggagactagtgagctgaatcttgcatcatgattgtgatttctccaaatggagaaaggattaaagggaactttcaacaaagggaacagtatgaacaaaatcagaccagtataaagaaagtctataacttcacagactgttaaacagcctggtggggatacgatataaaggtagggaaataacaaagaattattttgaagactagaaaagtattagtttgtttgtgctgctataacaaaatacctgagactgagtaatttacaaagaacagaaatttgttttctcacagttctgcagtctgggaagtttaagatcaaggcaccagcattcggtgtctgatgagggctgctttcagcctctaggatggcaccctgtggctgcatcctttggaggggatgaatcctacatcctcacacatggaagggacagaagagcaagagagtgcttccttcaacttctagcctttttataaggctgttaatcccaggcatgaggacaaagccctcatgacttaattatctcccaaaggccacacctcttaatactgttgcaggggattacatttcaacatgggccaggtatgatggctcagacctctaatcacagcactttgggaggccgaggtgggcagatcacctgaggtcaggagttcaagaccagccttgccaacatggtaaaatcccatctctactaaaaatagaaaaattagccgggcacagtggtgcatgcctgtaatcccagctactcaggagactgagacaggggaattgcttgaacccaggaggcagagattgcagtgacccaagactgtgccattgcactccagcctgggtgacagagcgagactcagtctcaaaaaaaaaaaaaaagtttcaacatgaattttggaggggacaccatctcaaaccatagcaaaattcataaccataatactgaacagtaaatagtggggaaacagatgttttaagccaaggtgtcctttgatctgggcttaagataaatctggtggcaatgtggaagatgagttggaaagggacctctgtttaaggcagtgagatgtgtgcagaaatgtgtcacatgagtgataatgaggttgtgagctagggaagtgatggtaagagtgaagaggagggaagttagtcaagaaagaatttgaaggcagaattacaggcagggtttggcaagtgttcacctgttcttcctgagggaaaaagaagaatccgaaaaaaccccacagtcatttctaacttattgactagggtggggaataaagggagagcaagtttggaaaggaagattctgagtttggtgttggatatttagaatttcaagtactttgggaaatctaggttaaccatacatgagatcctaaacacagcatagtcataggtcttgcttatggtgttaagtagtgtaaacaatatatttaattatggatccccaagaagcacttaaaagtagtttataagttggaaatgtattcagatacacggcacagaaaatctgactaagtggctaaaagaaatagagtttatttttctcatatacaggaaagttggtgatgctggtattggttcaactgctcagtgatggcaagaccagttctctgggacttgccatcatggttataaatagctgatgcagctctagaaacataaccactttcttgtcaggtgcttctgtttgggtctgtttgggtagaactgggtcacgaggcctcctctggctggaaggttggctggaagagcgggaagaaaattgttgaattcacttaaatacatactttcccatcctattagacacaattcctcttttttaaaaacaaataatttgtaatgccttctttattatcctgaaataaacatcatagacaatctgcttgtgtacatttttaaataaatatattatcctaactgtaatataaaggaacaattaaaggaaaataatttataattatttcaaaatgtgaattctaaggcatgactgcactagaagacataatgaagaagtcagattcttgcacggtgaatgtgacagcaacatatgcaagtgatacaagggtatggtaatggtgtttccagtaccacaggcagcatattcatttgtgttttacttaaaagatgaccaattttgggtcaagttctgcacaaaacacagcatagtcttctcttgatatacaagatagttgtttcttgaaagagtcaacttgcatgaaaactgtgcaacaacaattttgtattcgtatacacaatagagttacattcaaggccaaggtaataggtttttcacatttggaaagctatttggaatgtaggagagttcttagtacacagattgtcccccacatagctgtctgtctagtgtccccggcctctgccaactagttaccagtagaatctccataccatggtgacaagtaaaagtgctccccccacatattcaaaatggcccctaggggcagcatcatccatattaaaaacaactggcttagattaatgggactggacactttgtactccaaacaaaatggaggttggttagcaaggaaaagggggaatggatattgaatagggaattaagtgtctaccaatagtaggaactgggttttccttatgtttgtatcttttcccaaattcttgcagaattccttgcatatagtgagttctcaataagctttcttgaatgactgaataaataactggaatgtaagctatgggaaatggaaacccagtattatatgagctttgaataaaggcaaaaatcttccttaagatacttaaagggctaactaccgtaaatccaggaatattgtcagaagttgggaagtgaactttggtgtgccagtgtctgtgctaggatttagcacttctggactttctgtctgttacacattctagactgaagactgagggttaaatttatatcagtgaatcctgttcaggaatggagggtttaggggaaatatttaagttttcatgtaagtagtatagaagaaaaagtaactgtcacaataaaagatcaataaatctcaggctttaaatcttagtctctctatcttttagcacattctctttccactgtgttcttttccacttctgtttgtctattcgctctggcatttttatcatagcctgagacattttcgaatgataatttttaggagaaatatttagaaacagaatcaaagggctttgttttgtttcctcgaaatataaacctattattagaatataattcacagtatgagaaatgtaggttttgcttgagtttgcttccagatttaagtagaaaagaaagaaaatgacattataaagaattttatctctttttttgtgaaaaagataatctgtaactatggattgtgaagacaatatatgaaaagcaaatctttttcaaacagtgctccaaagttgcctttgaatatataacttctgaattcaaaagcatgatacagcatgggtttttaaaaaaatagttgtttaacattttgaagggtataacatttgataactccatactttgaattcaagtgaaggaacaataacttcaaccttttgtttataagaataaggaacactaaaaaatgttgtgtagtttaagtttagacatttcaaatagtcctataattgcttgagagagcagtagagtttttttttcaattagtttattagtatttcagggattttaaatggaagaaaatcttgagtgtctttgtaaatgaattgcatcttttataggcacagatgtttttcgcagcattattttcatccccatggctgctttacaatatgtggcctatggagaaaatgacaagtaggtagatgatgagtaggggaaaatggtggaaggtacagcagcaataggaaggaagtattccccaaggtttgcctgaaaacatctactttgtgaagctccaacatttatggagcaaaatgccctagagtgctgcaacaggagacacaacttaccacccctcatacggaaggatgggagggagaaatggaaggggaaagggaaggagggagaattcctgtgatcttcactacccgctgtctccttagcacagagaattcatccattgccacatcagcacaaggacaacatatgaagttcctcaaaatttccaaataagccattacttattacctatacggttattccctaaaagtttcacactgaagtaaacaagtgtttttggtcatttcatgccaacaaactgatggcccttgatcatcatcctttgaactgactccaggtctagaatgaattttcctatgtatggtgaccctaagtctgtgtcttagaaaatatatatatatatatatatatatatatatatatatattttttttttttttttttttttttttttttttttctggactcactgcaaactctgcctccctggttcacaccattctcctgcctcagccttccgagtagctgggactacaggcgccctccaccacgcccagctaattttttgtatttttagtagagacagggtttcaccgtgttagccaggatggtctcgatatcctgactttgtgatccgcatgccttggactcccaaagtgctgggattacaggagtgagccaccgtgcccggccaggaaagaactttttaaggttgcccttgaataccggtcttgattaagttttattctgtctatatatttcattattttaattttataatacatttctatttcttgcttagaatttataaattatatatcagattatgatttctgtgttttaaaaatacctattatatcttatgctggttttcttaagtggaatgtgatatattaatatcttgttccatttttgttacttctccaaatatagacgattagtaatattctactatttattaatgaaaaactaccttagttggcctaatgtaactatctaaaaacaataataataaaattctgtagtgctgttagagagatatatgattatgcattccagccaggaattacatcagtaatttttagattatattccagggaaaaccaggttttgggtcaactaacacctatttattgttcacttatgttgaaggttctaggtgatttctcatatagctcattgttttgtgccttcaatcttagtaaatcttctaaagtgctaccgatatactcagggaaaactaactttgttaaaagaatatcttttaaattaacctacttttaaaaataagcattattatgtttgtggaatttgaaaatacagtctagttaaggtatttagaataacactcagtttctgtttcaaagtgattatatcattttagtatcaaaattaatttaattgaccatataaggagacattaagtattattataaaaatggcatgttatggcaaagtgtggtggctcacgcctgtaatcccagcactttgggaggctgatgggggtggatcacaaggtcaggagatcgagatcagcctggccaatatggtgaaaagctgtctctactgaaaatacaaaaattagctgagcatggtgacaggcacctgtaatctcagcttctcgggaggcataggcaggagaattgcttgaaaccagaaggtggagattgcagtgagctgagattgtgccattgcactccagcctgaacaagagtaaaactccatctccaaaaaaaaaaaaaaaaaggcatgttatttattaatacgagtgacatacatgcaaaaggatgtctgacttaggcaatgttattttctggacatattttttaaatagactgtgacctaagttctggtggtccctctagaaagggtaccattccctcttctctgcctgctgagccatttcctaagactgtcttcagatgttatgtcttctctagagcttttcagcattccttttattcttttttttgttctcatggtactctatgcatgagaatgtttgagtatatatatattattacagttatttgcctcttagactgcatttgggtattcctctttgagtttctatttcgtgtaaatgcatatagtttcctataaaaaacacaatttataatcctccaggaagtctgtgtaagtcagtcagtcaaattacctggttgattatagtttcaggtttatctgctgcctgggaatcaaaacacaggtcttgattaactttctataaagcaaggatatggactagggatcactaagctctcttttatctctacaatggtgtcattatatgattctaatccatcactagaaatgtattgtgaaatagttaattaatgtttgcagaatgcttagagaacttttaatgagaagtagatatttgtggttagtgctaatgaatagatgtcttatgaaccttttttttgcaccaacaacacattggaaaaatgtactttcaagaataaattgcaatctggtgaaatttttttattagttaacaaaatttagcttttaaaaacaagtatcagtatagtggctttagtggctttagaaaccaggaccctatgcatataaatagttgtaataaaaagggaagcagcaacagtgtatagttttcataatttttcaaaatagtttaaatatgatagcaactttttactcttacagcttagttgtgaaggaggcaaggccagtactcttatactctgggaagctaagacctagagagattaaatgctcatttatttcttaaataaaaatgtattgagtgcctgtatttgagtataacaattgaaggtgcagtggtgaataatttaccctacttgactttgatagtaagggagacaggtttataaacaaacatattagctgatagcatagttaattatggtagaaacacagaagatggtgcaaataactctggggtgttgtttagtgagcctttacagaaaaggtagtttttaaagcattttcattaaactgtaagtggaggcatttgccagatgaaggggaggaggtgaggagaagggtctttcaataaaagagaatgaacatatgtaaagacccagagttatgaaagagcctgtgcgtttgaagaacagcgtgaagttcaatgcagctagagcaatattgtccaatataaatatgaacacaaatgtgcaatttaaatttttctaatagccatagtacagagtaaaaagagacaggtaaaatcaataataacacattttatttaacccaatttatctgaaatatttatttatttttcaacttaagtcattaaaatcaaatcaggtgaatattttacacttacaaaacatttcaatttgtcttccttccttcctttcttttcttttctttctttctttttctttacttttttttttttttttagggactggatcttgctatattgcccaggctggtcttcctgcctcagtctcccaaagtgctgggattacaggcatgagccactgccctcagcctaagacatctcagtttggactcaacacatttcaagggctcaatatatagaagcttagcaatgcatgtatatgtatgtgtgtgtcggagagagaaagagagtgagaatgaaaatctgtgtgctctagagggggaggaggttagataaggttgaagtagttgttggagtcatatttttaaaggctctgcatgctggcttattttagaattttttcttataatttagtagtttatgattgtgcttctcatattatctgtggtgaaggaacaattttgaaaattttgcatttgttatagactaatgctttcgcaaaataataataaattagaaaggtgaaagtaaaaagacatacaaagagaagcaccattttttaatcattaaagttgacaagatgttgtcttagtctattttgtgctgctataacggaataccatggactggatagtttataactaacagaaattaattggtttacaattctagagcctagaaagtccaagattgaggggccacatctggtgagggccttttagctgcatcaaaactttgcaaaaggcatcacatagtggaagggcaagagagggagagagaaaaagcaagagggggtaaactcactcccatgataaataacccattccctcaataaaggcatttgtccattcacgagggcaaatccatcatgatctaaacatctcttaaaggtcctaccttccaagaccattacaaaggcaattaaatttcaacatgaatttggagggacaaaagttaaacccatagtattcctcctgtcatgtttttcttacatacaaaacacatttatttcatcccaatagctccaaagtcttaattccttccagcaccaactcaaaagtccgaagtcttgtctaaatcagatatgggtgagacataacacaattcattctgaggcaaattcccctctagctgtgagcctgtgaaattatacaagttatctatttccacaatacaatggtgggacaggtataggatagacattcccattccaaaatggataaataggcaaggaaggggtaactggttccaagtaagtccaaaacccaatggggacaacaacagtaaatcttaagcctcagaaataattttctttgactccatgctgccctgcttcctggacacactggggaaggggttgagcccccaaggacttggagagccctgcacctatggctttgctggaacgttggagtcttatgcttacagctctcctgggctggctttgtgtgctggtatctacagttcaggagtctcaggtgtggttctgcccctgcagcttcactagacattgctttagtggggactgtttgtggcagctctgctcctgcagcagatttctacctggatccccaggctgtctgatacattctttaaaatctaggtgaaggtagccatgcctccacagcttgtgaactctgtgtgcctgcagaattggcaccgtgtggataccaccaggacttactgcttgtgcactcaggagcagaggccttagctgcacatgtgcctgctcaagctatggctggagcagcttaagggcactgcaccagaatgtggggaacagacatttgggtaggtgaggtgcagggcagttaattctgaggtcccctgggtgcctctttggaaactttgccctcaagattctagcttgcctcagagatccctgaagtgcctttgcggtcattttcttattgtcttgatgaatagcacctggctctttactagccatacaaacctttctagcaaatggttgtgtggccacatcttttgtttgcactcctaagcacacatttttattctttacatggccaggctgtgaattttcataatttttatgttctatttccccttaaattatgaatactgtctttaaattatttctttcccctcacattctattatatacatttaaaagaagccacacagctccttcagtattttgcttagaaatttcttccatcagatattctagtttatcactcttaaattctgccttctgttaaagccctcaggcatggacacactttagccaagttttttgccacttaataacaaggatagcctttactacagtttccaatacgttgttcttcatttccatctgagacctcatcagaattgcctgtactgtccatatttctgtcagcattctggtcatgaatctctaagaagaatcactcaagtaatctctaagaagttcccgactttctctctggctcatctgctcttctgagccctttccagaacttcccttaatactgcattcattgtaatctaggcttttcctaggctgctcttccaaattcttccggcctctccccgttacccaatttcaaagctgcgttcacatttttcgggtatttgttataacaacccacctctctggtaccaatttttgtcttagttgtgtgagtgtgtgtgtgtgtgtgtgtgtgtgctgctttaacagaataccacagacggagtaatttataaagaatgaaaatttattagctcgtggttctgcaggctaaacagtccaagaatgaggggccacatctggtgagggtcttcttgccacatcataacatggcagaaggcatcgcacagaagaagggcaaagaggggatgagagagatcaaaggagacacaaaccccttcctgcaataaacattagtttattcataaaggtggagccctcatgtcctgaatacattttgaaagtccaaccttataataccgtcacaagcgcaattacatttcaacatgagttttgaaggggacaaacattcaaacaatagcagacatatagtttataaaaaagtgtctaaaccagtgctatccaatagaactttctgtcatgataggaatgttctgtctgtgctgcttaatataatagccactagccacacgtatctattgagtacttgaaatgtggctagtgtgactgagaaaataaatctttagtttaatttaattttagttaatttaaattgaagtgaccatatgagacaattgattactatattggacagcattgaatacatttactcataatctctgtatttacctattgtgcattagtaaaaaacagtttgtggactggtatggcccacaaacccatgctttgagtagcactgtttaaagcatggactctagagctagaaagcctttgtgtatctttggcaaactgcttaatcgcttggtgcctcagtttcctcatttgtaaaataaaggtaataataaactaccttatagagttgttgtgaggattaaatgcattaatgagtgtagcatacttagtacaaggtctgacacacagcatgcactatataaatgcttcctgttattgttattattatttattatgtaggtggtggatatcaaacagttaattggtaacaaagcccagtctttttattaattctctgctttttgcagtagcttagactttttccttttaaaaacataccacagtttgtggcatctagtggcttccaataaataccttttgaacataagcataaagtacttttcaagcacagatgaagaagcaattattgttctgaggtggggggggggttggtaaaattatcaaaaacagatgacagctgagaaggcctcaatggaggagtctgacaggcaaagaggagagaacacacctggtggagggagcaaggacacccatttggattatactctatttaggagactatacagcaggtaacactgacttagccctatcactgctaccaccacttctttctctccttcccagctcttttcttgatttatccttttagcatattttaaacaggattaataggtaacacgtgattctacagttttaagggaggtcaatcgttgcctctttacttgttcattcctcagagtaacagtgcctgaatttgatggtggatgttgggcagtggttgggaagggaaggggaatgctgcttgaaaagcaatccctgggttatgggcagatagctgtgagattcttttcccctaaaacataatgtttcttatttatgtagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggtattgtttgtcttttcagtttgatttgtattttataaaactaatgtcccttggtgtaattgagtacaatatgcatgattcatattataatttggataatttcctattccattggcttaatgagttctctacccttttttgtcctcccattttttacttctgtttcttttgtgaaagggaactgatcatgttggatcgctttttaaatgtagaatctgtagctactggtccatgatacttaccagccctatcactttgtaattgctatctagttaaacattagcatggttctatagataattgaaatatacataaacaggatacaaaaacgatgacttcttccaagtggcctcagtgtgaataattttttagaattaatgaaatagagaatagaactttgcactctgaattgatttaattatttttatagaactgaggcttctcctgcaaggaattatccaaggttgagttctacctttacttataagcaccctggatcagctttatcagataatatacagtaaatgcccagatcagggatgtatagccagtcatcagggagctatcagttagccttgaatatatccatgggctaatttccggtggcagaagaacgagtttctattcttttgacttttttgaatgccaagagaaaggcctagtgaagtacattgtcagtttaaaacattatttattgagatataattcacatactatgatgttcatgcatttagaatgtacaagcgatttttaatatattcacagagttgtgcagccaccacaatctaattatagaacatcttcatcaccacaaaaagaaactctgtgactattagctgtcattctccagtctacctatatcccagccctaggaaaccactaatctgctttctgtctttatggatttgcttattctgggcattttacatgaatggaataataaattatgtgatctttcatgaattctttttttcatgtagcatactgttttccaggttcatctatgttgtcacatgtttcagtatttcattctttttattgctcaataatattccattttatggatgtaccacatttttatttatccatgcatcagttgatggacattgagattgttttcaccttttagatattatgaatagtgctgctatgaacattcatgcacaagtttttcatgtgaacatttgttttcatttctcttgggcatataccaagaagtagaattgctgggtcatataccagctctatgtttaactttatgaggtattgccaaactgttttctgaagtggctgcacagttttatgtacccactgacaatgtattataatttttccatatgcttgccaacacttgttattatctgtcttcttggttatagctattctagtgggtgtggagtggtatctcattgtggttttgatttgcatttccctaatgacaagtgatgttgagcatccttccatgttcttactcgccatttgtttatcttctttggagaaatgtgtatccaaattcattgcccagtttttaatcggactatgagatttttattatagagttttaaaagcttttttaatgtattgtatatacaagtcccttttcatatatttgatttactaatgttctctcccattctgaggactgtcttttctttttttttgatggcaatatttgctacagaaatatttaatttttgattagtccaactaatttattttatttcttttgttgcctgtgcttttggtatcatatcaaaccattgcctacaccatggtcacaaacatttactactactactgtaatgtatctaggtatgtatatctttactctcatctcatattttcttctaagaattttatggctgccattcttacatttatatctgtgaattaattgtgttaatttttgtatatggtataagataaggcttcagctttcttcttttgaatgtggtcattcagttgtctcagcttcatttgttgaaaagactattctttctcctttaattcggtgcattacattaattgattttcaaatgttaaacaaaccttgcattactgggataaaccccacttgattacaatacataatcttttttatatggtgctgaattcagtttggtggtattttgcttaatattttgcatttacatccatagggatattggcttgtagtttcattttcttataatgtcttttttttttttttttttttttttttttttgtatcagagtaagactggcctcatgaaatcagtggcaaagtgtcacctcaccttccattctttggaagagattacaactgactgctattaattctttaaatttctggtagaattcaccagtgaagcaatctcattcacgcttttctttgtgggaagatttttaattattaattcagtttctttacttgtctaatcagattttcagtttcttcttgagtcagttttagtagtttgtgtcttttgagaaatgtatctgttttatctaagtcatgtaatttgttggtatacagttatttatagtatcttattataatttttttatgtttgtaaggatggggtctaaatcactgctgtcacttgcttttgggcagaacaactgtttagatttttctagcaacaaattctctgagcctttattcatctttatctctttgcttaaccttcagttttgaaagatagttttactagacatgagattcttagttgaggggtttgtttttcttttctttttttcttttctttctttcttttttttttattttcagcactttgaatacattatcgatcccattgccttctggactccattgtttctttttctttcttccttttttttttttgagatggagtttcactcttgttgcctaggctggagtgcaatggcacaatctcagctcactgcaacctccatttccccagttcaagtgattctcctgcctcagcctcccaagtagctgggattacaggtgcacaccaccatgcccagctaattttttgtatttttagtagagatgcagtttcaccattttggacaggcttgtctcaaactcctggattcaggtgatccacctgcctaggcttcccaaagtgatgggattacaggcttgagccaccatgcccggcctggactccattgttttgatgagatgtcagctgttacagttttggaggtttccttgtatgtgctgagtcatgtcttctttattgctttcaaggttttctttttcttttgatttttattattttgactctaatgtatctaggtatatatatctttattctcatcttacttggaggttgttgattttcttgcatgtgtagattgaagtttttcatcaaatttgagaagttttcagctatcattttcacaaattctttttcttcctttttttctttttcctctccttctggtacttccatttacagtgtgttggtgatttaatgatgtcccatatttctcttatgctctgctcatttttctttattctttattttctttgttcttcagattgtatgacctctatcaatctgtcatcaagcttactgattctttcttctattagcttaaagctactattgagcctctatactgaatttgtctttttagttactatacatttaaactccagaacttctctttggtctttttaaaaaataatttctgtgtctttattgatattttttatttgatgagatgttgtcatcatatctgcctttagttctttaagtatggtttcttttagttccttgaatatttcaataatagcttctttgaagtgtttgctatatcctacatctgggccccctaaaagacagtttctactgcctacttcttttttttcatgtgtatgggttgtactttattgtatctttttatgccatagttttaaaaacagaaaacctgaatatttaaaataataatttaaaataatattttatggcaactctggatgctgacttgtcttcctccctttcccccatccatttacctggtcattcatttgtttaatcgcttgactgtactaactctgtgatgtctatttctcctacactgttcagcttctgatgttcctgtttagattgtttttctgttttattttttgtttttcttttggctgggttccctatgagtcacccgtaggtctgcataagccacttattggtcaaaggttatgcttaggttcctttagacagttatatttttactctttgccatttgatgtttttatggcttggagtctgttattacaacttaagaagtttgttttttcccccaactttggccaaggccaaatgccttggaagttccttttctaatcacttctgagagggtgcggccttgagcatgcacacagccttccagattaccagaatgcaaataattttatttttaagcgtggcttaatagtattttctccagggtcagaatagcttattttttagccagtgtttgctcagaggttgtccttaaacaccttgagtgagtgagatttctgccctttgttgacggatctgtgtgcagcttgggaaatgttttcaagtctgacccatgtgttgttttgattgttcctgagtaggtatgacctaggacatgtgtgtagcttttcaacccccagggtttactgggatcccaggaaggcccttcttggttgtttctttccttggttctttctgttaaagctatggttgttctgccattttgcttgttgctagcagtatcgtgaagctaccagcacccccttaattgttcttcaccaagctctccattattttcagcaacacccttaagtagggaattctccgttctctgcactaaatgaagtcactaacatcaataagaactatggagctcttcatccttatggcttctctcttcccccaggagaacattcgtgctactgcaagggagctagatgcagtgatagtggcacctcccagtgtcacccagaatgatatccctagtggatgataagaagggaggaggtagttctcagccttgttggcttgcagcttccagtatgggaccacctcctatgagtgagctgagaaaggggtgatcagagtcttagtattcttgatggctacttagggtagagtttccaccctatgagtaggacttgggtagaggaatggcacctcagttctcttggcattgcttgactagaacagaggttctaccacaaggtaatggggttggggaatgagaaacactggtagtctgtccttccaaaggtgaaactgtagccctaaactgagaattgggtggagagaaagctcttacgttcttgtctgcacttggtcagaatacggtacctgtagtagagtttctgtaacatggggctgggggtgggagaggaaagcagatcatgacccagatgccacagactcttactgttctcatcaagacttggtaaattttcttggatgaatgttgtcctttgctgtatgcccttaggggagttttgagagacattaaattattttttaaataatttttcccactaaatattttgtggggtgaagatctgctgagttactcatgctgccatgctggaagaatcactgggatagccagttttgatctctctaaggctgcatgaataggtggtagaattctccaaggtattagggagctccttagcttgggttctatagtgttagtcagttttcttcagttgccttctgttaaatgctaatctatgttagacaccaacttaaatcctcctttttaagctctctcaattgtccagttatctgaaaaggattagcactttttttcccagatgagagaaccagactccaagaggttatgtaatttaccaagggttgcacaactggtaagaggccttgtttgggcatgaacaactgtcaaactccagagtttgtgcttttagtcattagactatattgcctcacatacaaatattttaatgttgtttcatttataagattactatttttagccatctagctgaagcagatctgtttcaaaagccgttgatacctgtactgtgacagcagaatatattggtttttgtgtgtttttttaaagaaagttttcttattcccatttctttctcattgtcatttctgattctacaactgggcctcctctttcctggctacctgcctggtattgaaaactaagccaagttactgattgctcctgagaccttcaaaacccagaggatatgaattttactcaccggaatctattctgttttccaagactcactttcaccccactcctcgttccatggggctcaaagtagataaacagttgtctggcaactggactattttaagctctgaagagactggagagttaggctggaccaggtgtggaaaagtcccacaggagacagtgtaaagttggcgtaacaggatctctaatccaggcagagtggtgcagagcttatcttctagcctctctctcaggaaacctgtcttctcactttggcttaccactaactagttgtgtgaccttggttgccatttaatcatcatggccttgatttcgtgacctgtgaaatgagagatggttggaatgttgaatctgtaaggtctcctctagattggaaagggtaatttttatgagactccataagggatcactgaagctagaatttacaggagctggattctgccaactatatgtgatggagtagattctttgtttaaccagattttttaactttttaattctagacttgaatattacagtatgtatgttagtttatgcactcttctcaacttcagtattacagtaggtatgttagtttattcacatggcaggattgagagctctgcaagttatctgtggagagtttgaagaaggcagatatacaagcaggccaagtccgaagagatgaaggacaaacttacaagacaggagaaagcacaatctccaatcagtcctgagataacatagcatacatcagatttgaatggaccaagtaaaagaatgagaatcaacagtcacatctgggacaggctgacatatgttcaagaaagaggaacttgggcagactatgcggttctttcccagcagacataactctgggtcttcatggtttatggtctctgagcccaacacagcaggtcattgagtatttattaatcctcattggagactgacatctctaccgaaatacagggctttcttaaaattttaggattgtatgtttttattatgtttggtgtatgttttattatgtttgtatgccatattatgttatgttttattgtatgttttatattagttagggggctcctggcggcctggactgagtcttatccatttctatattctcaacatctagcatcatactcagtaaatagttactcatttagtttactcatttatttgagaaacagtggatttttaaggtagttctttccttggggtattattcacttgtactaaaataaggccttcttctacattgtattagtctgttctcatgctgctatgaagtaatactaagacaggataatttatagacgaaagaggtttaattgaatcacagttccacatggctggggaggcctcaggaaagttacaatcatggcggaagacactccttcacagggcggaaggagagaatgagtggcaagcgaaggggaaagatggttatacaaccatcagatcttgtgagaattcactcactatcacaagaacagcatgggggttactgccccccatgattcagttacatcccactgagtccctcaataagatttgggtgggacacagccaagccatatacataatgaatgatgatactgttgagccatcatcatttactcagaatttccctgattataaaattaatacttgcttattatagaaagcatgtacataaatataaaaataataaaaatcacctgtattggtccattttcacgctgcttataaagacatacccaagactgggcaatttacaaaagaaagaggtttattagacttacagttccacgtggcttgagaggcctcacaatcgtggcagaaagtgaaaggcatatctcacatggtggcagacaagagaagagagcttgtgcagggaactcccctttttaaaaccatgagatcttgtgagacttattcactatcatgagaacagcatgggaaggacctgcccccatgattcaattacctcccactgggtccttcccacaacatgtggaaattcaagatcagagttgggttgggacatagtcaaactatatcattctgacttggcccctccaaaatctatgtcctcacatttcaaaaccaatcatgctttcccaacagtttgccaaaatcttaactcatttcagcattaactcaaaagtccacagtccaaagtctcatccgagacaaggcaagtcctgtccacttataagcctgcaaaatcaaaagcaagctagttacttcctagatacaatgggggtacaggcattgggtaaatacagccattccttgtgggagaaattggccaaaacaaaggggctacaggtcccatgcaagtccaaaatccagcagggcagccaaatcttaaagcttcaaaatgatctcctttaactccatgtctcacatctaggtcatgccaatgcaaaatgtgggttgccacggtcttgggcagctccatccttccaggctgctttcatgggctggtcttgagtgtctgcagtttttccaggtgcacggtgcaagctgttggtggatctatcattctggggtcttgaggacagtggccctcttctcacagctccactacgtggtgccacagtagggactctgtgtgggggctctgatcctacttttcccttctgcactgccctaggggaggttctccatgagagcaatgcccctacagcaaacttctacctggacatccagatgtttccatacatcctctgaaatctaggtggaggttcccaaaccccaattcttgactcctgtgcactggcaggctcaacatcatgtggaagatgccaaggcgtgaggcttgtgccctctgaagccgtggttcagattctacattggcccctttcagccacaactagagcgactggaacgcaggtcaccaattccctagatggcacacagtatgaggatcctgggcccagcccatgaaaccactttttcctcctaggccttcaggcctgtaatgggaggagctgcctgaagacctctgacatgccctggagacattttccccattgtcttggggattaacattcagctcctcattatttatgcaaatttcttcagccagcttggatttctcctcagaaaatgggattctctttactatcacattgtcaggctgcaaattttccgaacttttatgctctgcttcccttataaaactgaatgcctttaacagcacccaagtcacatcttgaatgctttgctgcttagaaatttcttctgccagataccctaaatcatctctctcaagttcaaagttccacaaattgctagggtgggggtaaaatgccaccactctctttgctaaaacacagcaagaatcacctttgctccatttcccaacaagttcctcatctccatctgagaacacctcagcctgcacttcattgtccatattattatgagcattttggtcaaagccatttcaacaagtctccagggagttccacactttcccacattttcctgtcttcttctgagcccttcatactattccaacctctgcctgttacccagttccaaagttgcttccacatttttgggtatcttttcagcagcgccccagtctactggtaccaatttactgtattagtccatttttgtgcttctgatgaagacatacccaaaactgggcaatttacaaaagaaagagatttactagacttacagttccacatggctggggaagtctcacaatcatggtggaaggtgaaaggcatttctcacacggtggcagacaagagaagagaacttgtgcaggaaattcccccttttaaaacgatgagatcttgtgagactttttcactaccaccagaagagcacaggaagccctgcccccatgattcaattacctctcaccagatccctcccacaacacatggaaattcaagatgaaatttgggtggggacacagccaaaccatataatcacctatgatattttcctctagagagtcattgctatcatttctatttttccttttgatatttctatatgcatatgtattttattttataaacttgtgttcacactgcatatagtttgtgtccttttatcttatatatcatgaacatttaccacatactagtaaatatctttttaaataagttttaatggctaccaaatttaaatatgcaataattaatataatgccttgttattggaaactagattattttcttatttttttctcttcttttaaatagcatgggtataaaatcttttaatgtagaaagaagtatagacttttaaaggaaattttatgtttttaataaatgacatataaaggaggaatcattggtatattctaggaagttgtaggagagtagaaacaattagttttgaaactgcttgtatagatgtaaaaaatgccaataaagttcttagaagctgttttattttttagtggttttagttgtttaaaaatgttaacacaatagatatgtaaacattatatataatgtacattttaatgatacaacgtaaatatatattttaattactttaaattattaatgtacatattgatacatttatattcttgatatattttgttaaattgttttccagattgtacacacctattctcttattagcagtgtatcttcaaaaccctgcaccttcacctgcatgggtattttttcctaatctttgccaatttgatgaaccaaaagtgatatttccctattattttactttgcatacctttgcttattgttcaagttaatattttcatatgtttactggaagcatatttttcttctttaaattatttgagcatatctcttgcctatttttctactggtgctttaatgatattctaattgatgaataataattcattattaatgaattattttaataaatcaattgtaattgattgtcctattttattcaaattgagtgttttaaaagatattaagatggtttgcattgatatatcaccttctttttcattttttcttaaaagcatatttctttctgtattttgaggatgacttagaatgtagttaatagactgcaaaatagcaaagttgactaatttccactccctctcccctatcaaagtgctctaaggaacagttctttaggttagcttacacatactttggaacatcagtgtcattattcgaagattggtgaatgccatgcttttgaatatgtaccagcaaacttaaggtctcagtgtagctagacttggatttttgagctgtgtatatggattggtacttctgctggtttatgtcaaactgtgtgtaccttatgacttttccttttgggaataatataggagtgagaggaaggacaggtaaagagcactagattgagctcaatgtgcagagttgactggatagttaatgttgagctgtggagattagcatctcctctaactggtttaaccagctatgaatatcttacaggattttaaatggtttacagaatcactgggtaagctaatgatgcagattttaaattgagcttctcaggaatgaatttgagaataattctgtagaaccaggctaccatgattcctgttgcctttcctagattaagcaatggcctttgtcagaaaactgccacagaaaatctagagattttcacaatggtgcttgtctctgaaacagcagaaaacagtctctgtctaattcctgctttccagatcttgttcaagtgcaaaaaattggtgacacttaaattacttctagaaccctaactgtagaaaatcccaggaatgtagttcttaggtgttcagtctttgtgactcagaaaagcacatttgaaggaccttgaatggatgttgaatgccaactctccatatctaacacaatactcctttcattatgtcccttaatcaacaatatgatatggacttttttgcataaataaacaagaacagattgccattggttatatagtacaagtaacactaccaatagcattgtggtcctctgtggttataggattagaatgaatttaataggacaaaaaggaatatagagcataatcatgaaaggaggtatctccaagggcattctgatggattgaagggaaattgctttaggctgtttgtcacatttgccatataagttaaagtaggtttggctgggtgcggtggctcacgcttttaatctcagtgctttgggaggccgaggcagatggatcacctgaggttaggagtttgagaccagcccgagcaacgtagtgaaactccctcactactaaaaactacaaaaattgccaggtgcggtggctcacacctgtaatcccagcactttgggaggccgaggcaggtggatcacgaggtcaggagatcaagaccatcctggctagtgtggtgaaacccagtctctactaaaaatacaaaaaattagccaggcgttgtggcaggtgcctgtagtcccagctactcaggaggctaaggcaggagaattgcttgaacctgggaggtggagtttgcagtgagcctagattgtgccactgcactccagcctgggcggcagagcaagactccatctcaaaaaaaaaaaaagttaaagtaggttctccttcattttttataccctttccctttatctgttttgtatgcttctctttcctaggccatatatatatatatttctggtcttactctgttgcccaggctggagtgcagcagcacaatcatggttcactgcagcctgagcctcccaggctcaagcagtcctcccatctccatctctcaagtacctgggcccacaggtgcatgccaccacacctggctaatttttcgattttttttaataaagatgaggtcttactatgttgcccaggctggtcttgaactcgaactcccagctcaagtgatcttcctgacttggcctctcaaagtgctgggattacaagcataagccaccatgcccagcccctagacctcatcttaaagactggcatttcaaaggtttctatcttttgtttataaacattctccttaagtgatatgatgcagttccatggccgtaagtaccaccttgtgcttcagccacatggggtctatttgcctttccctcaacatgtgagtaccccttgccttaaaagctgcttcttggacctctgtctaacctaaccctaaccctgaccttaacccaactcaacccctctctgcttggagaatttatactagtttttaaagactcatttttttctttgaagtctttctggaaccccaacctaaataaatttaattgttctttcatctctacttttgtagcactgtctgttttatacaatggtcagattttattgtagttgagtgttcacatggttatctcctctgaaaaactgaccttctccatggtaaaagccacaccttatttatctttccatctcctgtagcactaggcccagggcctggtatgtcatagatacatattagatatctgcatgttaaatcatgagtggattgtgaaaggtcacaaatttaaaaaggatatttgaaaactcattcatactaaaacaagcttcattttagcactgtgtgattctcataggtcttttgtgtccatgtcatatccaaataacaagaaattttggttggcatctcagtgaaagcagatgagaaagagaaggataaataaacatcaatcaaatggtgattaggttgttcaccatggcctattctttctggaaacttaagcagcacagataaagtctgggaagctacagcctaaacttatttccaaactcttgtctcataggaacctaaaatagccttcctgcatacttcaagcacatctagcaaaagaaggctttctatagccaataagttcagtccatttgttagtgagatgctaatttacctgcaaagtcccatcatcagataagtaattatttgcacatgacctcatctcctcttttgatctcatcaaggaaacagcattttcagtattttttttttagggcttaatctttgtctgatatctaattgcagaatgagcagaagtgctctagacagcctgtatccacagatgatactttaaaattggcggtatgggatcagttgacggatctgactacaaagtgtcagaggttgcaaattccttctctctgtatcaaattagggatggaaatgaggaagtagggggccaaggaatttacattgatcaagtgtttatcatattctagtctagtcattgtgcagattcttttatgtattttgtctgtgactataggggttgttcccactttacaaatgataagctctgggaggttcatcatcttgtccaaggtcacacagctaatacatggcagggtcttgccccaacatcatgccttcccagtagccttccctcttcaccttgcctcatggtagatctttttgcccatatcttttaagtatttccacttccctcttgactgtttctgtaagaataagcacacctatctcctatgcacacaaacatgacctaagaagcataaattaaaagacaaaaatattgctgaatttgattgcgtcagaacttagaatttctgttccgtgaaggataccatgaacaaagccattagaaggcaaaatgagagaagatattagcactgtctaaaatgttaaggaataaatatgtgggcctagagaatactggaaatcaacatgaagaaggcagtagtcctaatagaaaaatgggtaaaagttctgaattggcaacttaaagaagaggaagcctaaaagctagcaagtatgtaaagaaatgttcaactcattagtaataagtacaatgcaaattttaaaaacaatgagatcactttgtagcagggatgtattaataaaatgtgttggcagggctgtgaagacgtaggcaccctcatgcactgattggtgggtgtgaagcatggtgctgccattctggagaacaatctctagccaaattaaatatattttcatattctatgacccagtaattcacttttctggtatatttcccagagaaattattgtacagacccctaaaggtacatattcaaggatgattattatagcagtatttatgggggcaagatctatgtgggagagtggacatataaaatatgatggatggccccagggactatgacaaaacagttggaagcaatagactaatgtatgtattgcaacatgaatggctcttataaacataaagctgggctttaaaaaagtaaaaaatagaatgatatataatacaattgcatatgtatacatacaattttacatgcacacagaataatattttatattttgcaagaagatatacaatcaaaaaacatcttagaagagttttctacttaggacattgtgggagggagtgagaaatggggataaaagagaacaaatagttttttaaaagcaaataggacaaagagacttgcgatgaataggctaatgattttgtaccatgaattgaggcacataattaactgaacactctgaatttgatttttttttttttttttgagacagggtctcactctgtcaccctggctggagtgcagtggcatgatcttggctcactgcaacctctgactcatgggttaaaccaattctcatgcctcagcctcccgagtagctgggattacaggcgtacaccacaacgcccagctattttttgtattttttggtagagatggggttttgccatgttggccaggctggtctcgaactcccgacatcaggtgatccacccaccttgacctcccaaagtgctgggattaaatgtgtgagccaccatgctggcctgaatctgatcttaaaaacaaaaatccactcacctgtgaggcatgaggttaagatagatatatggataatttattacttacttcaagcataaaggaggccacttctcttttactctttcaatgcttatccagttcccttttcactcactattttatgacattcaattagatttttgcttttgattttatataatgtaaatacaatgtaaattattcactttttaaaaatatgtttttggtttttatgtcatacatctttgccattgttttcttcttcatttctaagcttttaagggcagggatgatatttcttttcacttgttattatatagtccctagcatggtgataatcccagtgttcaattttatgaaaaatcttctaggaggaggttttcctttttaaattctaaaagtgtggataatgttcctaggagagtagatgactaaataatgtaggctgatagcatcaggtatcctttttaataaacaccccattccatcttaacacctcctctctgcctcctctctgccttctctttagcaaatctgtctgccttttttcctgatagaaagtatcattggttaataactgtagattcttgataattgttattgtgaatgaattgcaaaatcgtggtcaataattaataggttataataagtattgagcttaatcaagtagaagtagtaaatttagatatttcttcttgatagttatgattccatctctttgtctttgtgtttattttttcagcttctctctgtgtgtctttttctatatctctctactaatcacctctttctttctctttatctccctctccctttctttctctttgtctctttctttatttttgactgtgtctctttgtttttatctctttttttcccctctcctagtttctggttcatggcctcaccaacagtgtagtccaaggctgatgcatttgcagctatgtcaggttagtgctctagaattaattagagcttctatcttttttttgagtctgtaaaagctttctttgacaggctcattgtagtcttggaattatagtcacttgaatcaagctggtgagtacatattttgtagcttcataacagtaaagaaacattttgtgatgcatttcacattgaaagtggctccaaaagagtcagtgccattttgatggcacttgggaaaatgcatcagtaatatcatttagctgaaggcactttgatttctccaggagagctgaatagaccaaggccttgtgagactctttacagtcctgattttcttttccttgaaaaatttcatggcaatttccaggaagtttcagaactttatgtcatcaaactgaaactttttttcttagaaaaacattaagatttttcttctttagtagtagatggcttaaaggttttaggtctgctattggtaaatgcattggatgttcaaagcttgattgactaagtgggtaataaataaaccactgggaccagatgacatcaacccagtatttttgaagaaagtagaaggtaatattgtcaaaacttggttcaattatttttaacccttgttagttggcactgaacacaagaactatcagatttttttgagcttacccttcataagaattatcctacgaagacttaagcagtacattttgttggtgattattatctctttatttcatccttgtattaatcaaggttctcaaaagaaacagaagcatacacacacacacacacacacacacacacacatggcctctttggaggccaagaagtctcatgatttaccatctaccagatggagacccaggaaagccagtggtgtagtttgaaggactgagagctggagaaccaatagtatacattccagtctgggtgtgaggacctgagaaccaaaaaatgctgagggcaggacaagattgatgtcccagttcaaatgatcaggcagagttattccagccttcttttgcctttctgctctattcagcctcttaatggttggatgatgttaacccacattggggagggccatttgctttattcagtccaccaattcaaatgctggatggaataagagaaagactgaagacagagtccagatttgagggatgaatggtttgatttaatggcttcagaagtggagaagcaaaaatgttaaagatctattaataccttttgtatatgagagatgaaggaattggaggaatcaaagattataaagctttcaagtttggattggtgagaaaaccataatggtattagagagaaaaagaagagggttgtggaggtaagttagctgaagccagtaatgagtttggttttcaatacactgaaccttttgaggttgattccataaaaggtagtcatgtcctcatatgcaatgctcccaagtgtcacagagtgataacaatggaccagtgtagtcactgatcccacccatgtagcatttcttattttcttcagttaaattctacaaactcatcagtatctcctactaatactgccacaacagtgatctctgcttagttatctgtcaggtcaacatactgtgagcctgattatggcaagggctgcctgtaatctgtctcccaagtcctgaagatagcacctgccacttggtaggtgatcagtaattggttgttgcattggcatccacagtgtgcccaggtcaaggtgatgatgatacacagatgagtcaaatgaggagatagcactggtgtaatgtgggaacatggagaagaggaggagtgataattctgtttgggggttgaacaagccttcaaagagatgtgacattgaaggataaaggatttactggggctaaggagggaaaaaagatatttttaggacaggaaactagaagagcaaaggcatgcaggtgtgagagtataagatgtgtttgctcaatgactggaggagcaagttcacagagaggagaaataagtggatggtgctagaactggaaacgtatgcaggtggactatagaaaaccttgctaaggctcttatgtgctctcacacttcttaggacagaaattatttttagagtgaggaaagaaggggagggaggttgttagatggtaatttaatctggtatcttttagtagaagcacagagaactgggaatgaagagttttgagttttaatttttgttgctaactaatgtgattaggacaaagttataaaaattctctgaactatctagggttagtttctgttatttataaatactattattagtagtataatttttatttgatacaagaattcctaaaagttttttttttcaggaaaatatctagtttttttaattttaaaaaatctaataaaccaaacaacagttcatactcttttggtcacataggcatcaatgaaataatttctattctgactgtcatggagaatcattagcctgttacctgctaatgttccctttgtcttttacactgtggttttttgtaaactatgtcagtcttactatgattcaaaggacattaaagcaaatggggtgtttagtgacaaaagtatttacaaaaagcttttttttttttaagttcacactgccgtattgtactctcctcaaccttacttttaagtacattttctatacttaatttgggagaaattaccataaaacatttagtgctttgttttctgatatggtttggttttgtcccttagttcatggaattgaacatttgccttcagactgtatttatgtattactttcatctgaagaacatttattaagcacctgtttgtgggcattgccagtgatataactggtctgaacaaaaatatagctaatgatgtgcaagcagaaagtgtaagtttcctgcagccttttaaaataatattttactgatcataaaagcaatgtgcttagaatgtaatatatgtagaactttgaaaaataaagaaaagcacaattaggaaaataaaattccatgaaattctactgcctgaagataagagctgtgaatattttggtctgtttgcatgctctggtttttttccctatgcatttaaatatttatgtacatttacaatatcttgtgaatgcttcccctcttttaaatgagagtatagtgtgattgttcaggacttggctttcctcatccaattaataatgacagtgtgacctttatcaacttatttcgcctttcaaaggctctgttttattttctgcaaaaagggaataatactagtgtctacttcacaggtttggagtcagggcaaaatgagataatgcatttaccgcactcagagcctggctcattacaggagttctttattattggatattgcagttatttcatttttttcatgtatgtaatgtttgctaagctatgcacagtcagtgccatcagtttccttaccattcagttgttaatcacagagtttgattccattacaataataatcgctgagtcagactttcaccccactgtaacttgtccctagtggaaatttttccattagtttctgaaacttgggacctctctgttgtttccctcatgcagatttggtcacactagatgacctcatttggttgtcgtggggtttatttctgtagtgatgatagcctcttacattccctccaccatagaacttggtagggatgagaactagctggacggggccagtaacggggttgcatatgaccttctgggtggttctagagtctggatctgagtcacttctggcaatggatcagccataggatttcataagagtggccattagagcccttttaagcagaatactgaagtctggggatggaaccaacctaggattaagagttggggaatcagctatcaccagcatgaggtgggatggagaaggggatgaggctagcacaacattagggaattttgctgctgttttggtgggcaatataggtttggctgtgtgtttgtcttcttgtgtcttggtgacatcttagagcctcacactactcccttcctcaacttatttatttattggaaaatataataaaattgagataatttttacctttaacataaaagttcggctctaaaaaatgtttggcaaagcagaaactctaagtactaatgaggatatgagttgctcctacagccactttagagagctactaaatgcaaataagcatgacctgattctaggctcacaccctaaaaaatctctcccacagtactaagacagacttgtacaagcatatttatagcagtgttgtttgtaaaaatatgaaattattattaaggaagagtagtaaaccaggtcagatttatacaaggaaatactagaaagcagttaaaatggatgaactgtagttacatatgtcagcctgaattaaacaacgttgaatttaataggtgtgttgagaattacaggtacagtatcatacaatttaaatgatattaaagaacatgcaaatgatactgtatttatgcatttatgtatagtgaaagtataaatgcattcattcacatgttgaatactgtatttagataacaagtgctatgtctagagaaggaagagaatgagatgggggagataaagcatcagagatttgtattctatggatatgtatttaagttaaaaaatgacagcaaaaacaaatatttgagggggtggataccacgttttccatgatgtgattattatacattgcatgcctatatcaaatatctcatgtaccctataaatgtatatacctattatgtacccacaaaaattaaaagtaaaaaatttaaaaggacaaaatattaagttttaaggagactgaagtatgttttatattctctatttgttatctgattaacgtatttcaccattttcttaaatggggaaataaggacagaggaaattaacatataaccacaacaaattctagcagtgcaagggaaagtaagcctttatcacactgctgatccctgatcccttgttcctgtggccagagaaaactgctgttttttttttaatttttattttttattttttgagacggagtctcgctctgtctcccaggctggagtgcagtggtgcaatctcctcactgcaagctctgcctcccaggttcacgccattctcctgcctcagcctcctgaatagctgggactacaggcacccaccaccatgcccggctgattttttgtatttttagtagagacggggtttcaccgtgttagccaggatggtctcgatctcctgacctcgtgatccacccgcctggacctcccaaagtgctgggattacaggcttgagccaccgcgcccggctgaaaactactcttaatagttacccatgaatcctcatgacagccggtgatatagaagcatattgtatgcacattccttttacacctgcatggtaaatgctctttgctcctttcactacactatgtataccttggaggtcatttatcctgcaatatctgaccttttcttctaaagaaacttttgcttcatgaaggtaagtacaactacagtttctctaaagctcagttttgaaatcagtgatataaaatacatagggtcagttttacatagtaagttgtcaagacagattgcactcagactcaaaccaaccttgaaaacaaagtactgtatatctgtatttacatttgaaaggctcttttcccacttcagtttgtcaaacagttgaatatgttaagcttgagactagagacaatgtcagggtgaacatatgtgagggattcacacttctcaaagaaaagcacgctttttgtggccttggacaaagctgggattccgtgctgttgttattttcacaagtccctctactgagatcatgactgcatcttagagttgctgttgaatacagatgatgttaattttgttctcattcatattctatttagtttttaccaaactaaatgtttattagttggtgatatttaggaagtttgataggattgtgactatatagctatattttatgaaaaatggaggaaaagttccctttaaaatacctaaattttttttgagttaaagaaagaaaaataaaattcatgaaatagtgacgtgaagcttggtagtttagctgcagctgccaggtgtctaggctggctcttgggagagattattatgggatcacagtgagcctggctacacagagcatggaaagtcccctcgtccttgtcatcacagagtttggcttacagacctctcctctcaaagatggaggcttctggtctttctgatattgttttctcttcctgtccctccttatagagagaaatccaaaatatttttgctaaaattctctagagttgaatttgggaacaccaggggataaaacccctcatgttaaggcatgtaggaggaaaggtatcctcttatcaatcgaattgtagttcaaatatgctgtaaacccacctgtttactccttcgtggtggccgtaagatgtgaaaaggcaggggctccagaagttctaggtaggagtcctttgttcttatgtttttcaagggtctcatggtgaccaacattgttaacttcttttagcctctgtttcctcaccctcaaatgaggtcaatagtatctactttcagaagtgatattcaaaatatctgatatgggagtgggacttggctgttatcagacagatggcatatgcatcccgtaatgttgtgcctggtgctgtaaggttgtgcctggtgaatgtcaactaggactgttttacagggttgctataagggtaagataagatcatgcacatgaatgtgctttgaaaactgcaaggggatacataaatttgtactattaatgcaaaatacatgcaatgggcaggaagtttgagaagtgctttgagctgtttgaccagaagattctttaatgagaataaggaattattgccctgtgatgtcaatgtatttaaatatatgcttattatacatatattgaactatatatataatatacatatattacacatatattgaactcagcaattgaatgcttaggtatttacctaagaaaaatgaaaacacaattctactcaaaggcttataggtgaatattcaccgtagttttattcatcatagctaaaaactggcaacaatttcttatgttgatcacctgctgaatgagtaaacatgctgtgatgcctccatacaatggaacactacccagcaataaaatggaacacatgcctgatggacacagtaatgtagacaagtctcaagtgcattatgctaactgaaagaagacagacacaaaacattacgcaccatatgattctatttctatgaaattctatcaaaggcaaaactttagcaacagaaatcagatagtggttttcaggggccggggtcaggggagagattggctgtaagaggtatgaggaaactttctgaagtaatggaaatattctatctcttgattgtggtggtggttacatgattctatatgtatttgtcaaaatctatggaattgtatactgaaaaattgatcaatttcattatacataaattatacttcaaaaaaatggaactgggtaaaaatagttccctcatgaaaaaaatagaaaatgcaatgttgaaagagaaaggaggaacattctttacaaaacaaaatgtttcttctttataggctatatatttcagtttcagcttcgagtaatgaattttatggcttcgtctcttgcattgagcattacactctagtgaacacccaacttgctaagtcgtcccccatacacaccttactgtttctctctttgttatcatttccttatgctgagcacttgcctggagtagctccctcccccagccttccctggggctctcatttcctccctcactcatttggttaactcttatttaccattgaagattcagtttggaattcaccttctccaagagccttcccctggtttctccccatccctttcacattggggctcatttgggtatccctggccattagctttgtcagtatactcaccagatttcactataagtagctctttatgggtttgtcttccccaaaagaggttaaggactatatcttacacacttttataccctggtgcccagcatgttgctgatggtcaatagatgtttgtagaattagtgattgggagtgccaaagggagtggtgaggacatgtgagattgtggaaagaatgcaagggaaggaagattatttgaatcccagtctctcacttagtggttagagtaactttggacaagttggttaatgtgtctcagatagaagatggagatctagacccatctactggataggattaccataagatctacataaaactatgatgtgaaagcactctgtacctagtaaagcagttcacacacataagttattattatgtcattggaagagtgttgtttctcagctcttggatatagcaatgtaaaccaaaccaaacggataaaatatattcaccttcaactttaagggtagtgtctgcattgcattgatatgttcacctgactccttatagcatctagttagaacttcctctgctcataagagacagctatagtcttgtcagtcctttcactctgttatttctcattgaagcaattgctaaccagtgtatataatttttgaaaacatggatcttgttttatttagctttgggtcctctatagcacttactagagttcattgcatctagaaatgttaaaatggcaagccaagtagaggttaacatagacatctagagaaatgttatccagttttccagagaaggctaaatatcaaaatagtgttgtaattaaatcttatttttagaatctgataaagtaattttgggttaccacagaaatctttcaagtttaagctaataaaatattaatgtcctggatctttggaaatctactaatgtcttcatttggaacttcataagaatcaagaatttcactgcatctaagatccgttttccacaagtcttaaaatctgaactacagcacgttatctatgtgatattctttctagcatttcataaacgtattcttttaaaaaaataattattttatcttgattatagaagaatggagtctataccttatttgtaggtgatagagcaagcaccaggcccttgacccactcttactgcctccgttcatcattatttttagtttctactaacctttattgtattatttggaacaaaatggaagaaaacctaactgggtgtataaattttgatgtacattaacaattcatcaaagtgatattatagataatgtgactgttttcataaacaaaacaggactaaaataaatgaatatgcagaagaaagtgtgagagatactgaaatattttgctggtatagtatattatgcagatgtttgcatttatgaggtagaactagaaaacaaaaaaactctatgttataatcatttttaataaatgaatttttatttccaggtaatttatacctatattcaagtcttggtaagcaatttaaaataatttgctgacttgttgatctcacctttcaaataatatgccaagggccaataacttcttgcaacatgtatagatatttatccaaatgtgtttttgataaggatatgaaaatatttggggaataaatccaatacttatgcttatttatggtacataaatcggagtttcccatgagtgaccgtaaaaattggaggaagtggaaagaaagaggaactgaaatataaaccaaatgtttgtttatgggctttatttagaaatccacattagtgattctgacattgggatattaatccaaaatttcctttctttgtggattattttcacacaaaattgtacattctcatgaggcaattctctttggagtacccatagagaattattacatttttaccagataggttctttttaatattctaatctagcaaatttgcatttaagaaaactactttattccaggatagcttttttgcacaagttattgttctgcccacctcccctcaaataaaaccagcatcataacttctcagagctttgtctgctttcaagattctttggcacctgcactgggttatatgccataccaaaaatgtttcccagccattcatgtttaaatacatttaagtttacattaatttttaaaaggattaaaagcaccttcaaaaatgaagcatgtattctctaagcagcaagtattaatttataggggctgttcatggaaaaaaatgctgttattgtatgtctcttgccccatgcataataaagaacttttctttttgaaagtaattgctgtaaaatattccttgagggatcaaaatattagtatgactgggaagtaggatctctgttcttaggcagattgttttgttacttagttccaaatataaaactggacaaaagtaggtgaggtaagggaatgatagagtggttagaagagatctttagataagaacatctttggcaacagggatagggccttcacgatctttcttaaaatcctggagcggcaggcttcacgtgggaggaaaccaggggttgccactagatcagctaagagacaagcaaataagaggctgggtgcagaaaatgctgagtctctccgaaggtttttccctcaagctgagctggtgtctggttttctgaccacatgttgtttcttctctttataagagtgaaacaacattcctgtttaaaaaaaaaaagccaaaatgtttgtcatcaagcctgacagtgatatgggtcctcactcaaatacagtgagacttcttcctacgatattggtcctgtggagttaggtcagaaggatgtggttataaaataaagtgatttcattttgtttatctcctactcagaaactttcagtgttccccctttcccgcagtgacaacaggaaaaggcccaaaagcttcagcatggcaggtggaggccttctagaacctggttccaatcttagcataacttttaccacttcctaactcaagcctcaactctagctcaaccattcttctatgtaatcaagagatattctaggcacttctggtgggaagtagagaataagccaaggctgggaggggtgaggcctggggaactttaacagagattagtacccagatcactaaatttggggttggagggtgaggcaaagaactctggtactgtctacactgacagtctttctaaggtacctttccaagaagagaagacagtgcttgcctagtgactgtgatggttcagggataatgtgacaattcttgacaccctgctgttactttacttatagatcagaacatattctgtgagctgatatattagattttagaaggagaagccaatcccaaaagacaggtaggaattaaatggggaactcaggatacccaactatcagtttggtggccagagctggacttgctttcttgaggaaattatgatgaaaaccagggcctgagtcttgcagtcaaactggcctctgaaagagagggctggaggtgggaatgggtgggaaaatggcagctcactctgctgcctaggactcataacgcctggtatatcagataccagaaaacaagtattatactattccagagattatctgtcttactaatagggccctgggtagggcagagcctataggcttttaattttgacacctgggcaggacaagttctttcagtgacggacacttatcttccagcactataataggcctcattatggtacatatgataaattatcttgtccaattaatttatgccactttagactaaggactgtcatatatatacatatatatacacacatatatatacacacatacatatatatgcacatatatatatatagtttctttaggtcttaccaaagtattaaatactttttgaacaaataacgtattttggggggcattattctgtccacttacctaaatcaaggatgatataaacaataaatacaatttcaataaattagattttaatttttttttaatgaacagaaagccaattgattggtttcctgaagctctattgtttcctcctgtcaatggaatacaaaatcacaggaactctttatcacttagattggagattacgaatgccgtgaaggcaagtaactgcctttcttcttctaattattttggaaagaacatatttttcactagaaagaccagaagctggaaagccaaaggctttggccacaaaactgtgaagggactctggatggatggaggctccacaagagcttcattccaaattaagatgttcaggctacattgaagaaagcaatctatttgccttggaaaaatttattagtgctaagagctaatatatgaaatatacaatctgtatctggatgtttgcatttctctaaatcttgccctcaacatatatatcattttcaataaatggttttgagccataattttttcattcattctatatgccagttggtgtgcaggtggtgttgatatagaaatgagtaaggcacaggtgctaacatcaggggctcacagtcctcactggcatcaggtgaagcactgcatgcaatacaaggacaagtcctcaagcaactgatgcatagatttttaaaaagtggtatagccatacaacagaatagtctttggcaataaaaatgaatgaagtactggtgcatgctaaaaacctcagaaacattaggataaatgaaaaatgccaatcacaaaagaccacattttatatgattccatttatataaaatgtatagaataggcaaagacatggaaatagaaagtacattggtagttgccaggggtttggcaaccccactttgccagcggagggtgcagatggggagtgattattaatggtactgtgtttgtcgtagaggtgattaaaacctttcaaaattgattgtggtgatggctgcataactctgtgaaatactaagaacctttaaatgaacgcttcaaatgagtgaattgtatgacatgtgaatttaacctgaacaaaggtattataaaaagagagagagagaaatggtaggaggagatagatctttcaaaaaattgtgaattaggggaagtagagaaaagggaaggtgttaaaagaagatgttttaatctacattggttatcaaatgtacacaacagttttaagtacacattctcatttcatccaaacaacattgctgtgattttgctgttatttagataaggaaatggaagcttggagagcttaagcgatttgccaaaatacatacaacttaacaagcagaatgggctattaaggtcagacctgaggaaagcagatcacagttgagggggttggaggaaaaaaagaaagaaagaaagagaaagaaagacaagatgaagatacagggattttgaattctctgatcccagaagctctcattggctaaatcacagttttagcactgttcacttttattcttttgtaggctaatgtactaagctaattatgtatttacattttaaattccttgaggactaggcaatgtctctatcatttagattcttctaggtacaggcatccctcggagatattgtgggttttgattctggaccaccacagtaaagtaaatatcacaataaaattttttggtttcccagtacatataaaagttatgtagtctattaagtgtgtaatagcattatggctaaaagaatgtacatactttaatttataaatactattaatatattgctaaaaatgctaactgtcatctgtgccttcagcaagttgtaatctttttgctggtggtggtcttgccttgatgttgacggctgccgactgatgagggtggtggttgctgaaggctagggtggctgtggcaatttcttaaaataagacaacaatgaagtttgctgcaatgaatgatatttctttcatgaaagattcttctggagtatgtgatggtgtttggtagcatttttcccacagtaggacttccaaaattggagccagttctctcaaatcctgccattgccttatcagctaagtttatggaacattctaaatcctttgttgtcatttcaacaatgttcacacaccttcaccaggagtagattccatctcaggaaactcgtttatttgctcatccataaaaagcaactcctcatctgttaaagctttattgtgagattgcagtaatttagtcatatcttcaggctccacttctaattctagttcttttgttatttctcctacatctgcaggtacttcctcctctgaagtcttgaacccctcaaagtcatccatgagggttggaatcaacttcttccaaactcctgttaatgttgatatttttacctccttccataaatcatgaatattcttaatggaatctagaatggtgaatcttttccagaaggttgttgatttactttgcttagatacatcagaggaatcacaatctatggcagccatagccttatgaaatgtatttgttaaataataagacttgaaggttgaaattgctatttgatccatgggcttcagattggatgttgtattagcaggcaagaaaacaacattaattttcttgtatatcttcatcagaactcctgagtgaacaggtgccatgccaattagcagtaatattttgaaaggattttttttctgagcagtacatctcaagagtgggcttaaaatatttactaaaccatactgtttaataaaccatatctgttctataaacagatacgctgtcatccaggctttgttgtttcatttatagagcactgttagagtagatttagcataacttttaaaagccctatgatttttggaaaggtaaatgaatattggcttcaacaaagtcatagctacattagtttccaacaagaaggtcagcctgtccatttgaagctttgaatccaggcattgacttctctctagctatgaaagttctagatcttctaatagaaggctgttttgtctacattgaaaatctgttgttcagcgtagtgacatacctcaatggtcttaactgggttttctggataactagctatagcttctacattagcacttgctgcttcaccttgcattttcatgttatgggccctctttccttaaatgaaccaacctctgctagcttatatgggtgcagttcatggtgctccaaaacaattatgatagtaaatcagaactcactgctcacaggttatcataacagatatagtaaaaatgaaaaagcttgaaatattgcaataacttttcttttgtagcttccttacttctttcagccatcatagaattgaagagagttagggctttcctctggattaggctttggcttaagggaatgttgtagggggtttgatcttctgtccagacagccagaactttcaccctatcagcaataagactattttgctttcttatcactcacgtgttcgctggactagcactttttttttttttattattgagacagagtcttgctctgtcacacaggctgcactgctttggtgcaatcctggctcactgcagccttgatctcccaggctcaagcaatcctcccacctcagccttctgagtagctgggactataggtacatgccaccatgcccagttaattttaaaatttttttgtggagacagggtctcactatgttgcccaagctggtctccaactactggattcaagcaattctcctaccttggcttcccaaattgctgggattacagcaatgggccaccacacctagccagcactcataatttccttcaagaacttttcctttgcattcacaacttagctaactgtttggcacaagaggcctagcttttgccctatcttggctattgacatgccttcctcactaagcctaaccatttcttgtttttgatttaaagtgagaaatgtgtgactcctttcacatgaacactaagaggccatcgtaggttattaattggcctaatttcaatggtgttgtatcttagggaatagggaagcctgaggagagggagagagcaccatgtactgcacccatataagaagagaaacctaatcaataaactttgtgttctgactgctccatcaaccttccggacaagtcagaacacaagcaacatttattgattaggtttctcttcttacatgggtgtagttcgtggtgctccaaaacaattacaatagcaatatcagagctcactgatcatagatcatcataacagatatagtaaaaatgaaaattcttgaaatattgcaagaattacctaaatgtgacacagagacatgaagtgaacaactgctcttggaaaaatggtatggatagacttgcttgatgtggggttgcaacaaactcgatttgtaaaaaacgcattcatctgtgaagcacaaaaaggcaaagcaaataaaatgaggtatgcttgaatatttggggacctgactacccatttgcctgttttgggcaactgtattctgagaaaaatctgagctcattggcaaccaatcagtagaagtagggtggccacagatacagacatatgtccttgttagttgttattattttgtaagagagtatcacctgtagtgtcaatatgtattaccctgccctgaactgataacatggaacacacattagctccaagtttttggcagagatgctgtcctttaactctttgttattcaatcctcatcaaatccttctttcctttttctaattgcactccttttatactcccgtatcaaatccttcaatgtaaactgttaattctatttctaaaatatattgcaaattcagccacttctttttctcttctgtgaaatcaggcctggccatctccatcatctttgtttaggtctttcttttcagctggttacattactttcaagtctgtctctcctctactccgtaactgaaaaactatattttttttctatggaaattccatcacatagctccctgaaggtcctcctgcctagaaaaattatcatcacacaattaccttttaaaacacatcttaaaaacccaatcagcaaatgtttgaggggctaatatgagggagcttcaaaaagtttgtggaaaaagtgaattaaaaataaaaatgaaaaatataacctttatttctcaacataagctccatcaagttcaaaacacttttgtaagtgatgatatcagccatttagtttatccctaaataactgggcactctaggtatataaccatatcattgcagtcttttttacattattaactaaagaaaaatgggtgccctttacagatttttaagattaggaaacaaaaaaaaatcaaaaggagttaaatcaggactttcaggtggatgcctaataactttcccttgaaacttttgtaaaattgcccttgtttgatgagcagaatgagcaggagcatcattgtggtggagaaggattttctggtgaagctctcctgggcatttttctgctaaagatttggctatgtttctcaaaacactgttataataagcagatattattgttctttcacctgcagaaagacaataagcaaaatgccttgatcatcccaaaaaactgttgccatgacctttgctcttcattggtcagcttttgctttcacaggaccacttccacctcttggtagccatggctttgcttgtgctttgtcttcaggatcataccggaaagccatgtttcatctcctgttacagttatttaaagaaatgctatagaatcttgattccacttgtttaaaattttcattgaaacctctgctcttctctgcagctgatctgggcacaatggttttggcacccatcaagtggaaagtttgcccaactttgatattttagtcagaattgcataagctgacaaatcaagatatctatggtgttggttattgtttctgctgttaattgtcactcttcttcaattaggacatgaacaaagtgaatttttttcctcacagattgatgtggatggtctgccactgcaagcttcattttcaacattgtcttgtcccttcttaaaatgagttatcgatctgtaggctgctgattcctttgaggcattgtccctgtaaacttttcataaagcagcagtgatttcaccattcttcttcccaagcttcaccttaaatgtgatgtttgttcttgtttcaattttagcagaattcatgttgcactgatgggggctctttttcaaaaaaatattttttattgtactaaaatatacatatataatttaccatctttatcttttttaagtgtgtagttcagtggtaataaatgcatttatattctatttgtttctttgactcttctcccctctccccttcctggcctctgataactaccaatctctatctttatgagatctacttttttagctcccacatgtgagtgagactatatgatatttgtctttctgtgcttggactttttcacttaacataatggtcttcaattccatctatgttgctgcaaatgacaggatttcattcatttttatggctgaatgatatttcattgtgtatatatatggcgttttctttcttcattcatctgttgatgggtacttagcttgattccgtattttcactattgttagcagtgctgaaataaacacgggagtgcagatatctctttgatgtattgatttcctttctttttgatatataccaagtagtagaattactggatcatatggtggttctacttttagttttttgaggaaccttcatactgtacattaggctgtactaatttgcattcccaccaacagtgtatgaaggttcccctttctccacatcctcaccagcatctgttattgtgtgtggtgagatgctgtctcattgtggttttcatttgcatttctctgatgattagggatattgagcatttttttcatgtacttcttggccatttgtatgtcttttgagaaatgtctgttcaaaccttttgcccaatatttaatctgaatttttttttttttttttttttttttgctattgagttgtttgaactccttatatgttctggttattaatcccttgtcagatggatagtttgcaaatattttctctcattctgtgtgttgtcttttcactttgtcgattgtttgctgtgcagaagctttttaggttgatataatcccaattatatatttttgcttgggttgcctgtgcttttcaggtcttaaacaaaaaatatttgcccagaccaatgttctgggacatttctccaaagttttattctagtggtttcattgttttaggacttctattgaaatattttatccattttgatttgatttttgtgtatagtgggaaatagaggtccaatttcattcttttgcatatagctatccagtttttgataggggctcttttaaaactgatgtcttatccttcttagtgcctcaaactagattctgttcagatatgttataataaattagtatgagtttattttgatgcaaaaaagttgaaatctatttttttataatacacatttttcatgaacttcttgaagacccctcctatttgccagacactgttctttcattgactaataaataaattctctctcctttcttttttcatttttcagctcttgggttttacagttttaaaaattaatttttaattagacaagtaaaaattatatgatttgtactgtacaagtgtgatgttttgatatgtatgtacactgtgtaatggccaaatcaggcatatccattacctcacatacttaacatttttttgtggtgataacacttagaatctatcctcttagcaattttcaagtatacaatctattgttattaactatagtcagcatgatgtacaacatatctcttgaactttttctaactgaaaatttgtgtcctttgaccaacttcttcccaatctctacattccctcatctctggtaatcattattttactctctgtttctatgaatttgagttttctagattccacgtataagtaagctcagatggcatttttctttgtgtgcctggcctattttacttaacataatggccttcaagttcatccaagttgttgcaaatgacaatatttctttttttggtaaggccgaatagtaattccattgtgcctatataccacatttcctttatccattcattcactgatggacacttaggttgattccatatcttgggtattgtcaataatgttgtaatgaacataggagtgcaggtatctctttgacatactgatttcatattctttggatatgtgtacccagtagtgggattgctgggtcatatggtagccctatttttaattttttagctctatttttaattttttgaggagcctctacactgtttttcataatggcattctcaatttacattctcttcaacagtgtacaaggattcccttttctacttatccctgccaacacaaattctaactcttcaccatggcccaggaggtcctgcatgatatggttcctgcctttttgtcagattttgtctcatgtttctctttgccctttctcactgcactccagccacaaaaatcctctttcagcttcttgtgaaggttttcctgcctagaggcttttgtaggtacagtgacctctgcaatgagtattcttgtctccattcttcttgtccatagttcgttagcataaaatccttcagtttttcagcttaaatatctcctcagagaagtcttccctgatcacctaatacaaagaagttttctgtccccctcattcttcagttagctaaaaataatagaaaacccaaaacaatagttgcttacacaccatagaagtttctttctctgtcatatgaaattatagataactatgcaccagagtgttagcaacccagattccactgtccagatgttcctttccaagcctacctcgtcatccaggatggcttcttccatctgcatttgagtgaccaggataaagacatgccaccccctttaagtaacatggccacatctagctacagggaagctagaaaatggggtctttttaaaactctagacagtcatcttcccagcaaaattaaaactgttattactaagggagagggagaaaatggaaatggagggatgaagaggagttacattccacattttatactcatggtagaaatggacttttgtacattattgtatcacatggcatttttaattatataattttcttgtaggcaaataactttcttatgggaaatttgtgctactcttaagcaactggcttgttttcctattatggacattgtgaatcttctgcctgattatgttttgctttttgatttgtttgccaggaagtttgtagctaaatttatggtcctctccagcaactacacaaatcctatgatggatattttttctgataatattatctgtagcgttattttattttactatactttcttcctttctttctttaccttcttcctttctttttattttcttcaatgtaattttgcaagtctcttcaaattcctttggtaataagtcaggaaataagtaaaacacaagtataaataaataaagtattttatatttaatgaaggtgataaaagtgcctacattatagggctgtcgagagaatccactgagttaatgtaagtaaaacatttagagcagtgcctggcatattgtaagacctatagaaatgctagttcgttattattattattttaattaaatctttcctgaagtgactgtcagataaatctgcttgataagacagttttactttaacttttgttctaggttaaacaaagagggaaagattaaaatatacatttaaggaccactcagcaacaatcattctatgtcttcatattctaatctacatggcagctagtaaatgcattgtgctgtgtaagataatgtgctaaaactcttagtggagatggcctctaaattttttatgtttagtatttaggcatcttgtagataaaatgtatggatgaataatcagatgaggattcaatgaccagaagtactgttgctctctctccatctctttctgttagaaatagatctccatcagataggtctgtgtttgaattttagatgtactaccaaccacactatgtgacctaggtcaagtctcagctttcatgtcaatatatttaccgatgggtggcagtaatacctatcatatagggacataaggattacattaaataatacatgttaagatctttgcatggttcctggccagagtacacatacaatagctatttctgatatcattattttcactcaagtcttttaaattgaagaattatcaccttttagcacttgaatttatattgaatctatacacacatcatttttttatttaaatatttgaaatccttaccctacaatccaatggaaattctgcaaatgtttaaagttttggactccatgacaaaattgtatagatagaatagtggttttaaatatggctcggggattacaaatggtccacatggatccttgggaatgaatcaagctacgagctcctatagcaataatatttctattaccatagcgtatgtgcctaagtttctggtgtggattaataaattattactgttgttaaatggatgcctggttttcttaattggtagctcatcaaaagcttattaaaaacttcctattcattttgttgatttcagtggttggggataaatggcccaggaggctctttgccctgctaaagtggatcatgaacaatgtgggatatttaattcaattcaattcagcaaacatattgaattcaaaatatgcaaaaagcattgtgctacaaattgtgacaatatcaagggacatcccctgtggtggccttctgttatttggtacccaggatccatttttattctatttgggaactacagccttggcccactccaagctatgtggtttgggtaggattggccccttacccaggtctgggggtggaatggccttgcttggcttaaggtagtcagcataaccctttcctatggccatggtattagatttatgagtgggcatataactcatgaatctttaaaagacttgtgcctggggcttctgaaaaaaaatgaagtctcctctgtctttgcagtgggaacttctggaaaagatactttctctttccctgggcctatagttaggatgtaaggtataggagagcctgcagatgttttgggggagaacaccacacagattttgaatatgaagctaacaccatgggtttggagtcggtctgacctggattcaaatccaagcactgtcactttctagtttggtaaggtatttgagcttcgttgtgcctccattttgtcacctataaaatgtggctaatgcccttactctctcctccttaaaactatttggtactggcttttaattgtaacagaattaacatcaataattggatttgtgcccatcaagccaatgaactttcataaaatgaaatccagaaaattttcatgtaattcatagagttcttatatttaacccatgtctctagaatcttcttctagtgacaaattatgttgtattgaatcatgtgaaactgagccaagtttatcattatttagggtagaaattctgttttgttacagtagtttcactcaagttttacttctctaagaagaacataagacacacttaaaattttaagcatatctacataaaaaagcccagtttgttataccattttcatagagttattttagccctctaatatagcactgtaataacattttgtacttgctacaaacataagcacactagtttctatcatttttgcccttggtttataaagatggaatttagaaagcaaatacatttagggatgaaatagtgaaatctgctgaatgtgtgtagaattattaaagagtataacatggctgcttgttttatttagaaatgacattgggtgggttagctaaccaaagctgccaatactgtattttaatgatcttgagtttatctcctatttacaattctttgtcatttagtctacaggtgttagatcacttaacacttgctgaattcttcagatttgtttgtttcctgccgtttggtgttgatcattttgatgtgtgataggaggaggaagtagttatctaattttcactgaacaatcttccctaaggtatcacatatattcattctatatcttctatcagtcagccatagattgtgaaaaactttgatagaaactttaaattcagagcccctgaattagtcagttttcactcagtaatgctatgataacaaacaacctccaaaatctcagtggttcacaaaaaccaagctttaattcttgttctgtatatatatatacatatatctgccgattagtagtgcctttgctcctgcctcaggtatctttttttaccccagaatgcagacagaaggagcagcttccatctgggacatgccattctcctggctgagggcaatgatctctctttttcttttttcttttactttttaagttctggggtacatatgcaggatgtgcaggtttgttaacataggtaaacgtgtgccatggtggtttgttgcacccatcagcccattacctaggtattaagtcaagcatgcattagctgtttttgccaatgctctccctccccgtactccactcctcaacaggcctcagtgtgtgttgttcccctccctgtgtccgtgtgttttcattgttcagctcccacttataagcgagaacatgcagtatttgatttactgtttctgcattagtttgctgaggataatggcttccagctccacccatgaccctgcaaaggacatgatcttgttcctttttatggctgcatagtattccacggtgtatatgtaccacattttcttagagacaatgccaaatcttgcaatggtccttaaagctcctgctcaattatgactgtatatcatgcgtattcatattccattggccagagaaagtctcttggccaagtccaagctcagtgtctttgactgagatatcgcagtttacaaggcaatgggtgggcatgagttttaagaggaaataatggaacatatgtcataggtctgttttggacagggctactggtgtatttttctcttatgtcctattcttctgctgtttttttctccaaaaactcccttccttggttctctcatccacccctccatcacttcctctgtactcttggctgccaagtagacccatggagcctactccacttttctgtccagcctgatgtagaatctttaggatataggacctaaattattgctttagtaaaaactggagctgtctgatgttataaggaatagctctactctgagccaagtaggcttggtatttactgaagtcatatccactttgttttattcctggtaatttggcttgaagtgaaattttaaataaaccagatacttattgcttatgcccactaaatatatgtccacagcccttaaataactacctttgtcttatagtgctttatggaacatagagcaattttaccaccattatctcatatgatggtcacaagaagcctggtgatgccaatattattgtgattcccatttcacaggataaaaaaaagttaagtagcttattcaggatcaaaaggctggtgagctttatagccagcattcaagccagggtatatagtgataggcatttcttgttattgacaaagaaatcctctgctttaagcatatatcgaataatgcataatgtaataaataccctgttttttcaaaaaaaagttacagagtaagatgttggcttgtttcactgaaaatattcaacttaaaatttttagaaatgtcttattagttttgaatgatctgatgactaaatttcagtttatataaaactttccctcataaaacaatcattacacagtttgggcactatgcttgctggagtataaaaccccattgcagtaaacagtgtgtcatcatgctgttactgaaagtggcctactatgctttatctccactgccctgtcccaatctaagccactgtcacctcttacccagaatgtggcagtagtcctttcaacagtcctctataccttttctgacttcctccaagcttttcctcaagctgagcctagtgatatttttaactgtgaatgtgaatttgtctgacttccctatccttacccaaagtccttaatacaagtctcccatgtgatatcaccctgcaaacgtggccagccttctatcgtcattctctccctcaatttctgcttactttctcatcttagtcctctctcctacccaccctccagccagtgtctcctagtcaattggcactcatttttcccatcccagcttcccagggaagctagccatgacccccagaccatgataactagcccattttagtctactgtagctggcaactcacctccatatcccacccattgccacacctggattttcctctgtaaatactgcttgaacctgactgaggtgcattatgcttcctgctgctcactttaccaggttagatgacagcggttttcatgaaagccgtccctcactcacgcacattagtcacctttacaaggaaacacccagtgattagagagaaagcaaccaccatgtcagccatgcttcaaagcaaccatattcaaaacaagttgtttttggaaaagagtatatttcatgttttagagtataaatgttccctgtgataattactataagaaatcaagatactccagtctgagtgcctgttcatgctgctgcaaaaacaatgggaaaagtttggattttaaggcaatccaatttctaaggaccagaagcagtctatgcttatggctgcttattgctagttgggttcttataaacctggagtgtcctacatttcatgttgaattgaacataatgggcctgtgataggcacctctccacaaaataacaaaagtctctgtataaactcaatattttagaagtcaaagtagacaggatactttgcttgtggcttgtcctcaggtatcagtacagcaagtggctctcagcacaccaccaaacagggcaggcagctggctctctagagataattataatttattgtgcccatggattttgatgcagtggggtctgggctctctcacaaggccaacagagcaggtctaatttgagccagatctcaggagacacagtccggagaggatgggtcatgtgccttcagttatcacttggagttgcactttgccccttgttcctctttctctcaactagtagctgagttttaatttttttccctgaaaatttattcagagagactgttttccttttcttcctggaattcacagaatgaagatggaggtccataaataccttggttaaaagttggaagatcatagagtgtcccactgtctgttttggggcctggcaggaatactcctaatcactgtaaatgaataggtgtttcatctatttttgtcttctcttctttgttctctacctgaaaatgtccttccctcattttcaggctactgaaatcttctaaagccttcttaaagtttcttctttataggaaacttcctagatttcttcctttagtcagaattaatgctgatttatgttctctcatgaaattgtactttgtactttcatttagtgctgtgactgttctttttaaagttattgtttacttatttttttctcctccagattatacaatccttaaggatagtactggaatttcctcatcttcctattgtccacattgcccagcgtgaaattttggcccagtaggaaggctatacatttgttgaattaattttgatctgtaaggcatattcttccacgaaaaggacattgcacaatcacaatattctccataaacaaatggacactcagaaagaactgttgtgttcttttatctgccttccatgaatgtgcagtttccttaccacttctccatggacctagttatcttgcatagtgcacacattagaagattatgtgataagagtagaaagctaggtttcctttgggtagggctagactatttcctgttcagaggtgaagacttctgaaatcagaatcaattttctaaaacataccacattaaaataagaccatagacacgtttttctgtctataagtctttttattttgatggtagaaaatgttgtaagattatttcattatcttcttattgttaactgttttggggaagaatcaaatcaggagagactgagattggagtctttttatcaaattctctatagactacatgatccgtgccaataccacagcagtcagcagctgttgtctgtgctaggagaccacagtagtaattacacacaggttaagtggcttaaaaaaattgatcggttttgaaaattaggtgtggaagatagaaaggaacctgaggatttttataatatttttgtgatataatagactatagccaaaagagttactttatagtgagtatttttagcttcagtcccacattctcttcagaaattagtattataatccttttcattactctaaccgagtctgatgactcctgtcctaggatgaaacacccctcccaactcccttattaagagattgggacctagtgtgattaacagcaccctgatcgatgagcaagattcttacagattaaggaaaagaattgctgacaacttaggctgacttttatatacctatttgttttccttcctaattcctcttaaaatgaaaatgccaagcttttcttttgatatttgttacatttgtgaaataatataacaatgcagttaatgggaagagcatgacccctggattcagatatccaatagttacaaatctcagcttcagcacctagcagttatgtgaactttcttctctgcacctcagtctcttcataataactactttgcagagttgctgtgaatattagtgtaaataatggacattcaaatatagctattactgttattatcatcatcaattattctacctatagaaatatgcaagttccttggaagtatacatttctggagagtgatcagggatggggtattatacttttattttttcggtttctcttcattcattcagtgggttatgggtatgtgtgtgtgtgtgtgtgtgtttcacacattatgtgctaggcactatttcaggcacttggaacttacattattgtaggggtacaactggaaactgataaatgctgtaaaaaaaattaaacaagctaagaggtacaggaggttgggagagagttgcaattattaatagggacattagggtaggccttactgtgaatatgacacaggttttgtgttcttagaggttttcatgaactatcttttggaatgggaggatgggaagaagggagatgagagtaaagagtaagagcttgctgatttgtaggcaggcatgaatattccctttggtataaggtgtcaaaacacaaactaatatggaagggtaaaattttctaggtggtctagttttattttattccatttgagcaaaaatcttcctaaagtattttgtacacaccctgccttcccaaacaatggctactgaatacagtggcccaccttgtctgtgactgctggaggaggtcatcaccatggctcacatctgttattggactttcatgaaacaagtccctcagggccagaagagatgctgtcatctgtttgtcctatgcaatggcctgagcctgcagtcattgtgagttctacccacatgtggctatttaaatgtacgtataaattaattgaaattaaatgacattaaaaattcagattcttagtcagtctagtcacatttcaagtggtcaatagccacatgtggctaatggctactgtgttagcacagatatcaaacatttctgtcactgtagaaagttctcttagtgttagttattttatatgtttctgactccaacattgttttttgtggtactgttgtcagttttcagaccttatttcctctttttgatttgttgtttctcatagctgataggtttaaatgccagatgtagaattttgtgtaaagtaagggtaaccaggctctaagagatcagaagagctttcttgtgttcaagtttttgtacttggaatttttatttctattctgagtgccccaaggcctcttttgcttggttattgttctgcagctgtactgtaggtgtaagggaatcagactgctgagttcctatgggagaagggctatcaaactttaaaggtaaaactgaacattcatggaaatgctttagatccagtcagcagtctcttatttggagcagcacaactccaggggtgcttaatgaccaactggctacatgtacgccaggcactgggttagtcccttgacacacaaacaagaatgaacatggacccaaatggaggaaattacagtttaaggggtagagagagtttcattaagtcaattcccagatatgtcccaggtactctgaaagtccagagaagggcggtacctgatccaggcttccctgatgttacaggagacaagaggccagggaatgctccctaaagaagtgattcttgagtggaatcttgagggatgcataggtactggtcacatgatgaaggtgggaaaaggtgtctgtataggtaggtgtctatacagggaaaagtgtctgtataggtaggcagactttggatgttgaaatgatgggttttcggcagaagtggaaatggggaagaggggttggggatgctgcctggggcagatctgactcttcagtagtttgacttgttcactctggcagctctgtgaaggtaaaaaggagccaggctggaggctggcacaccggtggtatgggagggccagggagtagagacctgtaatagttcaaaagagaggtaatgagggcctgctgtgagagtgtaagggggttgaacagagttcatgatttcaattggtattgatttctaaggagtaaaattatcagtattgggggattgattacatatgggggataaaggagacagaggaatcagagatgactgtgagttttcagaaaaacagattaatttaaactcttcttccaagttcacagtgataggttttgacctgtagctgctactagtgatttgcattggcaactgtggtgtctagattaggttttggcactttaggactccactctcttgtttgttaaaaacaaaacaaaacaaaacaaaaaaaaacttgaatggaagcatagaccataatgaagtaccaccctcgtgtgactttaatttcacagtggcctatgaaaatttatagaaatttggcttcatttctagtggctccaatccggatgccaaaattgccctattgttgcgacatcccttgagtggactatcgaacctgttattcattaggagcagctgcaaaccatcagccaagttcccatactatgccaacaataacgccagtcaaatttcaaggtaactccaggtttcagaaatgtatgaatctcaaaatctgtctagccaaactcttatttgtatttttatgtatgcatattatatgaaaaaagctggtggtttccttagtttccataattatacattgcttcttttagactataaattgagttctcagtgttggtgaaggcatacctatagatcttagccaatcactttaaagtgaaaatagaaattcagtctggatcatggtaccaggggtagccagcccaaagggcccattatgatgaggcctatattgaaagcaaaaattcttgcatacctgtagtgcattttaaaaggattttccaagtaacagttaacatttgttaagctttcagaaaaacttatttctctagtttttaatattaaggaaatatggaaatatatgttgatactttgttttttactgacatacttcatgactgcatggctaaagccacaaaacactaggcacttaccactttctttcttttagatatatttagccactgcatctggcctttgttgccaaatattttttcccttttactctaactactccatcaatttggatctttaatggtcaggcaaattttgaatgatttcttggaagatgtgaaaccctgttccctaatcaggaaaatgtgggcaagtcttatggtatgagaaaagaagggacatctcttctaacaaagacaacaggattatagcgccattacacaacatcttcaaagtttttatttgaaaaataatgatgtgtttggtgatgaacaagtaccgtaaatgggaagcatgggaagtttccactctttaagaatgtttctatgcaaaggaggaaggaaagcttactttttgtggttcttcagagagattacattaaccatttgttgaaagtttcatttatgaacaacattggcttctaagagtattcttcacacactggcatcctttgtatgatgttgttgtaggttgtttagcaacatatcaaaatagttatataaaaagattaatatgtgtttcattaatcctaaggagagctttctgaaattcatttttaaaaataaatgattagcatcattctttgaaatttgtgacttctgagggtgggaaagaattaaaaaagaagctatcttttcaagcagtttgtgatttaataccagctggtcaagtgagttgaaaaaccttatgatttttatgttatattattttgaatgccttttcactctcttgggaagttggctaaccccacagtccttttcccatggtaaatggctctaaaactttgatcttcttataccagtttgccagatgtagcagaaagagcatgtatgtgacctttcctgtgccaattcaacccagctgatgggaaactgtaagttaatcttgcatgacttttatttctaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggtgggggctttggcatctctcattcgatccgtggcctccttctccatctacaggtttgtcacaatgttcatttgaattcctttcaaaaacaagggttttccgtgaaggaaaagtccttatgaagtaaaaacaaaccattcaaatgaaaatacttattgttcatggagtttcccccccaaacacacacacccattccacatttggtcatttgtttgtaatatcttctttggcttttctggattccaagcatcacttgtgcattcctttaaaaagctttaaggcttttcacatccacagtgatcccattacattccttatataactaatatattatgtattttcattggaggaagaactgcgttcatgtctgcatttcatcaaagattcctaatgacttcagagggagccagcctgttttccatgttgctagagaagtggagtaaaaagagagtgggtgacatgatgggggccatctatggtatagtgaagagttagggaattagaggaacttggatacagacttggctctgctcccaaacaactaggtggtcttaggaatgtttcttaaacttctctaggcctcataattttcttctgttaaccaggggtaaagaataataataaatgtacaaaataattttgagattaaatgaggtcaacttgaaaaagatacttaattatctgtaaatgattatctacaaaggtccatataaatatttggtaatattgtttgagagtaacataggacttgtctttttctttgtagttttgattgaggtaatgccaaataactttattggccctcagtcctaggatgaaattcagtattacagtggataaaaagtctaaaaactgagatgtagatgttcagcctagtttaatagctattatggcagtgtcatacgttaaggataaaatatttgagaaacatggggaaaagaagcataactttagtgtgatagcctggcctaagatttttttaaaatgcaaaaataatagcagatagggtttatttgggtctccggattggatttttaatatctattggaaagggaagtttatttattctgcacaattgctatttggaactggagacacagctgcttgaccttaattagcaccctacacccctgaaaataaaaataactggggaacatatgtcagcagctaggaaatccagtcagaggaaagttgtacaaaagtgcagggaaaaggaaagagacattttccttatacagggataagatatcttcccaggggaggaggatggggcatgttaaaactacatgttagaaagttatacgactagttacattgatgtcatagtgctaaaaataatgttctttgcggggtctttagaggtttcaagactagtgaaataatgattgcaccatattcttttggatgattaagcttcccaggagggaagtcctaaaatggctagcttacttcccataatacctccatcaccccttggaataacatattcagcaagctgtggccattcaccatgatttcacggtcatgagacttaaattatggagctggtctgttgctttgtgaaactgggtgattgccagaaacctttatttaagaactactactcataagactaataaattcccaaatgatttaatgcacagtaatttgtcaggattcactggcatttttttttttttttctggcataatgaagacatctggaaacccaagctacaacttaggagtaccagtagaattgtccagcaagggacttcagaatctgttgctagcctctaagactgattataatgtttcactgattttatagccaatccatatttcactggactcttaacttgtataattctattctttcaacatttataaatacataataacattggactttacatagcactttagaatctttcccatgttactttatttgctctgacaacaattcagtggctcatgcagaagggtcattattagccctattttattgatagggaaataaaagttcagacaattagacatattaacatgtttaagttttgcatcctaagaaataaaaacgaaaataaaatgagataaactatgtttgtctacttctagcttattgtttttagaaccaaatttctttgatgagtattctatattcctacctctaattcctcacctttcatttgctcttcagactattatagcctggcttttgccaatactgaaacaggacttgttaaggtcgcaaataactgcctacgtgtcaaatttaatggacatttttcaggccatcatcttacttcacttttatgaagcacttgcctccatcaactgcattttcagtgtttcttctctttggcttccatgacttctttctcatgttttctctctctttcttgcttgctgtcactctcactctcttctctattccttccctatatctctggcttctcactgtgactgtttgacctgtgtatcctcatcatgctcctatgaatgcggttcatacttgtgaagatgtgacttgaaccacaatctacattgtggccatttccaaacccctctctcccatccataccactgccgccagctctaggcctatatattcacctgcctgtggattcttctctgggatgttccatagctatttcagtttcaatttttttcaaaattgacctcatccttcatcttctaagtcacatggtcctttattgcttttttctctttctgtgtccatcatttctaacagacactgagtctcttaggttctgctccttatcagtcatttcaacaattacacacggaacagctccatttcccagcatgactccacattccagcagtcagcaatcactaacacttttcccacgcaccacgtttcctcaaagtgttgtgactttgcatatgctttctcctctgcaaccctccatttcccttctcactgccacacacttatgagtttcttcctctggggatccctccctgatatccacttgtagcccaggtgagttacctcttttttggtatttccacatacatcgttctgtgcatgctctgtatcataatgtcttggaagtattgatagttttggttcgtgctttggtagagtagactaactgttgtaacaaacagcttcaaatctcagtcacttcacacaataggagtcttttgcatgttcacataatggtttcaagggggtggtcagaatgtggccttctgctcctttccatctgtggctctatcatttttgagatctgagttctctgcagagtcttctgcattcatctgacgcataaggggatagagagagaaagtcgataacctagagggagattttccatggttatccatatctaggcctggatatggcacacctcacttctgctgacattctattgggcagaatgctattacatggaggctaggaaatttggcctatctttatgtccagggtgaaaggaaagtgaatttggtgaaatactgcccagtctgccccaattgcctgtctccacactagactctaagttccagaaagacattgattacgtgtattttttaacctctggattcctatcatctagtataatgtttgaaacatggtaataacttaggaaatgtctacggaaggaatgaatttgtctgaggatgtagagtaaatcatggcagggctctcgtaacaaaccagctgacccggttcctggtgctctttgtccgaactatgtaacccatgtatagtaagtttgaaacaacttgaacttttagggtactttgctctgcatttggaggaaaatattcagatgcccaatatgccagattatacattttttctgccactacacttatgaacaaagatgttttgagttgctgattaaggaaaatagctcccttctctctgaaaagcatttcacctctatgggagtgggtgatactggatttcatctaaaaatattatagaggtcagcaacactagagaacattatattatatatatatatatatattatgatttgttgctgttggattcaaaatttgagaatcccctggagggtagtttgatttgaccagtttgattggacactttgtggtgtaatcatcaatatcatcagccattttgggtctgcagtggtcacacagttgcatgacagatgtcctgaaaaaatgtccattgcttgttgtcagcatcgtctccaggttcattattgttattctctgtgttgccattattagtgttcttgggctcaactttacttctaggagatattccctttattaatgcttttctaatgacacttctttccatcaccattatcaactgagacccccccattagagcttttttagtttttctgatggtaaaatacctttctttgcttttgtcctgggaaatatgttttaagaataaatgcaattaattagagatttaagtcccacagaggaaagcttctctatggaacaatttgtcttgcattatttctctaatttatcatattgtttagtacatatttcttgagagcttcctagttgctcagaaatttccgagtactaggattactaaggtgaattccatgtgttttttgtcctcaagaaatatttttatgtagccaaaagagaagggggtaagaacatgtaagtgattagtgttatttattttatatttagtgctaagtgaatgattgggggaaagggataaagaaaggaaattactatttattaagcaccaactttgtactattctaaagggttaaagagtttgtctcaattaattctttatgtaacccaatagaagtagatactgtattggtatctcttttactgaaggagagacaggttcagaatgattaatggcttatcatgctacacatctaatgaaagaactaggattcaaactcagtctctggctctaacttccatgctgttagattgtaccaagcaacctggagagctaatgctataggaatctagaggagataacagaaatctgattggggttggttgcactgacaatgtggatttggggtgtgttcaataaaaaggcagaattgaccaagagaaaggaggtggaaagactctctgtaaatatcaaagcaaggtgggactgcatgatatatttgggtaaaacacaagcagatcagtttagctggagccaggcctcctagggggtcagagaaatgcaattctggggtgagaggaagagaccaggcttgaagaattcagggtagcagattaggcagttttaagtctaatgtggaggaaatggagaaccatggaatgtgttaaagatatggggtgaattttacagcagtggttcttgaagtgtggtccctggaatagcaacatcaacctatctaggagcttattgatgtgcaaattattaggccccacctaatacccgttgtatcagaaaagctaagggtggggtccagcaatctggtttaacaagccctccaggtgattctgatacacattaaagtttaagaactactgttttagaaagatcaatttggccattgtgcatagcatgcattagacagggaaggacaggttactcctctaataatgcagatatgaagtaatgagggcatagatgatggcaattggaatggaaagaaatcagcaggaggcatagtatgagaacattagaacttggggattgattgtattcaaagggggaaggagtaggggtccaagttgataggcaaggattaaaatctatgggatgaatctgtatttagttcagcccaaaatttaaaaatcttaagtttcaaataacaataaggatttgtggttttagagaaaaaccagatttggtgatatatcttgtatgttccattgggcaaacttcagctgagcagattagccatcaaattcttcttgttgatgggatgtcccccctcttatctgccaagttttcccctctttttttatatactttattcatttatgttgcctattcgagtcctgtagatatttgagctgatgatccctgctctaaggatcccagcttggggacaggagaataagaaatgtaggggtcgggagagggagctggcttggagggaaaccagccagtttggtttctagacattttgagtccgaggcaactgtaagatagtcccattaatctggtctttatattttgcaagaaaaacagttcagcatttccatttctctgttgtccgctttttagatcacccaaggcagtttaaaattctaggctggctttcttgcaataccttgggacttctgcctcctgctttcttagcatgcgagctcaagaatgcaaagtaatttttatattagcccatgtaaaatataattcaaaaggtaactctactgaggccaaactgtttgttgtattcccactgccacacatacattttttcctagttattttctccattgccccagatagttgaacagggactgcgacttttaatcagctaaggaagcaaaagactttctcttcactttactgtgaaaattgcatcaccacactgggtatgaactcattgaggtgggaatgagttgttgatagggcttggctttggaaatactactggctgatgttttatatcacttggcctttgtgtactgtattgacagagtatagtgaagaggaggaggaagaggagcaatttagtttgaagatgactaagagctgattaaacattcagctggggagagagatgagtgaatccaggtgatgtttatggagtgtcagagagggagaatgctataccatctggtgagagagacatgaaaaagtacataaatcaatctctataatgatacttaattaatacagagttgataaatgacataattgaagcaatgggtgggctacatcatagagttaaatagcttcaaagagggtgctgattaaagccattacaatttataaaacattcttcatgttaagaaagcatcttgatgagatttcacatgaacattttgtaatcagagggccagcttaaaacactcagagcagaggtgaaatgtcttaagaggtctattttggatgatttttgaaaaccagttattctcagggaataaaaaagcttgctttccccactccctttgttttttaatgggaaaaaaattaatgttgcattcttcacctttagacaatctcagatttttgatgtcctggtggtttggttcttaagcatgaccttaagataattagctatcaagcttcatttaaattgttttgaaatatcattgcaatttggggagcatatgtgcctgctggtgaaaaataaggaaaataccactgggactcaaaaactgtacaagtgactcacctcgattagtaggcttattttgtttttgcttaactcactctgaagctcataacagatgcacagtaatcaagcagaatgccaattctcatcattcatgcaggtggggccactgtgctcccaagggggaaccagagaagacccacaacaaacactgcgttttttcttctcatcatcctttcttttccccctttctgatttttggaaggtacattctttgtttggaaagcctttgttagaaattccaaaatgttctttaatcactggattcttattattgtatcaggtagtgtgacaggcatgcttcctcataatggatagagccaggcaatgtattttggagcccgcattctggagactccatgcctgtgtctttgttcagccacttgccagatgtgcctcattggtgcctcagtttcatctgtaaaatgggggaaatatcttctttgtttttcttcctggagttttgagggttttctttttttgtttcattttgtttttgtttttctgaggcagagttttgctcttgttgcccaggctgcagtgcaaatggcatgagttcggctaactgctacctccgcctcccgggttcaagcgattctccggtctcagcctcctgagtggctgggattacaggcacccgccaccacgtccagctaattttttgtatttttggtagagatggagagtcaccatgttggccaggctggtcttgaactctcgacctcaggtgatctgcccgccttggctcccaaagtactgagattacaggtgtgagccactgagcctggccttttgtggggtttaaaagcagtaatgttattaatgcctgacctatagtaagttttaagtacatgtaaagttgctactattatacagtcttattaactattgactggacatagttattgaatgaaaaggaggaagggagggaagcaggtaatcagggagggattgagggaaggaagaaagagaagaaaggaaagaaagaagaaggaaggaaggaagaagaaagaagagcttgatttagttaatgtcactgttgtaattggtggattataattgaagctgtctggttgggagacaaaccctatgccatttagatctctgtctgttcagtttgtccaaactctgctggggttatgtatttactagtctgtctccctttttggattggcaattctgcagacagactgtgtgtcttactcatctgggtatcgccagggctgtgctctatacctggcacacagtagtgctggaataaataaagagctggaagcagcacatccctttctctaacatgtaaattcaaggtgtcaccatttcacattcatagacattgaataataatgtagatgaggtgactaaccttttgaattgctactcatcaaaaatggaatctctggaatctgagaggagactatatagttatgtaaatttcggcaaagtattgcaaactccatattactatggtgctttgtggggctgctataattaatggtctgtttgcatttctagtacaggctgtcatttttcatctgcttataaccttgatataaacatttattcttggctgctattttgcattcataattgtaaaatatatataaacgttaaccttctgtttttcagcttttttatttatcaaaagcacagctcaagaatcacatcattgtggcatgtttttctgaatctctagtggcaaaaagaaatgaatgcattttgaattcaggcttcaggattaaggcaatgttgtttgcttatgcagtgccctttgaaaaatgtgtaatgtagcatatgaaccaaaagaatcctgagaaactttttccagccggtctttttctattacttatgccttttttatccctctgtgttcctccccacctctgtcatcagttcaagatgactcttaaagtcctcttgcatccatccaaatgacccattggcctctttaggtgcctggagaaagtaccagcaaaggtatttgttggagtctatcaaaggtaacaatacatagagtgggtttcaaaatcagacaggctgggttctattgttggctctcccatttagatgctgtgtgaccttatgtacattaaacaaccagtgtgagcctgttttctcatctgtaacatgtggagaacaatgtttacctcatagagttgttgagagaattaaatgaaatcaagcccttgacacagactgaaacatgggaagtgattgatgaaatataactgacgtcttatcttggccatggtcattattatcactgtcatcattagatagtgatgggactaagctaggtaggttgacatgagctgacttatcttaaaaggcaccagctctagatagagccctcctcagtgttcaaagactcaaaagacttgggttctgtttatctcccgatttcgggagcccactctccttagtctccctcagtcattgactaaaaactatgcacttgtcttttccattctctctatcctcatgttaaatgcttgatattgttcttgcaagctgtaccaaagttgtggtggcccaaatcagtatcagtggccagcttacccaaaatgcagcaaatattctatttcaaacaatacccaagatattttccacctcagggcctttgcactcactgtcccctttgtctggaatgctgtttccctgctttgtgtatggttggctctgtttcaatctttacattttaactgaaaggttctttttgtgaaaagcctttcctgactatactaagtagagtagcactctccctcaaactctctcacacataatctcctctgtatgcacagaatcctaattatatttggtaatttatgtctatctacctacctacctatctagttttcagcatgtacttctgcataaaaatataaattgcatgaggactggaactgtgtctttcgtgtacctcattgtattctcagtacctaggagattgctggcacagggcaggtacttaagagatattgattgaataaataactattttaaaaatcatctaagacaatagagaaccaattaaacagatacatactgtattatagctatttttctgaagccacattctaaagcaccacagatttttttctcaattttttgttttgttttgttttgagacagggtcttgctctgttgcccaggctggagtacagtggcatgatcatggctcactgcatccttcaccccctgggaccacagacacaaggcacaatgcctgtctattttttaaaaaaaattttagtagagatttttgtggaaaaatataaatctatagtaaggctgaaagaatagtaaatgactcatttactcttctgagatcagacaagatctcagtgtggtatggccatagatgtgactcatatactctttataagaaattgcctaactttttatttttatttttattttttgagacggagtttcactcttgttgcctaggcaggagtaaatggcgcgatctcggctcactgcaacctccgcctcctggattcaagcgattctcctgctttagcctcctgagtagctgggattacagtcatgcaccaccacacctggctattttgtatttttagtagagatagggtttctccatgttggtcaggctggtctcgaactcctgacctcaagtgatccacccacctcagcttcccaaaatgctgggattgcaggcatgagccacggcgcccagcctcctaactttttttaaggaagttgtaccattttatattttcggcagtcatgtgtgacacttcaggctgctccacattcttgccaaaatttaattttagcctttttggcagatatgtattggtatatcactgaagttttgatttacatctccctgatttctgaatccctctttgtgaaaagtctactccaggcttttgcccatctataatttttttaaaaattactgagtggtaggagttctttatataatttagatacagatccgtagtcagatatatgttttgcaaatattttctcccagctgatgtctttcccatcttttgtgtcatagagtcttttcttaatagtgccttttgatgagtagaagttttaaattttgaagtctaatttatccacttttagttgctttcttttatatgcatctacattcattactcaatattttgccacatttgctttctctctctctctctctgtttctggatcatttgaaagtaaggttgttataacactgaaaacatttcacccataaatatataagcatgtattcataagagcaaggaccacctctaacataactgtaatatctttgtcatgcctaagaaatttagcattgctatagaaatattatttaatttaaaattcatccatattcagattttcccaattgtttcccccagtaatgttgttgatcttttctttctgaattccataatccaatcaaggacatacattacatttagttgtcataaagctttagtctccttatatctaaaattgctccctagtctttttagtattttatgacactaacattttcaaagaatataagggagttattttgcacaatgactctcagtttggagttgttcctcattattagattcacgttaaatatatttggcaagggttctatatggataatgtcatgcccctcattgcatcacataaggaaacaaataatgtcacttttccttattggtgagaccaaatttgatcacttgtctaaggcattatctctggatttctttatcgaaaggtagcattccacctttgtagaggaaatacattgcaattattgtgggatgctcttgagactttgtgaatcttaagttctttaacaaaatttcacccagtgagattttaacatccgttgatgacccctgcctgaatcaatcattgtactggaagttgcaaatgtttttctaattcaattatttctattacaattatttgctgtgtgcttttgtaataaagagcatctgcctccttttccttctttttgtttctgatgatcacttcatgggtttttaaaaaatgtatgtgataaaattcattactatcatcattctttttgataaagcatcaaaaatttcaaaataattaatgtaaaagttagcattacatgataagcttgaatatttgaagcactggaaggaatactctttttattcatccaaagttacccagactaccacagataagtcaactaattaggagtgtgtaatcaatatcatttcctctgaactttttattaacagcatgagctttggggtaataatcctgaagttatttttagtttacaattgccaatgtatagaatatgcaaataaagatccttcatcccatacataattgctgttaattgttaaaataagtgagcaaaatctcaggtccagcaattgcttctgagtttctgcagactgatatttgttttccttttttttttttttttttaaactatgcagctctgatgttgaggagtatgaaaagagcttttttttttttttttttttgcaagagaaataaggatctcaatataggtttgcagaggccagcagggatgtatctttaggatgggtttacctcatatctgtgtaatacagagaactataaattatccacccactccaacctccccatgtcatcagtggttgtgaaggggtaactagcctctgcctgggtgtcaacagtaatagtttaatagctcagtgaatgtctgttgcctcactggttactgctccgtagagtaaatatttgacatcaaggacaagaatttaatttttaactttctcaacttaattttattcagtaaacatttattatgtgtcttctatatttcaagccaggagaagacccaatttttgtaggggtaggaacttacataatttgggggcctctttaagaaaaacaatacaaagttacttctacacatttagatataaaatcaacatttatttacaatagggaagaaattataacaatttatgaatttaagagagccaccaaatactacaaacgtgacacaattcagaaaaatatcttgttttgattaaataactacctatcaagctgctgtactttgtctgcattttttatttgcacattctttgattgctctttgtatgacagtgcttttgtgttgtagtttctaaaacaagaataaaaaaggaattcagtctttcctgtagtatggttgatcataatttagcttttattattgatagtttggaaaagtttatttcagctttatagcttttttattggtagtatcattatacaattttaggattgttgtcaaatttgggaaaatgttatcaagttttgttcatgtatgggctgtaagatttcaggacattttatgtttttgtatagtgacaatgaatgaacatcattccatttagtttgctgtctagatcctcgtttttagtggcattttatgaatttttgttatgtttgtatttgtcagcattttgtgtcaaaccaacaagaaatttcaatcttttctcaaggtgatgtactttttcattatttggcttattgagtgatctgtgagactactcatcccaaatacccaaagtatgtctctttctgtcaataaactgtagttttgtatggcttttgtctgggaatgccatactttgtcagaataagatgtggtgtatattttaacatgtaatccaatatgttaacacaaataaaactgtgacttcatacatagatgcatttgctctttgagctctacaatcacaggaattctgataaattctattttgcatgacttccttaaaaatataaaattagaggttgtgttcgcaatagcatactctgaattactgaacctattcttgataggagagaacttccattttaagtaggaattaatgaggattggatacctcgactgcagttctgcatatctgataactggaagcattttccagtgactggcttctggatctccaccactgtctccatgctttcactgccagatgttgcaggatgcattcttgttacaatatgacctctgaccctgtgtctttgtattatgacactagtagtcccgggacacattcctgtaccaagatggaaacaactgtgaatcacctaagcacatccctgtaaacccaagccaatatatctccaggtcagcttctcctagctggatcctcaatgcctatagtcaatccagtgctgctccatatgttgggaagtatgacagaaaggaagtcagagtggattaaaagattccacacctttggtgtgcatggattggtgcagcccttctagtgagacatccccagatgttagctgataacatcctcaccctcatcctccccaccatcacttctctatgttttactggcctgatccagtttttggtggcttggcacttggaattctttacaagcactttctttctatattgacttactatcatttttagaacccagattttttaaatgttcaagctggatgaacccttatacatttgctctactctttcattttataaatgaggagcttggggctgaaggtcattcagctaagtagaagaacaaggacacattattttttagctctttatgccatctttcttttctttcaagtctccatcagactacacccagccttccaggattaaagtaagttaattaggcatgcattgatttgatctccgtaggtcccccctaaattgatatttttaggagttagaatattcaatgtgctccccaaatgctacgtaatagtggttttttgctcattttgatagggcttttagcagagtgaactgtttcgtggacactgtcacaggaagtggaaactcaccttgtgaaaaggtaagctttccatgggctttgagttttcctttcctcagcaggggaagggcctatatgtgttagtgttagctgcctggccttcctctggggcttggtttttaatctccagggaggcaaggctgacaaaatgtcatctatttgcctactaaggaaagaagctgtgaaatagatctccattgcttatgcacctcaagtcgcttagttccagctgtatccataatatcatggtgtatttaaaatactgctcattgcaatccttttgaaaagagattctgatgctcgtaaatactccaaaaaggcattaaggtgttacactgatttttatttttattttattttattttattttatttatttatttatttatttatttatttatttatttattgagatgcagttttgctcttgttgcccaggctagagtgcagcagtgagatcttggctcaccacaacctctgtctccagggttcaagcgattctcctgcctcaacctccctagtagctgggattacaggcatgtgccaccacacctggctaattttatatttttagtagagacagggttgctccaagttggtcaggctggtctggaactcctgacctcaggtcatccactcagcctcccaaagtgctgggattacaggcatgagccactgcacctggccgctttttatctttaattggatttattccctttagaaaacttaagtttgtggattcatatccaaatattgccctttactgatctagctttttctgctgtaagttctaggaaccttttaattcagagaggggtaaagaaaagagctagcatacactcaatagcttttatgttttggatgcttcataaatatcacctcatttggacccttacaagagctttgggaggcagggagctttagacacattttacacctgagtaacttgatcaggacattttgaaaaaaaggtttttgattatctgtttttcaacttgagagagtcgtgagataactaaactacaaatgaaaaatacgtaggtaagtctctttgtaaggtcatattcgtaaaggttgcaaaagagaccaaacaatgtattccaattgagaagtccaggtagagtatttggttcatttgtgctgctataacagaataccatagactgggtaatttataaagaatagatctttatttctcacagttctggatcctgggaggtcaaaaaacaaggcactggcagcttctgttgtctggcaagggctgttctctgcttccaagatggcaccttatttcttcatcctccagaggggaggaacgctgtgtcctcacatgtggaagaacagagggacaagtgaaccaaatctttgtgtgaaacctcttttataaaagccttaatcccatttatgaggggaggagccctcttaaaggccccaccacttaatatcatcacattggccattataagtgtcaacacctgtattttggaggggacactttcaaaccatagaataaagaaaacgaaagggggaaaactgcaaacaaatgtgctatgagattagatggatttgaaggggactcgacagtcttgggccctttgttttggaagatggattttgaaagttatcttttattgtattcctgtgaggcccatttgtttcctacccttttctcttgtccccctcttccttctctttattcagtatcttcctctggcaaatagcagttactaaatttggttctctgttatcttccaactcgaaaggcaaaaggcacaggcagtaccctcctggtaattatttatgatatttctccttccagagatttgccctatggcagcttcaatccgttaccatcactttttatttttttgcccatattggcagcttcccaagactttgggaggaaaaagcagatctgcagatacgcaaacctcaaaatcaagacttggttaatgaaatcactcctccacttgcccttgcctgttactgaatcctgttccagctgggatggaaaaagtgcattggtcatgctgtcaaaagcatatcacatttctccactgctatttccttccttcttaactaaaaacaaaacaaaacaccatagacaacaaatagacacacacacaaaaaaaaagacactaggtgagagtgaaggtagtttgtactattttcatttttcgtgtgttcaatcgtatttctctcagcaaatatgattggaagtggtgcttttccttccttccccaccttccagcattaggtttgtaggtgaacataaaaatacactgacactcaaagaaagagctctttctgctctgcacacatcccatctcgccctcttccttgctcctgcttatttctctctctttctgcctccttacctccttcagtttagagcttagagaagtttttcactcttcttttgacaggtgtcagatagacagtatgagctcatttaagctgaactgtctgggggaaactaaatttgttcaggagaatagcaatttggatgacaagtgccaggacataccagatggcacggctggagaaattcttatcgggctcccagctcacgttccaggcggcctctctgtctctctcctctattcttatttgttcatggttgacccagatggaaacttgaaatgcaaatgtatttcttcttggaagtttccaagtaaaaaaggtgatagtgactcagcataagatgcttacatgcccccaaaagaatagccagtacttgttatttatgcttattactactgatgcttcccagacccctgtgggcacatatttgaagaagtcttaattgtgagccctaaactgattgtgtaattccagttgtttactaaaataggactgttacctaagctgcaaaatatttgatgttcttgtcaggatgtgaatggaagtgttcttaaacattcttcctcagttgccacacagtttgactgattttgttggccctcactttccagaaagggaaccgtggacataaatgtcatgggaaggtatttagtagaaggtgtgatttttgggggcgcatatgaaacattctaaaattcaaggccagggcgctgtgacaggctctaatctatgaatcattatattcttaacatattctgagaacaggaagagaaagctcaacctttatagacacagatggaatttctcctgtgaagactggtaattcatgtgacatttgctgtttgcttttgtttgcagtcaaattctttctctcaaccttgcactgtgctgttactggtcacttaacagaccttctgaaagagcaatataagtttatattttaggtacacaaacaaagcagatgtttataatactgggcatgattttttttttttttggtcaatatttggttcacatgagaagatcaactttttctagcctgtatactttggctctgaatttacgtgttttgaaaggtttgttgttgttgataatttagtgatgaaacttactcgtggaaaaggcttattgtgagtgaataaataaatagtataggctaaagtgtgtgtagcctacattatttggtagtgtagtgtacactccacatacttttatcattttaattttctactaaattatgcatgtcctggtattaggattcccatagtcatggcaaaaccaatgatggtaacgccatacttatctggaggttaaagtttcattaacaatttaaggtggaaatcagagaagaaggcctctgagccagcctaatagctattctaaccccacacagcaaggtagtatattgtattgctgctcttctcaccaagagcttctgggcctttagcacattatttttaacatgtttaaatttctgggttttgtggacacatcacattagcagatgtgggaatgatagaggttattttgacatacagagaggagacaagaaaacggaagtgtaaccacaaagctgggttgccacatcctatggaggtgtaaattcataaggataacattgagtcacccagaaaagttgtattgtgtcttccttttaagaaacaatgtgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagcagggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaaaaaatgtggtggaactaaaagcccagtaaaagtgtaacatgaaaggaaaggctatgttatattcatccaatagggtgtgtgtttgtgtatgtgaatatgaagaaatttatcataaagaattggttcatatgattacagaggctgacaagtcccaaaatcttcagggtgagtcagcaagctggagacccaagtgagctaatgctttagttacagtctgagtttgaagcctgagacaggagaactgattgtgtaattccaatcctaaagctagcagactggagaccaaggaagagttgacgttttacttcaaatgcaaaggcaggaaacattcttcctcaattgccacacagtctgactgattttgctggctctcactttccagaaagggaaccatggccataaatgtcatgggaaggtatttagtggaaaatgcaatttttggggtccatataaaacattctgaaattcaaggcttgatatcccagtttgagggcagcagggcaggaggaattctctcttccttggggagggtcagcctttttgttctatttgggctttcagctgcttgaatagggtccactcacattgggaaaggcaatgtgctttgctcagtttacaagtttaaatgataatctcttccaaaaatgccctcacagaaacatccagaataaagtttgaccaaatatatgagcaccctgtggcccagtcaagttgatacataacaatcacagccatccttccagttagtcacagaaagataccttcctgcatctagacaacaggcagctgctgaggagggctgggaacagcagttcatgatctggtatcagatcatgaacccaggggtccagcacaaagacgtagatccagccctgataggagaatgcctggtttttagaaatagggggattagcttccaaactatagaaagaattcattcatccattcattcattcattttaaaattcaggtcttaattcaaatatcacttccccagggaggcctttctgatacattgtctacagaagtcctttcagccgctctcatttattcattcacgaaaatgtatcaggcctaccctgtgaaaggcactgggaatccaatagtgactgtgaataacaagcaaggtcccttccctcacgcatcttacttactagtggggacagacagaaactaagtaagcaaataaagaaggtaatttcagatagtgataaatgccataaaagataaaatagggtaatgcattagagtgttgatttgaggacagggggaagttacactagatacacccgttagggaagacttctccagaagagcagtcagcttggattgaaggatgaaaagtaaaagctccattcagagctcttggggaagagcctcttaggcaaaaaacagctggtgcaacagatcaacggacagaaccatttggccagttctgggactgaaagaaagccagtgtgactggaatacactgagcaagggagagaaaggtcagagaggtgagcagagaggttggcagggcaagatcttcatggaaggtcatataggccctgattcagagcttgcattttatcctgattggaaataagttttaagcagaggagtgatatgatctaatctgtgctttgggaagatcactgcccagcgggacacagattgtgtggagcaggaatgttgtaagaagtacagacatgtaggaggctattccaatagtccaggtgagaaattacgatagctgggctagggtggtagctgtggagacagtgggcagtgggcaagcttggctgttctgtgaaaaagtcttcaggaattgctgatggtttggatataaggggtgagaaaaataaaggactcaagagtgactgctaggttttattttcttaatggcacatatttttatttgaaattatcttgtttatttgtgtacttctttactgttgatctccctcatcaggctgtaggtacagtgagagaaggaatcttgcttatcgtgttcactgcctcagcctcagtatccagaagagcacctgttccttgaatgtatgtgtatataaatattgattgagtacttagtatggaccaggcctgtactaaggctgagatacagaggagaacaagacagagatgacccatacgatcatggaggctgcattctggcagaggagatagacaataaacacatgaactgagttgtttcaggttttcataaatgctgtgttgacaaaaggatgaagagagtggttaaggaaaaacctcttctctagtggttctgttattctacatgtattcactagactctaacatctgtgaaagcaaggactaggtcttatattcttcgtgtagtgctaagaagatagtatgtgcccaggaaataaaagtgggcttgtcaagcctggaagccatgctcagttcctggagcatcctcagtacctgttttgttatctatgtgatgtgacctgctagggaaattgtccgagtctctcctttcttgtgtaggttgacaatgcctagacccatcagtctctgcctggacaggcctgtaatttaactgcctgcctggctctgattgctaataggcatgggtagccacctatggatttgcacagccacacacggccttgctgcaaatttagcagcagatagtgcctcaaggtcactagagaagaaatgaatctgtaaggtgaataaactaaggccaataagcatagagtgccagaaagtagtgcccagagggatccgaggggcatctgcatgtttattaataaacaaacacacaaaaacccccgcctcctcctctacttaaggaacacagtgagatctcctcttatgaagtcatttctcccatgacttctgctttgaacagaagattttcaaaagagctttgtttgcccttaagcagtcttatcctcagataaggataaacgatcagaggaaaatttcactgggttgttggtcagctatcaaaatgaaaaatgaaaaatctttcttaactggagtaagtgtggaatgcttgaatagtgcagcagcttttagtcattcttttacaactgctgtacacattgcagccagaaaagacattttagttgtcaggtagtcaataaatatttattacctgcttcctgtatactggttctccactgggaactgttcctaaaggtttgttttcttgttacttttcttgtccctgtgttcctcataactcaaaactgctgacccatttaggaggtatgggaaagcaagattgatcagaaagcagactgggaagagacaagtcatgataattcttatgctgtcaaaaactgagtttagcatcatgctaagcaggcagtattcaattcataattcaaaactgagtgtcgcagtgaatggggccctgcaaagtcaatgtctgattgttttcttgctgataagcaccatgatcagaggtctcttcactttggcttaaatcataaacatgtttggagcacctaccatgtatggccactctcctaagagtgaggtaggatattgaggtactcccagtgtagtgtctggcttctggggactcagtgttaaatgagtgtggagaagatgtgtatatgaagactgtgtcttaagggagaatgtactaagggaaatatgaagtctggtaggtacacaggagaaggagatattaatacttcctggggggaatccaggccttactagagatccttctgcacactgtcccccagctcctcactttgagtgtttcttttggattattcattttctctatcttgtggcaggcctcatcaagactggtatgtgcatctgtgtttgcttttatcagataatcttctacctactttgagtttaccttctatttctaattccttgcttaacttctgggttccttgcacagcagcgtctgatatcctgcatgttagttctttgttttccctacccaactgaaaattactaatgcaaaattatattagcaaaatgggcataaccagaatcaccactgctggggtagttaatgagcagaggtctcccatttgcttcctgcccaccagtctctctcctgccctttcaaggcagacgggttgctggctcactaatttcccacatattgcaatcttttcctgtgatgcagaaagctatgtgtatttccccactcctgaggtgactgaactgtttaagtagttttgataattcgttgctttaaaaaatacacaaagatttgaataatatagataaatgttttccttgactacccacaccaccctattgaggtcagtattcttagatataacgaacaatgtgagtttgatctatattcttccagactttgttcccatgcactgacatatgtatatgtgtgtgtgtatgtgtgtttgtgtagttttgtgcttttttctaacaactcagctgccaaatgatcagtgcatatagcactacttcattgtttttattctcttgagtgtcattcatgtatttctaactctttgtatgcctaatatttttttgtttgaatgccaggcattgttttaaaaagctattgatgctccataggtttacctttcctctactaggcagatcaggttgaaagactgattgccttaatccaacaactgactaagttgcatcagaacaggttgcaattttgttaaattactttttgttctccctatttcagaagcatggccctccagggcttttgattgtaattctttgtctcctcagcactaagagactgcagaatatcttgtctgcttttgagagatttgggcttagctctttagtcttctgtactgtgcagcttctgaacatgacaaataacttgacagggagaccaactctgtgttcaagtctcctcaaatcttcaatttaaccactgaagccgtacatggtttccagaggatctgctggtttctttgtcccagcagcttccctctgcctgaacctaccctagattccattctctagaatgagccagcttagggtggcaagtgtccctgaagttggctgcatgtcctcagatcacctctgaaatctttcctttctataattttactgttgttagaacttttggcttcattaactttctaatgtccttaaatatgtgatttttataatttatttaacttttctagttgtttttagtgggcatgttggcctgccatgaacaacttcattatacttagaagtagaacttctccctcattgcttttaactccttcagattctttcattgcatgatgtctgtggcttatttggccatttccctgttgatagacatgctgatttttatttgtcactgttacagtcttataatttaaaatgaagtacatacattttgtgtacttatttatagcaattactaatatctggaatttctggatttaaaatatggatttttaattttaatagagattaccaaattgttctccaaaaagacttaaatttaaatctcaggggctgaggcttccctttaaataaaccaggtctatctctgatcttataggttggccctagtaccaaacagttctactagtaacattgagagttctatgaactcttttagagactctgagcacactgaaagcttacctgctgtgttgtccttgccactcttacctcagtgctctcctgtgggtacatttagtacctttacaacgtgtgcagtgatcatgccatggattacaagagtttaacacattttctaagacaccaagtgagtaatgtagatactgaggagatattcagtagaaaaagccaaatcactaataatagcatattttcaatatacaggcaatttctcagttgaaaagcttagctattattgctatggccatggcttcaaagctgtgaggttcgctttttatttatattggcaattttcccatgtgcttataaaaatcagtcctttggatggttcactcagtgtatttgaataccttttccaattctctgaagctccttgatccagtaacagtttctttccttggcagaccatgaggagtgggaaagtagctttttctaagtaggcattgattggcattgagcagtgggaaagattggagctggtgaacatggggtgtgcaaatgtattcagccaacaggagctcttccagttcatagggtggatctgctggaatagttgccttggttctcctttcacttcagggtggaattaagctcctggctcaatagggaggaagcaggataagtcttagcctctggacacttaacctaaaattctaaagaaaaattccttattccttttttccttttcaatggcttacctttaaacagcattaatatcctgcctgttgtactgaagcaagaaactgtagtatctattttcaaaactagtacatggattttcaatgtgagtgtcttggtaataaatgctggtttattttgaatttaaaaatgtattttgattttgtactgacagtttaactctttgaaatataacggaggaagggtcagaaataaagcaatctttctttcttctggacttatttattcactcttctttaaacagttgttaaatctctcttatgcatttgacattgggctttgcactagtgatagaaaaatgaataagactgtgacatcttttggtactacatcatataaattgtctagattgtacttctaagccagcatgagcattttagaatataagaaatagaaaccaaaccaagaaactctagttcggagcaaaattatatgcccagttgtctaagaaagggctttgctttttaccagtaatttagaattttatgactaagacaaagcagaaaattgggaagaacagtgaaaagggcaagaagttaatggagtgcggtcagagctgagaggacaaaatctaaatgaaagggggaaaagcaataaggattgaggaaggttgtttaggtcattaagcttacaagatcttctatttcccaattagtacattctgaccctgaagacgtttaagtacatgacgaggatgtcactggagtgtgacaaattcttcacattctcacttccctttgctaattctggcgtcagaagttattgcagagaacatagtcaaccgtctgtggagatacatctaaaacagatgtgcctattgttaaacaaacatggtatgtttaaatccatatttatttattaaacaaaaattagataattactccgattatctggtacccacagggatcatacaaatgacaaacacaaagggccagcactctgagaatgagaagcctagagagaggccaggctgggatagtgccaaccctgacataagatagaatataattaggactttaaaggaaatacaaacaaatattgtgggcactcaggaagaaaagcacttttggtggttgtggatacaggtagagggagaaagcacaaacaactcagagaaactttcttgaaggagatagtatgctaactggccatggaaaattgtttgaatatcaacaagtgatgggatctcaacagggataaaggatacaggtgtcataggtaaggtagtggcataagcaaagccatgaaggaggacagcttgtttgatgactagcagtgtgtgttataggagatggggtggaggatgcagagaaacaatgtattttgagaccacacaactatgcctttaaatcccagcccttccgcttatgcatacgggaccatgcctaggttgcttaacctttctaaatctcagattactcatctttaatatggggacaataatattgatttttgcatttgtgtgtgtgtgtgtgtgtgtgtgtgtgtgtgtgtgtctgggagagagagaaaggagagagagaggagagaaagactggttataatctatgtaaaccttctggtgctcaataaatggtagtaattattatggcaagtagttaggctatctcaattttggacaatgtgttagataaaataaaaaaaataatttgtgatcaaattttgggtgatcttaaggagctagtttaggaatatggagttactttgataggcattggaaagccattgaagacttttgaccagggaatgatgtgattagggcttagaattgcagtgctgattctagatatattgtagagctacgacataaaggattagacaattagatatgaaccatggtgtcagacacctacatatctgttctttactctcttgcagttataaaaaccctgatttttagctggaaacatgactgtctaaaatgaagaccctatttacctgttttgcttgtggctaagtgtgcctatgtgacgatgttctggccagaagtatcatgcagtagcatacctaaaagatggctggcccaccttcttctttatcacttcctccatcctgcttcttagattacctgccatcttggtctaggtccagctgctaatttggaccctagcaatattggagggatgaactggcaggagactgagtcccaaagaacttcatggaacagaattctgccataccatcccttgactaaatttcactagccttctacatgagaaaagaatgaactaccttgttgaagcctctgagattttgagattctgttacatgcagttgatcttacaatctgattctaaccaattcagatatggaggaaataaatgaataagaacttagtttctaggatttcaagccagtagccattataggaatataaggaaacatgtttggagcagggggaggatgatggttttggtttgggattcaatccaggtggagatgtcaggtaattggaaacaaatgtcaggagcttggaagagaggccagagttggaggtttagacttggggtgggaagcaggactttaaatagctctgatagttgaatgtatgataggggaagacattttcaagggataaaagtataaaaagagtgcaaaaacctgaaggctgaccctggactaagtgtctgcttatacaggtgaggaggcaatagagatagtgaaattgggcaggaagaggtgtggtgaaggtgagggtaaagggaagaagagttgaggctgaattaatgagcttatttcttttgcatatggcatgtaggagaggaaaaggattcctaggtttctcatagtcaagaatgtactgattatatgcatttgcttcattaatgaatacagtgctattttgtttagtgtttcaggaaatgctttgattccagcattgttttccgcttttaatgcttggaaacagctttgctaggctcttctcaggtgagtagctgcacgccaaagtgtctcagtgacagcattgctaaggagttttatggagaatggatggtcttgactggaaagtcacttaatggcttttaaagttgtgagcagatgatcatactgtataagtgacagactgtgaagtctgagacctcatgaatggttttgatgttggcatcagataaaattactaacaaattagatctgacatattttaatggtatgtataattattattggtctttgtgattataggctacatagtaactgctatcactggtaatagccagtattacttttgtctggacacacaccagacatttacggaaatagctggaagaagaatgatattgagaattgagggagagggtggtttgtgccaaaaggaaggtttggaagaggtggacactattcctctctcacttcctaactggcttattctggagttggaggcctgcagtgcctcaccctgtcaagctgacctaggcacctagtatgtttagctgttccagtccccactctccagatttggccacattctcccagttggaaatgatggaagatattgccatctggagttctctgatttcctgtaagttcttggagactttatgcatggccccacccaaagcttttccttcaccccaacaggagagaaggaggctgcagaccacagaaacttcagagatgatgatttatgtggactcatcagaagtctaaaggggcatgtctgtgttcttaaagggtacgggaacctcagagagccaattggcccaagaagcagtatgtagaatggctacatattctatattttcaaagatcaaacagtgcagagtgcaagattataggaaacccaaaagggtcacaaaccaggataagaaaatatcccattcactgccatattttccaaacctaaaagagtgcctcaatcaatgtttgttgagttttaaataaatatctttatttcagtaatatttaaaaatgtatcctaaatctacttgttgtctgtattttcaaacatagggaaataagcaccaatagctaattggaggaataggatgggggatggggcacagcatgaggagaggagtgagagtatgtctctcccagaaaacatttattgtaggtattgattcaaattccagttcctttcattcctagctgtgtgatactggacaagttacttaaatttgagccagagtgtctccactgttaaactaagtaacaatatctactttataagattattgtgtaaagtaggtaaaatttatgagaacatgcttaataaattctaagtgacaaaatgttaggtgttattactgacatttataacaataataataataataaaataataaagattggaacatggccagggagtggtgaggggtcatagcattggtgtgaaagttggatttgaatgtcagtttctctggctcatatggtaactctgcctatccaggatttaacttagaatcaacagctccccaaacaacagcagagctctatccagtttgaacacttgaactagttcttttactcagtgagaacctgtgagtctgtctggagtagagaggcgggtgttgagattaaaccaccacagtgggctgtctctgtcttagggaagaataacagagaaggagtttctgcacaccagtctgacttagagctgagcagcacatagacgtgtacccaggtatctcatgccttatgcccagcgggacccttcctggtgtgtatggtcgatatgctaccctgtggagggtggctatttattgaattcctattccactcaacttcagtttatctgactttggaggggttgcaacacggccttgcctcttatgctgagctttctttggaattgctatgtgactgtttctttgacagacttagttagaaattcagatgatactgatttaaaatagacccgtggggtttgagaacagttagagagagcacagatgagaaggagaggttaaattttttctaaactcaagttgtcagtactaaattcattatcccccattaacaggcataataatgaaaataataatgtataactttttcactccattcactcatttattcatgaaatatttattaagtgcctatgtactagagtgtatactaaatgctagacatatatagataaatagataaaccatgcctgtcttagggagtaaggtggaaagcctgagggtggcatgtaggttagtctggcatataatctcaacaagcttttggaaagatgaaatggttgtacttagaggcagaaattgcattggttttggtcacagatgtagcctacctccattgcctgccacagaacctggctcagctaagtacccaatagatgttttttgaattggcttaatatttctaattgcatgattaagtggccagaatcagttaatttaacccatgagtccttttcactccttttacagagctagaaactttttgtggccagtcaacctggtaaccaaacatttaaattctggtaattggtaaatatgcctcgtcacaggtttgttgaatgatttatttttcataaaagcaggaggttcatgacaagctcagcaaatctgttggcagttttaagacattataccgggtagtttagggaaatttctcagcacatgagaccctttagattatgtaatattcttgcaaggcaactaggaaaaatagtttttaaaattatgtctattttgctatatttaaaagcagaaattatcttattacggagaattgattaaatatttgatagcatttttgtatgatttaacatatttataggtgttaatttctcacaaaatttaagttatagctctaagtgtagaattaatagtttccctttgattacagtttttttggtgttaacgttcatctatttttggatgatttgacttacccttcctttttaaaattcagactctaaatttaaggctatacatcaccatagtgtttatgaagtgaattaaatcttacagaatgttccagtgcaatctgaaactacagcaactacttgaggttttatgtctgaaaagtgttttaatcagtgatggatttggaattattgcagctgattcctgaattcttaggcctaggccttaggaacacactatccagatgtttataaaatgccattttaccaatgtcctgtttatactttgactttgtggttcaaaaaaaatacatttgcctacttcaaagtaccagatgaaagtattttacatcaactaaatactgcatttgagctgcccaacagtccctaacactgactccttctgccttaaaggcatttatttcctatcatcacctgttttctccaagacatgtgagaagaataaagcctgtattgtggcattttgtgtgaatgctaagatcttggcaatgtttcttataccttccctagctcttctattttccctaaaaagtattctctttttgaaagaaaaatttaatttctcaatttcttaaaccagattattaattaaaactgcaaaatgaaggaaggaacacccactaattcttcaaagctcagcaacagaatcaaatcctttgaagatctgtctgcttaactcatcactattaatcagtttaagactatttagaaaaggtactgagagaaagaaatgaataaaaatgggtgaataaggcaatattaagctgacactttatagtccggttggtagagtaaaaaagcaatcaaacttaacagctttttaaaaaattaagaatgttatataggttgatgttatttttattattataaatataatatttactccttttgccaacttggaaaatgtagaaaagtcaagaaaaacataacattcatccatgatcccaccacccagacaaaaccacttttacctttcccctattttttaagtcattttttgctatgtaattaatcaatttgcataaatacaaaattgaggtaacggtatatgcacaattttgaaacatgttttaatcactttcttgtggcattaaatattcttcaaaatatgtttttagtggctgcagagttatgttatgactttctcatcctttagttggtctttagtgtgtttttatggtgtccagtttcagtattcatgttgatctcctttcaccctttgtcttcactgagtcactcttggctcactatggtaatcattagcactggtttctagatatttctggctcttcacctgcacataaaacagggctgtacatctcagtcccttggagtttgggtgaggacatgtgactttttctaaccaatgagatgtgagtagagcatttaattactgatgagagagacctttcagagtgctgtcctctttgccacagtgactggcagctttccagagagtggctgctccattagcgtggatcccagagtgaggttgaggccaacataaacacctaattggcctgggatggataggtaatgtgagaagaaaatgaaactttgttttagtgagtgaaatcttaggggctgtttgttatcagtgaataagtttgcctgtcttaactgataacaccaatcatttgtatctagattgggaatctgatttagaccttgtggtcatcttatagactcatgttcaccttcacatctgtaaattatgtggcaggtcatcatatacactttctcaaacaattggggaatctttgcccctatgcatctgttttcagggtgtttctttagttgacttcaggcgtattcaataactcatatcatatacatacataaacactcataccttcattctcacaatgtttatgattagccttgttcatacttttctgttgcctaggaaaatgtcaatagaaattttaaagtaaagactgattttttttaaagtataaacttagtagttatatgaaaatgagaaaattcataaggaaaaaatcctgtcatttcccctgccattcaaacctatttttattatcccatatttcctctattccctgtgtataaaactttatattgcttatcatagtttacatacaacttgacattttctatatatataaaaattttcatgtttttcctacacttcataattaacattttaatggctgcaaaatattccactgaaattgaacaccgtaatttatactacaatttccttattactggttttttagtttgctgcaatttttttgaaattctgttggaataaataatttttagagcattttaaaacaaatatactagaatgtatacatctaatcagtattatcatataaataacttctaagtctaaacacatattctaatgcaggtgccattgatataaacatttctaatctcttttaaaatggtctttatggccaattgatgagctacaaattaaaaattagtctcattattttataatatatcttgatttggaccccaaatcattcattcattttgttaatcatattttggctgttttcaaaagttaattctaattttaaagcaccaaattttgccttcatttagaccatttggaaggctgccaaatgctctaaaggcaatttcagaggaaaagttccaaaactgttaacagcactgggcaattgctgcgataactgagcagcctaccatagtgatggttttagagaaaaaaacactcctttttaaatgtgagtttgagtggatttgttactgtaatcattaaatccacaactctatagtcacactgggcatggatgtaatattgttcaaaataaatgccagttgcttgatagcagggactgattctttcatgacatctacattagtgccttgcacatggtaactacttaggtatatttgtgatcgagtctgtgaaagtgatccctgttgagatcacactttttccattggcaaggacctatctttgaataaatcctttctgctggtgaagtcttgaagtctccagcactctagacttacagcattagcattatgtgggaatttgttagaaatgaaagttctctggcctcaccctggacctactaaatcagaaattctagagattgggccagcaatctgttttagcaagacttccatgttattctgacacataataactaaatggtaaagttagcctgaagaaaaactgaaaataaaggtcaaagaggtgattctataatgaaagaaagttggtgttagaagccacagactagcaaaattcaataaacatcttcagagcacctactgtggtccagaaattgagcttgtagatactaggtatgcaaaagcaaaatagatagtgtctatacagaagacataaatgtgcgtaaatgggtataaaataaatacaatgctgagtgatacttcgatatagaagaatatacaaaatatgggtggtgatgatcataactaccatttataaaccacatgttgtctgtcaggcacagtacagtgctttatatatatatttttttggtatgattatcagaaggaatataaagattaaaaggtgctgcattacttaaataggttcccttaaacctggaaagaataaaatcctggtcacaaagttcatttcttgcccagagcacttgacccattcagggatcctgtgtttgtcatttctcttcagaaatgattatattggcacctatctcagaattgatatacagattaaatacggtcatggatgaaattatttagcccactatgtatcatcaatattcattagatagtaatcatttttattgctactaatagtaatcatcatcatcattagaggggtgagcggcaatataagatagattctatagaggttaaaagcatgactccagccagattcagattgccagggttcagttctgtctttgtcagcttctagctgtgagactatgggcttagcctctctgtttcaattttgtcatctgtacaatggggacagtaagagtccttcacagggttgtaataactggtaaatgaattaatgtgtgaaaagcacacagcacactggcaggcacagggcaaatgctcagtaagtgctagcttggagtgttctgtcaaaaagcctaacatctctttgtggtattttgtgatttttgacagaatggtgtatgctttaggcatctatggaacaaaaatatcacccttccttaaatctgtggcgttgagggatcactacatatttgaataaaggcctttctctgatgtctaacaggaagaagaaaaccactgataccaaactaaggtttaaaaaaggccaaggggaagaaaattttaaatcaaaagtcatccattcttatttcatggaaatacgttatttaagcaaatatactgataatgatgcacagatgctgtttgtatacattactttcctcctttgaattcactaagtactgatttcttattggtgccagcgatcttcagaattagttctgtccccttctgtatcattgtgtgagacaaatatctcatatacaacttttctaaagattagaagactaaaatatgtgtctattgcctcaaaggcagagaagaggtacacaaatgtgaataaacagttaaaacattaacagatgtattggaagagtccttgaatacacatgtgattgatatcaagaaaacattagctttgtaattctgcctagatcgaacactgatgggctggcactacagaaagattcagctgcaagtatttcatgtaactgatggtgtaacgcaaaaacatttcagtagatatctttctaataatttgccacaggtgctcaaatgcctgggagctagaatttcaaggattcaaattgctactgtgatagcttcaggctttgcttccaggtttttttttttttttttttttttttaagcaggctgtggcacatgtttttaagaatttaagtctgtttattggtgatgctgcagtttgcttgattacagtttaagagggtgactgtagtttctcaaagaacccaatgaatatgaactcagtttacatcattgaaaactcatgttcaatctctatcctgtgtgtactgtgttcagttattttctttgaacttaacattatttcatctacatttctatgtactgctttcgacccatttacgtgtcatagatgtcttctcttttgccacttcctctcctgaagtttctgtcctgggtttcttctagagttcaacgtatatatagagatgcagagaacatcttagtacaaattattttttctttttttacgatattggcgatgagtttgttctccaaagcaaaataaccaaaacaaaatcagaatttttataggtttgctgcattttgggagatcacactctagaaagatcaaactaatttaagtgccaccagcattggttatacagattgatcatcccttatccaaaatacttgggatcagaaatgttttggattttgaattttttcagattttggaatacttacatgtacataatgagatatcacagggatgggacccaagtcttaaacatacagttcacttgtgtttgagatacaccttatatacataacctaaaggtaattttatgaaatatttctgataattctgtgcatgaaacaaaattttaactgcatttttgactgccactggccacagaagtcatgtggaattttccatttgtggcatcgtgttggtgctcaaaaagtttcagagcatttgggattttggatttttggattagggatgcttaaactgtatgtgtaattttcccatagcttatacggtaccagatttttattataatttaggtgtgtaataacttcttacagtaattttaatttagatttacttagttggtaggaagttatatatctgtgagagaaaattcttaatatttataatttgaaaatatataatgcactgatttatcattttggtcatggcaaacattgggatatatttgtctgcaaataaaagaaaactcgactaatggtggttgtattagtcaggactatccagagaaacaaaaccaataggatgtgcaagtaagcagaaattttaacatacggtagaattaaattggaaaggaaacaaggaaactcatatattttgtgatgtttactatgggttacagaatgtacagtaaacacaaaagctaatatttattcaatactttctagctcacaaaacattaagtgtaaaattttagctattttaacttttcttttatctttatttcacaggcacttacctcctgtatctttgaatcttctttatatttttatgtttaagagaaaaaagccaaaagtccttcctgtatggtgtggatgttaaataccaaacagttttattccccttaacattttgaccatcttccttcttccttgcactcttgtggagttggctgctttcctttactttggaagaagctacgtttttctgaccctgtaatggtgttcttctgagatttgcggatgaacataagatattaaacatatcggttgagttttgttcatgtggagtctgtcatcaatatggaatagaattcaataatttgactttttcttgcctctcttctgccatttcaaatgaatcataaaaattaggaaggaaatttagtcccatctcctctctcttgagcagatttcttttccttctcttttttttttaaacctgtgggagttgggaatattttagtgctccccctttgtgaattatggtgtaaatgaaactttttgcttttgtgttattaatgacagtttaaaagtctgagatggattttctcttattgttgttaatgacagtataaaagtcttaggtaaatttactcttaaggtgctaaattaaaaaaaattaataaagtcaattgaaaattttccaagagttattttaaagttgatttttaaatcaaataagcttttctattaagcaaaataagtgctcttttaattagaagctttaaaaaaaactctatggaaacaaaagactataccttcaaaagctcacaatctttacaattcccacttccagacctttttttaggaaacattccaaggctttaaactatttgtgaataatttttatcttagtcaatgtgttatatgcccctgcacagacttatatattcttcattgagatatataattgtcctcttgttggatatttaacctataagctgacactcactttcaaggattgatttgagctttgcaaattttgaaatgctcagaaacataaagtgcttggtatcttttataagaagctagtcagaactgcctgacatgaagggagtttgattgatgtgtgataatcaggtgggaaatttcaaacttatttatttaagcactgcatttattttatgtagatcaaaggaaaatattcagctggcttcaaatgatgtcacttttcataagatacacaagaaatttgatgaaatttgaaaaactgattaagacttatatttgttcatgttcattttatattttgggtgtactatcttgcaagcacaaacaccagcaggctttgcttttacacatctcataagccaagtccatggaagtataaatttttaatgagatagatactaggattctctccttaaaggaaaattggaaacttaggattcttattttgacttttataatagaagttctatttgggatataattcagacacaataaaatacactcctttaacttgcacaactctatggatttagtatattcacagagttgtgcaaccaccacaactaattttaggacatttcatcatcccaaaaagaaacctcatacctattaatattccactctcccctgccagtcctgggcaacctaaaatttactttctatctaaaacctaaaatttcctttattgaatttacattctatctagatctgcctgttctggacatttcatacaaatggaatcttgcaatatatggtcttttttgactagcttctttcacttagaataatgttttcaaggttcatccatgttgtagcatgtaccaaatgtcattttgtattgctgagtaatttcatcatatggctatactgcattttgtttacacatttatcatttgataggtattaaggttgtttctaccttttgactattaaaaataatgctgctatgaatatttgtgtgtaatatttcttcatgtgggcatatattttcatttcgttataatatataccaaggggtagaattgctgggccatgtgataagtacatgtttaactttttgaagaactgtcaaattgttttccagagtaactatgccatttcacatgcaatgtacaaggattcaaatttctccacatcctccccaatgcttgtttttatctctttttggtaatagccatcctattagatggaaagtgacatctcattgaggttttgatttgcatttcctttatagctaatcatgttcagcatcttttcatgtaattatagtccatttatgtatcttctttggagaaatgtctattcaaattattttcccgttttcataattggattttaaaattattgaattgttaaatatctttatatattttagatacaagtgccttatcagatatatgctttgtaaaagttttctcccattctatgggttgcctttttactttttgatggtgtcctctaaagcacaaaagtttaacattttgatggttccatttatctattttttattttgttgcttgtgattttggtgttgtctctaagaaacaatttcctttcccaaagtcatgaagttttgtagttttagctattacatgtaaggctatgattcattttgaaattgttttgtctatggcatgatttaagaatgtaactttattcttttgcatgtggatatctggtttgcctagaaccatttgttgaaaaaactgttctattcttgttgaactgtctgggtatctttgttgaaaatgaattggccattcctagaagggtttatttctggactctcaattctactctattggtttatgtatctatccttataccagtaccatgctatcttggttactatagttttatggtaagtttttaaatatggaagtatgagttctccaactttgttctttttttaaaattctaacttgttttgtttattttgaatgatttccatatgaattttataatcagcttgtcaatttctttttttaaaaaaagcagctggaattttgatatggattgcgttaaatccataaatcaacttgaggggcattgccatgttaacaatattaagtattctactttatagacatgaacatctttccatttatttagatctttaatttattttaacaatatgttatagttttcagtgtacaggtttcacatgttggttaaatttatttgttctattttattgtttttattatgaattacatggattgcttagttaatttaattttcagattactctttgctattgttttgcttttgcatcgttcattgctgctgcacaattgatttttgtatgctgatcttttatctgctaaccttgatgaacttcttaattagttctaatcgttttgtgtgtgtatgtgtgttccttaggattttctatatgtaagatcatgtcactctttctagaaatttggctttgatattaaaaatacattaatataaaactaaagaattagttagaataagattttgttaaaaatattaacttactcaaaaaaaaagatcatgtcatctgtgaaaagagatacttttacttcttcttttccaatatggaatttaaaaaatttttttattatttgattcctctggttagaatctccagtaaaatgtttaataggagtggggagacaaacatccttggcttatttctgatctcaggggaaaagcattcattcttttcccattacatatgatgttagctgtgggatatttgtagatgctttttatcagattgaggaagttctctttcattagtttgattagtgattttatcataaaaaagtgctagattttgtgaaatactttttcagcatctgctgggataatcatgtggtattgtcctttattatattaaaatagtatattacatcaattgatttttggatgttaaatcaactttgtgttcctgggataaatcccatttgtttgtggtatataatcctttttatatgttgccggttctctttgctggtattttgttaaggatgttttgcatttatatttataagggatttttggtctgtagttttcttttcttgtgttgtgatgcctttgtctggttttgatgacagtaatggtggccttgtagaatgagttgagaagggttccctcctcttctattttttgtaagaatttatagaggattgttattaatctttaaatcttatttagattagttatggcttccttggtagtttaccctttgcttttataaattgcagaaggggcttgtaaatggggacaggacggtggtgtttgtgctgattggtccctttacaataattttactacagtgaaagtagaggattttaaataaaactgagtcttcattttgcctccttctataaaacaatgatagatgctccaccattggaagacatgcttagttgcagaaacaaattcaaaggtttttatatcttaaattaaaattagaagatgcctttcagtgccgtctcctcagctgagccatgggtgcatgcccggctcactgtccccactttaagaagtcttaccagtaacctataagtacaaatctgtctagaaacactacttaaaagagcctgttaagaagtgttatactgaccttctcttgggtaagagcctaagaacaaggagagtttgttgaatcccagacatcacgtaaggtaatatgaataataaatatttagattgtcttcctacatgttgcaaggtaatttttggtcattaatcactccactagctcagtgggaaaaattaacaccaaagaagtaataacaactaatttttactaagtaattactatgtgccaaacactgtcttaaatcctttatgtatactatctcttttatttttcatagcaatattatgaggtcaatgctaacattattctccactttacaaatgcggaaatttagaaacaaagaggtaatcttagttgcaaagaatgctggagctgggatccgacctaggttaagtgaccccagaacctgaaccagaatttggaatagattatatgcatcccagggatttagactcagggtctctgtattccaagttctgggtttggaagataagtctttgtactccttttgatgaataataaaatttgcagtccaccttttcttttctttttttttttctgagacggagtctcgctctgtcgcccaggctggagtgcagtggcatgatctcggctcactgcaagctccacctcctgggttcaagtgattctccttcctcgctatacctgtaatctctggggattacaggcatgtgccaccacacctggctaatttttctgtatttttagtagagatggggtttccccatgttggccaggatggtcttgatatcttgacctcatgatccacctgcctcagcctcccaatgtgctgggactacaggcatgagccaccatgcccggcttgcagtctactttttagaaatgttcatagagggtatactcagatggtactaatcacttgagattagacagtctctgcagggataattgaataagcaagttaataaaataaatatttaaaatgcattgagtgattaatgtgtttgagggtaagtgatttagttgtataattaattatttctgcaaaataactctatgaaatggtattattatcacttccatttgtagaagacacccctgaaacaaagatgtgggtaacttgccctgggccagttagcaataagcccagatttgaacccaagcagtcttgttccagaccttctgtttttaacaattctacattgcagtttctctaagtaaatagtcacctgaaatatggctacaacaatacagtcacaccaagaatgtagttagagataagaatgcatcattgtgtttgtgcatgtggagactggagctgcttctataggagataagcaccaagctatcatctgttggagagaaatgtgttgtgggtgaaaggaggaggagggctgttctgtaaatatgagacaagctgaaacaaatatagaaatatgaaaagaaaatctgattttcaaaagtgaagtttttagcctatgctttaacagaagataggaatagactgtggcacgcacttggaagctgtgacagtttggtcctgagagcactgtggtgtgggagggttaggagccacacctcaggggtgaaaaggaacagtttgaaagggcaattttagaaaatgactttgataagctccattagtagatacagaggttgaatcaacagattaatataggcttcaattataagtgtttctatgaatataagaagcatctagaaattaacaggaaaatatctgaccagttgggatggtatttctcctttagtgccaaaagtataatagtttttttttctcttgtggcagtaaaattaaaggcctggatttattcagcaacttttctttatgagaataggaatatattcccagacattgttctacacttttcctgcgtggtgttctaccaccaatgtggagttatagatttagacctctgtgtttgggtgggaagagagtaggcccactggcaggcagtaaccacagaactacatgtatctgggccagttttattccagacatgtggatcttctggtctgcagccttgacaaacttcagagttcccttgtctccttgtacagatgtgtgtaccttttgatcatgaaggcactattaatgtccttcagagtttgtgtcaatttgcaactttgaaggatatccaaattatcaaataatttacatatgatgattattaaattgaagtttctaatttattcttaacaaaaaataaaaattacattcacatcaaaagcaagtaaatcaatacttcccacatttcctgtttcccagatgcaaacaaagataagtggaagttaaatatcaatatacaggtgctttcaaaaaagtcttttggtctatttccactttcaaggtaacctggtggcttcttctctcaagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggtgagtgaaggagaaggctggcctaagaatacagtttcctggtctagtttgagttattagagatagtttgggaaagagagaacgtgaaaccacctagatggtcctcatagattcgttgaaggcagaagctttatatatattttttctcatcaaaattttaccatgtttaccatctcacaccagtcagaatgggtattactaaaaagtcaaagaataatagatgttggtgaggttgtggagaaaaaggaacacttatatgttgttggagggactgtaaattacttcaacccctgtgaaaagcagtttggagatttctcaaataactgaaaacagaattagcgtttgacccagccatctcactactgtgtattgtaaccaaaggaaagtaaattgttctactaaaatgatacctgcactcacatgtttattgcagcactattcacaatagcaaagacatggaatcaacctaggtgcccatcaatggtgggctggctaaaaaacaaatatatggtcatatatatatatatatatatatatatatatatatatatatatatatatatatatatataccatggaatactacccagccatagaaaagaatgaaatcatgtcctttgcagcaagatgggcacaactgaaggccattatcctaagtgaattaatacagaaagaaaaacaaaaagcatgttctcacttacaagtgggagctaatcattgggtacatgtgtacataaatactggaagaataggcaatgggggctccaaaatcggggagggagagagggaagcaaggtttaaaaaaactacctgttgggtactacattactctttgggtgacgggttcaactgaagccaaaactttagcctcacacaatatgtccatataccccctgaatctaaagtttaaaaaataaaaaaataaaaattttagcacattgactgaagaagggcaggagtaattgaaggacagaatggtattcgtgatgtggaaattcaacctcggaacaattgagagtggtatttgtccacgtgttgtatttattccatttgaagctagcctggcatttgagataaaaccaatagttaatacttattgtgttaattatcttatttaatcctttcaaagcttagtgaatttgcatatattttctgtattagtccattctcacattgctataaagaaatacctaagactgggtaatttataagaaaagaggtttaattggttcacagttctgcaggctgtacaggaagcatggcggcatctgcttctgggaaggcttcacagagcattcaatcatggcagaaggcaaagggggagtgaggtgtcttagatggcaggagcaggagcaaaggggaggggagatgccacacacttttaaacaaccagatctcatgagaactcgctaacacaagaacagcaccagggggatggtgctaaatcattcatgagaaacagcctgtataatccaatcacctctcaccaggcctcacctccgacattcgaattacaattccacatgagatttgggcagggacacagatctaaatcatatgaagtttcttcattttataggtgagaaaacaaacctagaaggaaactcaattacccaaggtccacacagctaagtaggcagctaagaaggaattcagacccaggatcttgtgaatattaaaccaagctttaaaccacagtttatgtgcagtttccagagttcatgaatttatctgcaaataaagggatggtatgcaagtaattaacagaattattgtgaggactagattaggtaaggcacatcaaatagctttgttgagtgtttggcacatcacagctcactgaatgtaagtttcctttgtatggcatcaagtgtgcaataaacactttttataaggtttctggtgcaaatctcatgcatttgttattgaaattctagaaatggaacttaaaaatgttatttagaaatttcagacttgtattttatttgacagcatcagtgggatgaaggaaagggtgaagagtgatggcatttggtgatggagaaacaagtcttatgcacatgacttctcccagactaaggactgggagactcaggactcaggacttctcccagacttgagggctgtactgcagtaaagattcattttaagctcaggactcttttccctcttctaaaatcatctgcttcaaggacctgggcatcaaccatggcttttgccacagggatgatggaaaacaagaactcagtagaatcacagggagtcagacagctgtagagaaacggtggtttcaaatagacaagcccagccccttgtccctttaagaaactgataacaacagaagagccaagagtctatatttcagatgctaaatagtcagatgccttaaagtgtaatccttcccaggtattttccccagtcagtagttccagggtaaagttatgtcatcatcaggtagctagcccagggcttgaagggtttaggattataatactatcgctgtttggtcgagcaggctgggtgagctggcctaaggttgtgggcaggtgggtggcagggtgagagtgagttattgggatccttagtctgtagcagctatggagtctcagaatctgaggctgaagtatttaggcagaggagttcttgagagccagagggctgagatagtgctggctctgacagcttcatgagggacattaacatcttctggctaggagggcttgggcctatttgtcagctcagcctgactcattcttttattttttaaaatcagctgaattgaggtataacttatataaaataaatcaaccaatctaatgtacaatttgatgagtttggaaaatgtataatgtaaccactactacaattataatatataatatttccaccacccaaagtttcccttgagttcctttgtagtccatctccgactctaccaccctgccctggcagccagtgatctcctttctagagctatagttgttttttaaattattatttcatatataagtgaaataatataatttgtagtcattttctgtgaggcttatttcactcagcataatgcttttgagatgtatccatgttgttgattcagttgtttcttcctttatatccccgagtaatatttcattgtacagatatatgacaattcgtttatccattcagcaattgatggatatgtgggtggtttctagtttttgattattgtgtataaagcttttgtgaacattcttgtactagtctttctgtggacttaatgttttcctttcttctgagtaaatatcttggagtggaattgctggactggcctaaatttaagtacccttctctctgtcaagatgcttcactctgtattttgtcggggtagcaccttctcccagaaggtagatggacaatttcagagcaatcatgagatttaggatgttgcctagaattccaagagttgatcataaatactttgttaccaagatgtaaaaggtagaagtttaacaaaacttcttccacaaagaagtaacagcattactttcacagaaaaaaatgaaaatgaggacagtaaagtcaagtctgtggttgcgttttgtggagggaatctgcattctagctggcctggaaccgcaggggacatacagactatgaaggcaagcaagaagcatgaagtccctctgcaggtgttaagttgactaatgagcctgaaaaagaatggccttatccccaataaatgtcgcttcttccatgaagactgctttgataacattcccctcatcccaacacttcatgccactgttatggtgtcatctcctagcagaacttgcaaatgccctgagagcaggcactctgttcactctatttcctttcttttcctttttcccgccctaatggctatttcaggaacttggcatgcagtggcttctcaacacatgttttattttggtaaaatgaaggagtaagtaagaaaaaaatggttggaggatgttactaatcttgatcctctttaaatctggaagttttactgcccttttagaataccaattgttcattggcacattgaacctcatccctgaatgtagtgcaacatgtccaaatatgaacacattggctccctcatacctgattttttgtctttgtttcttgtttctattaaatgaaccatatttatctaacagcaaagttataaaacttcaagttaattttcattccctctcctttatcactgtcctacagtcaggtatcacatcctattcagtctattttcagcatattaaaaaaaaattctgttcctaccttgcctttactgctactactgccttaattcaggccctcactatttccccccgattttttttcttctggtcttttccatacttctttgcaatgaggctcaaagttattttaaaacatttgatctcaacatggtgattccctgctttcaggtccctctctcctgtttcttataagataaaggttgtgatgaagataaatgctgaggtgagtaatcagaggtgagcagaagacagagaaaaaaagacaaagagagaggggagtcagggttagataagaggcagttatagtaagaagaaattatatggtaccattcataaatgaacagaaaatgagaatgaagaaaggggaaaaggaaatgtatgatggtgaaaggcaatgtctggtggagattcaaggtcaactgagaactgatctttcataggccagggaaggagttcagttccaaagtctagcagactttcctaaaatcattcatttttaagttatcagtaatgctaacagtaacttaaaagttggtttttataatttaggttgactaacttctgcctgacacaaccttgctactttgctccatagcatactaaagaatagtggtgctaaataacttataaaattagctgcagtggaaattatctctataaaaggagaaggtctgttgaaactatcattattctgcctgcagaataatgcaaatatctttggagacttgaaagtaggcagaggggaggaaagtgggtatcttagtctgttttatgctgctattgaagaatatcatagaatgggtaatttataatgaacagaaattagatcagagttctggagacagggaagttcaagagcatggcaccagcaatttgcaaggaactaaggaacttcatgctgcatcatcccatggcagaaggtggaagggcaagagatggtgagagcaagagagcaggaggggaccaaactcctttttataacaaactcatttttgagataattaacccattcctttgataatcatattaatccattcctgatggcagaaccctcatgatttaattacctcatattaggccccaccttccagcaatgttgcattggggattaagttctcaacacatgaactttcgggtgacatatgcaaaacattgcatggactaacactaggcagtggctaatagatattgttcagtaataacacccagtatagttccttacatctcatcaaccatgcagagaaccttaataaaagtaaagcagttagcatgtaaataatccttccattttggcccaaaacccatgggcaaaatgtggtaaatatcagctttagaaaagtgtatatgtgattgataaagtattagtacatttcaaaaccctgttgcataattcatccataagcctggaccgaattaaccacaggctttaaaaagatgccaataggccaggcgtggtggctcacgcctgtaatctcagggaggccgaggcgggcagataactaggtcaggagatggagaccatcctggctaacacagtgaaaccccatctctactaaaaaatacaaaaaaaagttagccgggtgtggtggcgggcgcctgtagccccagctactggagaggctgaggcagaagaatggcatgaacctgggaggcggagatcgcaccactgcactccagcctgggcaacacagtgggactccatctcaacagaaaaaaaaaagccaataatgaaaatactttattgggtttcactttgtgaaaatagcagaataggggtaatatatacctaaaatctaccctctttccaaaaaaccgatggtggcacattctggctcctctaagcccagaattctctctccactctgacttcctcagaaactgtactcttctgtgatttgggcatgttttgcaggacccagaagatcttggacagtgtgcatgagtgcacttcactggggctaaagcagtcctctggaagctctgacattagcctcagaactgcattctctcaagacagctttatccctgggaaatcatggtatatttaagacccatctatggttgagaataaatccgagtaggtgaaaatgagcgctttttgatttctgagctgatacttcatggtactaaaatagcaatattatttctacccccacttatcaaggaactactttgcatttgaaaattcagaggaaacttcttaccatctgtgaataggttttattttttgttaactctatagaggttatcctaacaattaaaatagtcttagaggcagagacagagagtagggatcctagagatttagtacaaactctatgactttcagattaggaaaattgaccaaggagaacttgtccaaggggacacagcaaatatgtggtacaaacacatctggaacataactctagatttctggactcccatttcttttaacctctaagagattccattatgcctgggcatgccttagttgaatggtgtataaatttgagggctatacattgattcaggatataggcagttccatccttaccaagtcatttttataggagaaattgtacctttctctcatgctttttctcctgacatcttttccctaagcacaaagagttctcatatctaccgtcctttgtcgtctcagagtttccttagagcacccctgaaggagtttcacctgggaaagtcgcctgtgcttgatccattgattttatgtatcctccctctaagtcctccttgggtcatttctttttagctccttgtcactttggaagaggatctgatgaatgcatcacttctggggtgttaatgactctttatgacgccttgttcccctgtgcctcttttcacaccccttcaccaatcagctactcaggtccatctttatcagagggcaacagaaaaagccaaaatagatgcactactaatcatattatattgtaaaataaattttttagaaataattttagactcacagctattgtaaaaatagtgcggaaagttcaaatgtatgctttgaccaggctaacatgatcagtgataacatcttacgtaaccatagtacattaacctgttgaggacactggtgagaggagactcctgagagcgagctgctttcttggaaagcgagggctgtcttgtgggcatctctgtgtagcacccagtgcagggtggacctgctctgactttagcccccttagtctttttccagttttaatttatgatgctttcatgattttccacaaacagatgaacaaataaacacagaaggaaggttgtgcttgaattgacctgaccagaggacaaactgatcctaaactggactctctctcaccagtaatggattctctaatgttgactcttggggctggcccatttcttttgatccccagcaatttcctaggtcttattttgaggtttgcttagtaaaggcaatatttttaaaatgttaatatattcatgaattattctgaagttattgtatggaaaggaaagtgtttgggattttggagtggttggcggttgatggtattcaaacccattttgataaggccttgatgcagtgaattttttttttaacatgcctttttcttacagcagttattttcatgcattcaaagaacaaattcagttttatatgccagtattattttaaatatagtacagtactgtgaaggctagtggggaacattgaaatgaaaactctagtttgttaactgaacacttcactttcttttttcagtgtggggcaggatttctcaacatcatctctgttggctctttggatcagataattctttgttgtagggggctgtcccgtgcattgtggggtgtttagcaacattcttggccactaaccactaatgtcacttcctaccccacaccacacctcctgcagtctcgagcatcagaaatgtctccagacattgccaaatgtcccttgggggacaaaagccaccccaagttgagagtcactgatgtggagtaatggaaggaagactagatgggtgttgtgaggctttggttctggttttatttctggcacaaataagctgagtggcttaatccttcatctatagaaggaggaactttgtctgaaaaagcttgaaggtcattgccagccctaaaattcctttattaaaaaaatactgaaagatgaaaaaaaatacttaaagatgaaatttatcatcacactaatggtaaattctgtgtactgttaaatagcaacaagacgtcatggaagccctttctaaagctggtgctggagaaaagcattatttacagagtaagggtgttgctgttttgttttgtttttaaattctgtgttcgaatacagttgggaactttcctattcaaaaagttaaacaggctccctttttctgtggtacttcttaagcctttaatgtgctgatgtgcactgggaatctttaagaggtagctttgcagtattctgcaaatttttgatcatggaacactgttttcacagagtatcttaacataaaacattttgtgaaacagtaggatgaggcatgagttttgctgggtagattatgttttagtgttttttattatattctttttaaattgctcttacattaattcagcatctatttacttattgggtattggtatgtgtgaggcactaaggttatagcaatagcatggggtgggcagtatgctctgagcataacctgtaaaatttgcatcctgtctcttatattttgttggtagactattttgcctttctggatgtaaacatcagcctttcctgaagatgggagaacttatgcagaagttgagaaataggagaggcccattaggagggacagcccacggtgggtctgacatgccatgtgaagggccagggctttgtcctgtaggcagcgcgaaggcactgtagagttttagcagtggatttgcgttttagcagtggattttcattttagcttactctggccactgcatacttttgagtaggcaaagactgaaattcagccagaagataatagagtttaaaccaagacagttgaaatagtgttggaaaagaggagaaggattcagaaaatgtttggaaataaagttggcaggagttgttgaagtttgggtatatgagagaaaaagaggtagaagtgcagtttgggtgagtaggagaattcatccattaattctacaggaatttattgagctcctactttgctgggtgtattagggttctctagagggacagaactaataggatatatgtgtatatgaacaagagtttattaaggagaattgactcacacgatcacaaggtaaagtcccatgataggcaatctgcaagttgaggaacaaggaagccagcagtggatcatcccgagtcccaaaacctcaaaagtagggaagctgacagtgcagccttcagtctgtggccaaaggcccgagagcccttggcaaaccactactctgagtccaagggtccaaaagctgaagaacatggagtctgatattcgagggcaggaagcatccagtacagaagaaaggtggaggtcagaagacttagcaagtctgctttatcctagcctcactggccattgcttagatggtgcccacccagattgagggtgggtctgcctcttcccgtccactgactcaaatgttaatctcctttggcaacaccctcaaagacacatccaagaataatactttgcatccttcaatccaatcaagttgacacttaatattaaccatgacaagttcaccccttgtcaacttgaacccatacacatctcctgaaatcgtatataatctccaaataaagacaataattatgcctaatataatacagctatctcttgtgcaacccggagcacactaattgttaacctaaatgctattacataaagttaacaatacttaaatactgatatgaagtcaataactcttacgtcacatgacaaaggaaaaagaaaatgaagatattttcttagtgcaagtgtatacatctacatattcttaacaaaattaggaggaaatattcacaacaattacagtcctctttctgtagctggtcacgtggttgtagctggtattgatgactacctttttctactacctattctgtattccctttgccttcagcaagcacctcagtgggtcgtagttttttacttggtgtagtgacccaaaccttcactcctgaagggtctgggccatttgtagtcatgcctggattgggttgttgtagtttcccattgaccataatcacaaggcatggtaatactaagagatgccgtaaggatctcctgtattccatgcatactcttccttacctccattatgggataatagactaattttatcttgataatccggatcagttgccccggccaacactgtaactcccttcttagcctgttgacttagaggtaggcagagcccaaagtgtccagatggcaaccttaacttccaatttaatagaatcattgttgtgcctcctggcaacattcctccctctggaactaagacttctaagccagcagaatataatgtagcaggaacagaaaacaagaattttgctagtgggtcactaggggtgatggtgagtgatgccacttccatttccaccccttgttttttggacctgtgaatcctggctatgggagaaacagtaccatgtattggatgctgattcagatcatacacagccttctggagaacttcactcgagccctgcaaagccctgcaaagtattgtcgcctagttggcattgtaattgtgacttcaaaagtcattccaccattctatcaatccagctgcttcaggatgatgggtaacatagtaagaccagtgaattccatgagcatgcacacattgccacacttttttagccatagagtgagtgtcttggtcagaggcaatgctgtgtggaataccatgacggtggataagacattccatgaatccatggatggtagtcttggcagaagcattgcgtgcagaatgggcaaacccatatgtctattccggtgcagacaaactgctgccctttccatgatggaaaaggtccaatataatcgacctgccaccaagtagctggctgatctccctgaggaatggtgccatatcgagggctcagtgttggtcccggctgctggcaaattaggcactcagcagtggctgtagccgggtcagcttggtgagtggaagcccatgttgctgagcccatgtgtaacctccatctctgccaccatggccactttgttcatgggcccattgagcaatgacaggggtggctggggaaagaggctgagtggtgtccatagaatgagttatcctgtccacttgattattaaaatccccctctgctgaggtcaccctttggtgagcactcacattggatacaaatattttcacagtttttgaccactcagaggtccatccttaaaattttgtatatacatattatcccattatcaaatattgtcaaattgccctcatagcaccatagctgcatggtaagatgggcaattaaacaagcaacagtgatagaaggtggtaagtgccacagtatggcagctacatgcttctataggggctcatttgagggcaaccgtcctggtctaggaagccaaggatggctttctggagagattcagtttattcctactaaaaagaagattaactgcatgctagagattataaggatggggttgggatgaggtatattacaagctgaggaagtacatgtgaaagcctgaagagtagtgttactcttttttttaagaaacgtgatgtgacttcctttaacttctgaattcatttgctaatgaatcctgtttttatggagttatcctgtaaaataacccaaagacaaagacatggcttttttaatgtatatgtgtttttagaaataaatcattgaaaagctcagtaatccctttggagaacagctttagcattgatgctgtcaagacccttgtcaaaagaataaaccaaacctgattggcctggtggataaactcattccatacataactgaatagttagagactgtacagaaatgcagttttgcctttcatcttaatatgtagtctgatgatttgtaaaaaccttcttagtgggaacagcaggttattctgcctgggtgggagcctttttactagcttaagcagctgtttaaactttcataagcaaagtaattattaaatgtttcatgaacatattggttggaacgtttgttcacattttaaccttgagttggaaagtttcaggggggtggggttaaagagttttaagctggcaaattcattctttttttctttcttattataaactttttatggcttagaaccagccaacctaaatcatggaaggaaaaatacatgtgtggcaagcatgagacatttcattgtttatttttcaaatttctgaaatgtgctcatagctgtgcatgcctctgggctcataaagacagcaaatggaaatagctgaagccagacagactgttttagatagatagccacccaggtaggcaaggaaaaccttgtaggttactctttcctccaatcaagtcatattaatttgccaaaatgggattttcaagcaggaggatgtgatctttcataggtctgaacaccttgcctttttcaatgatggagccatttaataataatcataatcagaagatgaggaataatatacatttatagaatacttagtacatggcaagtgtatatgacacatagtagtctacgtgtttctcatacattatctcctttaatgttcaccacaaccttgtcaaacaagcaatgctgttatatccatataacagatgaagaaacgaaggcttagagaggtcacagaatttgcaaagcttctgagtggctgagctgggatttaaattcatctgtcctatccaagaacaattcattatcctgtacttcttagtgcctttttattctagtttgtgaagtgctgctacctaaagagtttcccattttactctaaatgaaaaagaaaaccaggacaaccatcagcatcaacagcaactaatgcttgttgaacaactactatgtgcaggacgctatgttataagcttgggaaatattctgggatgagaataaagaagataaaagggtccttgcccgtggctggtgaggaaaataggcagtaagttctagagctcacactgtgcagcactagtgcagggcctgcagcactgtgtccttgctggcccagtactaatgtctgcatatagtactttacaatttgtaatgtgccctcactgatattgtcccacataatcccaacaataggactgataataatgattcccactttaaagatgaggaagctgagattcagagggacaaaataattggactaaggtcaggcacacaccaaaataagtggaaaatacgattcaaaatgtggttctctataacttgctgtagtcattacctagagccctgcaattttatatagcataaaataaatgctttaaggattacctgaaacacaaccttaaaaaatgaaagcctttaaataataataattacaatatagtgaagtaatgagagcaattttagtagttttaaaatatgtccacatttttttttaaaatttctgtttaaaaggtggagccgaattctcttcccctgcatgtgtactgtacttagtgtctgacttctagtgaacagaatattgcagaagtgctgggttatggcagccaagattagaacataaaatgcagtgtagcttcctccttgctctttctcttgcatcacttgctctgggagaagccagctgccacgctgggaggagcacttggagaggtccaggtggtaagacactgacttcttctgctattaaccagtacaaactagctaacaagtaaatccaacaggtccagtctaggcttcagatgacttcaaccctggccaatattttgaccacaaccttatcagagaccctaagccagaaccacccagctatgccactcccagattcttgactcacaagaacagtgtgagataataactgtttattgttttaagccactaagttttggggtaaactaatacagcaattaaagggcacaagatacacagaaaggaataactgtgtctaagctgtcacaaaagatgggtactaaaatgtgacaaatatgagtaggaacttataggtggacaaggaatttattgggaggtgttctgggcaaagaggcaagtgtatgcaaaaaagtgtggaagtgtgccacagcaaggtacatttatgaaactgcacagtacagcacaagataaaaatcacaccaagaaatgtaatatatcataatataacaacaaatgttcttaagagtgactttgagtctgcaagaaatttagttctatatggactattttaaaagataggaaagcaattaaaacattgtttgaaatatttacttcaaaatttttttaaagtactgtataaatttttagttagagtctaagctatccagaaaagccacttccctgttttcttacttcactagaactgtctggttccatgttttgaaaactttagtttaaatgtagagccaagaattaactaatgaagaacacctggattttctgcaggatttcactgcaccaattctgttacaacaatcaggtagaaattaacattttataaccaattatatgttttacttggcatcatgctaaccaactgaatttttacaaaagagaattggccaaattgactcattattctccaccatacctcactcattgactgactatttattgagtgccgtccgtgtgttacccactgtgataggcccataaaacaaccctttatggttgcaaaaatcactttgcatcccagttgcagctctactgttttctagagttaatagaagttcctggtgaaaaaaactatgcttagtttttttctaagcatgtttaacttgggtttttaattaaaattaatacctactcatttgaaataaagagaaaagtgaaaagaagttttacttggaaatacattaattgaaagacagttgctgttagcatcttgctgcacttctttcactctattttcttctatgagtatctttataaagttataatattttatagatactgtcaaatctagttgttgtttaacatcaggcaaaatatcccttgaaacagaatttttaatgtatttaagttattctaacaaatggatatcctgcaatttacttaacctggtattagatgttttgattatacatgaatctttcaggaaaaatgatgtcatagttaaataaatatgtagctagtgaattttgaatgtgtcttttgaactgtttatgggctttgtgataattgggtaattttaaatgataatcagtaggaagcttaggaagaggttaacatggtttctctcccttccaagagaactgcctttgtaagattctgagatgaccactgtggccatgtgcccaagtgtgctgtcacagttatactgtcagttaaattaagcatgaatgattggatggagaacattattattctctgcacattcttgattcttaatttaaggttaaactaatttaatgtcatgtgaatttttagcagcaattatggacagttaatgcatgttcttccttagttatgcctcatctctttgcaaaattacaatatttcattccaaatttcttctgaccagatttggaagtagctctctcttctcttttccctcaatgtttatatcagaagggttttgagtttatactgtaaatctccatttgtgtattttcataataagactctaagaaccttgactggttatgagggcactggaatcaaagcaaatgagggcactggaatcaaagcactggacccagtgctttctccatccttcaggggatattgtacagacaatagagatgctatcttaacatctctgtttgagtttttccctctccacctgtcttgcataccaccctaaccaatactccttaagtatggctctatattactatgcccctatcaacactctattttaaaaaggcatggcttcacacttcctgtaagataatagccagtagtccttgaatctggcattcaaagctttaaatctacaagatgatatactggtcataccttttcctgcctattttctagagtcttttcccagaagactctgttccatgtatttggtgtcactttcctgtctctgtgccttcctcatactgacccccttttctaacctgactgttgaaatcttacctactcagtcttttttcatttatttgttgattgtttcaataaaattaatttacttaataagtatttactgagcactgattgctcatcagacaacattcaagagcctactgaaatggcaccttccctgagaagcctctcttaattacacacccatatacaatgtttctctcttcagaacttccataggtctcttttttatgctttccataaaatttgtcacaaatcccataccttatttatgtgcatataggagcatctaatgggaactcaaaattgctttaaagaacataaatgaatgaatgaacatgaatgagctaatgaatgaaagaaaagttatgccttctgcaccagcagaagctaatgactaaaataaaatggttaaactggactagaaatttaagattgttatgggtttctagtctaggaaacaccctcaatgtggtttccatattggattatcccaacagagaaagatatggaatccccatcttctgattcccacaccattactctttctgcaccatgttatcacatgctactctattaaaattgaggcagtattatcatactttgttattgcttttcattattagacatagtgttttaaggacagtattgaataggaagattgttttttcagagtgctgtaacctattttagcattcaaaggggcaaatgtataaacctgagtggtgagaaaaacgtagcagattaactaattttgaaagataatttattttgaacttgagtaggggctagggaccttcattagttcctaagaaaagtagaccacaaactcaacctctatgctcttttttatctagtcatgatattagagtatgtgtggactttgacagtgacacctaaatggtttttacttgcctcattgtttccttactaactgtatgaaagaagaacacgtgttgagcccctccaatctaaaaatacaaactctggaatgctccaaaatttgaaactttttgagtaccaacatgactccacaagtggaaaatcctgacctcacatgttgggtcacagtcaaaaggtagtaaaacaattgtttcatgtacaaaataattaaaaatttgtatgaaattatcttcagactatgtgtataaggtgtataagaaacataaattaattttgtgtttacacttggtcccatcctcatgatatctcattatgtatatgcaaatattccaaaatctgaaaattccaaaatccaaacatttctggtcccaagcatttcagacaaggaatactcaacatgtgagactctggaggtgaatttttgtttgtttgtttggttggttggtttttgcagtaaattgttgaagtcttagaaggggcgcattcagcagttagagcttcccttttaatttgcataccatgccgaagaagaggaggtgtgattctccttctggagatgatcattctttcaaaaagaattatggtgaattgtgttttttaaaaatagacttctagggcagagtaggggaaaaacatagggaaccgttaattaaggtatcagggcttgagaacgttgtttttgtctgcccaagacccttcctttggaaacagcacctctcccaacatttgtgctcctagtggactggtaacttgcactcctaagaactggaatcttgaggaagacacagagcgatagatgagattggggctgagtcatccatgatggtatcctgggcagttcagaatctctgagcctcagtttttcttccccccaaaatgggattctatgtctcactgagttatttgaggattcagtgagatgatgtctctgcaagctttggcacagagttgttattcaagtgaatattagctaccactctttgaggttagtagtcctggggacaattcttttctccccctaaagaaggaaagggaaaggaaactttctactgaggaggtagcaaatgcagaatcactgaaagtgcttgcgaagaatatccaactattcaaattatgaattagcaaaagataatcaggtgattgtgaactgtgggttgctgctgctttgttgtaatactgctgttaaaacccacgttagagatcacatggacacaggaaggggaatatcacactctggggactgtggtggggtcgggggaggggggagggatagcattgggagatatacctaatgctagatgacacattagtgggtgcagcacaccagcatggcacatgtatatatatgtaactaacctgcacaatgtgcacatgtaccctaaaacttagggtataataaaaaaaaaaaaaaaaagtcaatagtactgcagaaactcaggcttcttgttgggtcggggagtggcgaaatgtaaagggagtaaaaagggtggtagtctataaaggaactagccatccagccacccagaaaccaagtccctcttttaattaatagagttatggagaggctccagcatattaataaatgtccccctatgggtggtgagaacgtcaaatgtgaaacagagcatattggattttgtaataaaaatacagagaattataaatgagatgtccaggaggcatctaagttaaggacacctaagatcaagaatttatattctagttgataaaaagttgtggataaaattagggtgctgagatggaaaaagaaaggctcctgttggcaggaggaacactgatatgaagtgatgggagagttttgatcaagcctgtatctttggtatttaatatggggatgcgtagagagtattagaagccataggtacagccacatacattgttaaaatgtgactttttgtatattatttcacgtttgagcaattaccaacttactagcagttgtacaaaaagtaagccattgtgaatttgggatgcattttcacatatacattgtattagaccattcttgcattgctattaagaaatacatcagactgtgtaatttataaagaagaggtttaattggctcatgactctggaggctttataggaagcatggtgctgacatctgctcggcttctggggaggacttaggaagcttacaatcatggtgaaggtgaaggagaagcaggcaactcacgtggcgggagtgggagcaagagagagagagtgggaggagaggtgccacacacttttaaacaaccagatctcatgaaaactcactcactattgcaaaggcagcaccaagccatgaggaatcttcccccatgatccaaacacctcccaccaggccccacctccagcactagggattacaattcaaaaggagatttgactggggataaatatcgaaactatattagacatgaagctgcaaattattatttaattcatattctagcattaggtataccagaacaaggtatctgggtaagagaaagtcgatatgaagggcacaagataatggaggaagacagtttcttctatcgtctagggactttgagccaattcttgggaaaaaaaatagatgatgttgtctttgatggtccttttgttgttgttttgatcctcttcttcaaattcctggtaccttttctttctgactaacagaactctcttgttgtaaaacagcccagtgaaataggtattatcccaatgttacagttgagaaaagggggctcagaaaggttttgttaacttgctcatgccagtataataaataggaaaagccagtttcataatcaagtatgtctggctctaaagctcaccaagtccaacatttttgccttggaatgtgtaagttaacaatgcccccactaacaacatgaagcaatacagaaggaatgggttgagatggggtttgggcaaagaaaagatgagcttggttttaggtatgttgattttgagctaccttggaaagccattttctgttttgtggttgcaagagaaatcgtggtttgttgccctgtgttagacatgggtaaacttagagtgttccatttgctgtagaattagtggaggatagatagatgggatatataggcagagatcgatagatagttgtttgtacattggttgtttgaaagttgagcaatgtctgcagtcactagtcagtatttctattgcttagcaactctatttcctcatgtagccataacaaatggaacttttatatttattttttatgcttaagggtacatagtgctgcttataaatgatgcataagtgacaattttatactgtgagcattactctgactcttggaatcatagaatctcaaggttggacgggaacttaatagttggatttgttctatattcagactgctttacacctccatgaggtcctgactgacacatactactcatttagatagtgctccctatctgaaaagtcttggttttcagataacattttctttcctttaggcaaattattcctgttttacccatgaaggacaaatccaaatatcttgtcttcatgagaactcattgcacatttagaaataggccccatgtctctgccaattttctctttcctgggctgagcttcttctccatcttttcagtggctccttggagagatatattccttgagcgcaggactctttagcccaggttctgggaatgcacctcacagaaggctccagtgtcatcccctgcaggcattgtctcactggcagagagccactcatccatggccatagccttttccggtgtagtccccatctaatgatcaattcagatggggtataaaagctcagttatttcagtccaatatgtgacaactctgacaagccattttagtctcagagctgctcatggggtcagctgagtctattgttgggctgcattgcaacttgatttgttttctgttccttcttgagtccttcccctccctttctcaggtgttcattcccagggcataaacattctgcctgccaactctgatgcagagtctgcctcctggggaaccaagcctgcaatgtatgacttcaagtcttcttatgaaaccattccaatttgtttatggacttagacttctggagtggatagatacctctaggtgtaatctcctgtgtaatcagaatacattttgctttgaagaatattttaaattaagtaagattccacaaatctaatgtgtaaagctcatgcagtagaaagttttcagtgtggatgtcttagcttaggttccccctcaaaagcagagtgtgaaacaaggacttacatgtgagtagtttatttgaggaaattatcccaaggaacagaagtgggagactggaaatgattgttcacaataatctctgtcatttcatagccatagtttttcatcaacactttcctaatgagctcatctttgggatgccaagtgacattgctgtgtgctttcttcaagagatctgagcaatgtagtcagacagccaattaacatttttatttactttgggaaagctttgagtcctgagacctgcatgagatttttctggtagtatttccaactgtctaacaaaacatgtcaaaaatttcatatttgtcgttccaggaattcagcttaataagactacacagaccaggactgagaggttggtggcaaaggaaggagctactgagagccacacatcaataaaatgagatatccaaagcatggaaggagggtcagtcaaggcaatgagggatagactgggatcagttcaggaggctcctcccagaaccaggaatctaattaggagactgaaaagaaaggaagtgaaggggccccaagccagagagccctatgtataaaattatacatgattttatatatgtaagtcgtaatttaattctcacagaaatattgtgaagaatgtgccaatattattatcaaaactatttagcagatgaagtaactgaggcacaaagaggccaaataaattgtccgatgttgcataggtagtaagtggctgagcctgacttcaaacctcgatagacttttcccaaagttcatgctcttctgaatattacttatttctcatgtacctgtttctgaggcagaggttctcatgtattataaatttccttgatgaaagaccaggactggttcagaatgtgtgtgttggagaagaggggtgtaacagatacacattttatagacctccttccatcccatccatctgggcccactgcatcttgcactgcaccactcagggaacttcccccttgcccttgtctgctactatgtatctcggtcagcaagttccaacttggagtttctggctcttcttgccacttcaggacttggatgagatactaagccatggggcacgcaatgtggccccacatgtgttggaagaagccagatgatacaccctggacatgaaggagagttaactccttgtagggtgaaatttgaccagaggagggcaatggacaggagggaagtggctaaattccctcatcttgcactgtccaatcgacttctctgaggcatgagtttttcttctagctcattctttcccttgtcaagtggacacaccagcaaaggacctgttgcgtctctttgtggcttagtgtgaagtgataggcaggatagtgatccttcagttggcattgcttggcatcttttcttgcctcaatttccttctagctcattctttcccttgtcaagtggatgcaccagcaaaggacctgttgcgtccctttgtggcttagtgtgaagtgataggcagcatagtgatacttcagttggcgttgcttggcatcttttcttgcctcactttccttctttctaatccttgtaccctgggtttacccctttcaaagaaagcattaaaggccaagctaagaaaatgggtctggactaaaaagtggaaacaaatagagtagtaggcatagttcttaacagcacttcactgttcagagacaagaaaggacatagattctttgaaaaataagtgtagaacaagttagatgttgatattatgactaatgtgtaagttccagtacttaacaagaagttgttgtaaggtgagtatttatgaagaagggggagaagggaagaactccctgatcaggctgattttaagtcagatctatttactgcctgttatgcctgtctcctcttcctcttcatgttgctaatagcaaaaatagccgctattttctgaacacttaaatatatgtctgagaccatgctaagtgctttatgtatattttctcatttattcctttgaggtagaaaattgagactcagagaagagaagtagctgtcaagcagctaatgagtgctagcaccagatttcaaacccagggctgactaactctgaagcccatactaaaaatggatttgttctgctgtcttctgcaaagttccttatcaaaggaagttatctagagcagaggaaagccatatggagaaaaaaatatggcatgagagcatcttattcattttgttcttatttgctccgaaagcaacttctggtggagccagctgctggtgtttggagtgtctttgccttctaggaggaaatactctttcctaggtgccacactgttgatacttctcaagaccaaaataccacaggcctccagctccttgataaagctttaatgtgttgaattggcataaatcaattccctaagtctgcctagcagaaccaaactctgaatatggtgacctcacagggtcacctagctcaaggcagccagcaggcttcctacttgatactttctttgatagatgtctttaggggagccaacttttctttaacatctttcctttgactctaaagctctcctctcccaacatttcctctcctcagtttaacccgagttatgtgttcatgacataaatagggccacgtttgccgctgaatgatgtcacagtgcaggtgatccacagatagagaatacaaatagcatttgacatttgcctttgggatgccttatactactttttatcctcccagtaatgtttacattgttgttttgtttttgttttttgttatttaaatgataatggcaaaagacccttgttaagagtcatgagatctgggatctgattgcagctctgacttatcatctggatgtgactttgatctgtcacctggtcctctgacgactcagttcattcacctgcaaaatgggagagttgggagagattatttattcttaaaccatgctgatcatcagaatcaccacagatgctttttaaaaagggcccatctcagagtcctgaatcacacttcaggtgaagggaggagaaaggagattggggagaggagcaaaggtccagaatccataattgcaacaagctgcctgggtcattctgatgcacagtttaggacaactttatgcaatactgccagttgcacaactccaaggggtgccacttgcattctacagactccatgggcacagttcacatgaaatagaatctgaacagcccctcttggtattgtgtaatacagcagccctgtatgagctgattactgtatagggtcatttgtaagcatggatattctttgattggatgacagtagagtgctttgaggtcctcagtagacagtagccctgtattagttcattttcactctgctataaagaactacctgagactgggtaatttatagagaaaagaagtttaatggactcttagttctgcatggctagggaggcctcaggaaacatacaatcatggcacaaggccaaggggaagcaaggcacatcttacatggtgacaggagaaagagagagagagagtgaggggggaagtgccacactttaaaaccatcagatcttgtgagacctcactcactatcatgagaataacaagggagaaatccacccccatgatccaatcacctcccaccaggcccttcctctaacatgtggggattacagtttgagatgagatttgaatggggacacagagccacaccatatcagacccataagcatgtggttacagatgaaggcacagtagctgtgaccaataggataggaaagtggatggcttaagaacagctgatgaacactgccccatacaaagctgactctcagattgtctcccacattatagcattacagctggtgcccatctgacaagagggagaggtgtgtgaagaaagcaggatgttgagagcagcgtgagccaaacagcaggacctcgggtcatggtttccccaatagggttgaattgaggaaaagaaacaaggctttctcccagctaagaaaagcttttagttgcctactaatttctgtgctttggggtttctttgactttgttttccctttacacatggtgaaattccttttgaaaataaattcagccctgtcttaaccaaaaaaaaaaaaaaaaaaaaaaagactggtaaacctgtatggagatattacttgagttcctagaagccaggttttgttagtaaaaaattggataagtttgggtacttgggcagacagaaagttgaaaatctggggaaagactgttagcatgcagttgtgattacattaaatgttataaatgaatttttatcagaagctattgagatgctgctgagctgacttgaggtattccattgtctagaataatactctgcttaatttgcatgagaatcagttgaggcatttgtcaaaaatgcagattcctgccacagccccaggcaattctgagtcaccgggtatggagggggcatctgggctgtgcattttacatgagcatccaaaaatcatgctttgagaatgctgccctagacaactgatggaaagacagggaactttgttccagaatacatcctgtgttccttggaaattatattaactcctctcagccttagttttccctcatgtaatgtggataaggatacttaccctttccaaaatcagaggtcttagaaaagtattttaaaaaataaactggataaaagaggtaatgctagttacttagaataggaatttatgtgaataaaagtctatgtcttgggcttctgtaaactcacctctcaaccccagcatacagcacaagaatatggaaatagaaggaagtatgtatgcatatatgtgtataaatatgattgagattgtgtaggagcctgtcttagtccatttgtgctgctataacaaaattataataaaataccaccaactacatagcttatatacaacagaaacttatttctcacagttttggtggctgggaggcccaagaccaaggagctagctgactcagtgtctgatgaaggctcactttctcatagatggggcttttttgctatgtgtcctcctgtggtggaaggggcaaggcagctctctggggcctcttttataaggacactaattccattcatgaggactctgccctcatgacctaatcaccttccaaacaccctgcttcctgtcacatcacatatgaattttgggaggacacaaatgctcagaccataggagaaccttggaaagatttctagaaagtcaaacaatagatttttaagaagtctattttctaataagctattagttagtgcttattagaaaatagaatctgccaaagtaatgtaggaggagcatttatcaaggcagattgatagagacagctcagtagataaggcaaacaaatgttgaccagtgaattatattcataatatattttgtatttgtaatatattttgttcttatttagagaatgtactaattagggtaaagtatagctgctgtaacagagaaccaacaatctagtggctcaaataacaaagaagtttatttactgctcatgtagcaatcctggtatgagtagtcattgcctgatgagtaactttgctctgcatggtcattcggtgagaggttccttctatcttgttgccctgctgtcacgtaggacactgccatcatttactttgcagaagctggcttgtcacctggaaaagggacagagaacatggatcatcataaagctcagacctggaaatggcacatagaacttccattcacaaaccactagtgagcttaaaaacaccaggatgcctaagtgaaggggaggctggggaatgtagcctatcaaaatagccatacccaaccataactctattgttactgctgttgaagaacgggagaatggggttggtgactaactagcagtctctgccatgggaaggtatacagaactttgaaaatggagccaattactactttttatggcttcactaattggccagagctactactgtgctgtggagtatcagtgtttcctttgatgtgttgttcctagcctctctatgggcttatatctagcatcccaggtaaacctgagagttatcctgggcaatgtggatgctggtattccattttctcaattttagggttctcctcctgtatcctgtacaggtcatgagaaaagacttgttgagtcctatcctactgttaataaatgtgctgttgataggaaaatgttggcagaagtgccaatatgaatagtcttctagttgcttttctgatggttgtgacataatgaatctcaaatgtgacttttgtcatataattggaggctctgaacattaagaacattttcttaaggatcatccaggcagaaaatgagttcacaggtttttaacatttttactgatggttcccaaggctccacctgtcccttcattctattctatactgcctctttattggatttctcccccactgcaacgtgtgtgtgtgtgtgtgtgtgtgtgtgtgtgtgtgtctgtgtgtgtgaggagagagagacgagagagagaggagagagggagaagagagagagaagagagagacagaaagagaaaagattgacaatatatttcagaattcttaaggtttgctcctcattattctgtgatgtgcagtactattcataacagaaaggtctgataattagctgccttgggatgttctaaaggtgaagccactctcctgcaatgcatcttgcaagagagattagtgatgtagactggaggttggcatgtgacagagactgttaaggacaaaagcagattgataacagtgaaagctgctgcttggacaggttcatggatttagagagcgacctccccgccatgggaactggatccctatgaaactgtggcatgaactacaatgagatgaaattacctcagagaaaaatctgaaggcacatttgagggttgggacattgcttaggaagctgattaccaaagacaaaaacattcatgtgtatagtgggagaatgggagataggttactctttaaatagctagttggcattgtcattgaagtttgccttactggaaaaattatgcagctatttctcttttcagttttatacacatgcgcacacacacacacacacacacacacacacaccatatattctggggaagaggtgttttattttccttttgtgtcatgatttcatagacccttatattctctaagagatctgggctttcagccacattcccataggattctggaatttttccctctaccctcagcctgccccatcacccaagtgtgatttttgtgattcttgtgtttctctagtgtctcaccaactgtatttctaaagcttggtcagtgttccatcttggatttcttgttttgccacttgtgatggcaatttataataaaaccaagatatgacctgttttgtatccagcaatgaaacaagttggaatctgcctgtgatgtgcaatgtgccttcaatgaaggggcagctgtgatgtgaatggatcttgggggagagaaaggaccttaatttctcttctcttttcccatggatataaaactttgttatggtaaactaaacctctgatatcatatgcaaccgctggcattctagattgttttaatggccactccttattgcttcatgctaagcgttaccatctgtttctttcttaattataaatgcagcaggaattcacaattacatcagtaacggtggaaataaaatggagttagaggctttctacttaacacaaggcagccttcctctaatatttttcttctgttacaggcattggtcagagaggagactttttcagtggttttcttttccctctcttcagtatacttaccatgagaatgtcatgctataaattcagcaatttccttttaatgagagggagagctgtgtttattttctgtccatggagctggggatgtgtgggcagctctttctcacagtattggaaaccagtggtgtgactgtcctgctgttattggcctctgtttttgtgaaaacagatgagttataatagcccaatgacatgagtcatgtcatcccccagaggagagctgggagtggacatctaagaaactctggtagccagcctgcctgtctgtgaatatatgggaacatttatacagggaggtgatataaaagctgaagacatgtttaacccagattacttaggcttttatttttcattaagtggaaaaactaatcaaatttcagactcatgaaattttagtgctaaaagaaacccttataaatcaccttgatcaaagctgtagtgactgccctttcctttgtgtagtgctcgaccaggttgagcacgggatttggagtcagcagaacaggtttgattctgaagccaccaccatggactttgagtcctcttcactgagtttttagtgtcagttctctttatccatgacaggagacatgatgcttcttatgaagcctatgtttggattaaatgagagggaacaagtaaatcctagccattgtgtggccggtctgtggggtttttttccccttctttccattcacatttatgatagatgaagagatattggtccagagaggttaaatgccttgcccaatatgatacatctagttcagggtggacctgaagtagaagtagttttaaaactctatttcaaggcttttgcttactatgtcatatctagaccctttgctacctttctccatccttgtcaccattgtacaaggatatgtacttttgcacaatgaataaccacaatggttatcatgtgtatgatactttttaaatctgtaaagtaccttttaaaatgtatattcccatttaacatgaagtaggtgaaatagtgttataatcttttttttctctctctctttgagacggagtctcactctgtcgcccaggctggagtacagtggtgtgatgtcagctcactgcaagctccgcctcctgggttcatgccattctcctgcctcagcctcctgagtagctgggactacaggggcctgccaccacgcctggctaattttttgtatatttagtagagacggggtttcaccgtgttagccaggatggtcttgatctcctgacctcatgatctgcctgccttggcctcccaaagtgctgggattacaggcgtgagccaccgcgcccggctgaagtagtgttataatcttatccttcctcttattttaagttggaaattctgaaaggtcaagtatcttgttgaagtcacacagaaggctgagtcaggacttgaaccaggtttttaagactttccatatatgggcttcactctatactagatggactcttactgttacaccagtacatgtaggagaggactgaaagatgcagtaaaaagaaatcgatattattatctataatttaatagttgtagttaggactttttatgatgtgaatactataagaccaaaaccattttcttgaattatattaatattttagcgatccacgtgctttttacccaccagaaggttcccctgggtaagtaaagaggtggagcaggagagagcaggtttgcaccgaaagtagttacaaaacaaaacaaaacatataagacatcaaccacaagaagcccttgctccaaaatgcaaatgacttatttgctacttcaaaaatgcacctcatcaatgaagggatcatttgatcatttgttcctgccaagtttatgtttagtccaggaagggtcaggctggtgcatattctcacccaggggtctgagagcacagtggcaggtgtgaaaagagtctttgggccttgcacttgccttttcatgccaatgccctcatccaaataagaagtcccctttgcactttcccagcttctaggccatatgttatgtctgtttcttagagggtgattcaatgattcctggtgataatgacatcacactgagttttacttacatcctgtttctcttgtataatgcccatgctcctcttgtcatgcggtcctgagccatcagggcccactctataaagcttcctgaaaatcaggccttcctggcaacaaaactaaatcttttaatctcagaaaccctactactgaccatgtatagaaaaccatgcaaatttaaagaatgtaaatattgacattctcaggttttcccatgtaacctgatttagtctgatttccctattatttctgccatttctgtgggcattttactgaagccaggttttataaagcagcccagaagcagcatcgttcataaggtaagggcacaggctgtagtatcggccagacctttggtcgagttctggctgtgcagcttgactgtgtgatgtcaagtaagttctcagagcctccctttccccatctgtaaagtgatgataacggtgcccacccattagctggtgctgtgaggatcggatgagctaccgcatgcaaagtgcttaattacaggacaatgttttgcctttctgaccccccagaaccagatgaatgattcatttgtgatgtttttctcttattaggaagctttagctggacaaaggtcattcaggattattttaacatatgaaatgcatttgttttattgaaagagattagaaatgttattttgaaagttttataccttactttagaagtcaagtcttataacattagtaggttttcacttcaggttactttcatgttctgtcttttcactgtgagcaaggtggtaagaaagccattctttctattgtcttgtatgcgaatgtgaatatatcctctatgtgccaaatacaacttcgtgagcatattgtttgttttaatgtagccttttaatgtcagaaaaaaagtctcaaagttctagtataataataatgattaaaatgcttattaaagagcacattaaaagataaggctattttgaggactcaggggcatataaacaggttattattttttcatagatgtattaaatcagacatgtgctagccaaatgtctgaccttatataggttttcttcagagttttacagaaataatgctaaaataaaggaatgtgaattcctttgccagttctttgaaggaaatggtagagtctgacctacctcgaaggagtattaagagaaacaacctggttatattgctggaggcttagagtctttaaatagtctcagagatcaaatctccctcggctacatagaatgattccatacgctttcttctgaaacttcctctctatctctaaatggggccattttgagcccctcatgaggaggcgcagtggaagaaaaatgttctgctgagcagaatctgcaagccatgccacatgcagacatctcatctgataatgacattctcactctgtagaggccaggaccaactgtgttatcctctttctcctgctcctctcctcccacctcacacatgcacaagcacctgtcaaccaacatcctcataccccttcttctcttagaaaggaggggcttcaaataatattctagggggaaaggtcccatgactctctgataagaagaggaatcctttaattctactaaacatgcaaaagcattgagcaagcaattaggcaaccatgtatatagctccagatgtcccatacatatggacaattgtccacactgctggtggggctggcagcattttaaaaactggttacaacacatatggtcctttgctttttgctctggcatctgaagtcttgctaatccaaacacatcatcgctgtggtacttccagcacagtaaatacctatctgctctcaagttacaaatgcggtgtgcttccctagctcaaggttgtgggtaaattaattcttaaatgaaagtgagaggcagggagctttgcaaagagaagaagcatgttaggtgtaggaagaggaaattaaatggattggactctcctctatcttttcagtgttttggccctccacccattaaaagctttcaagctttattggatgatagtttctaattccccttctagccaaggctccaaggtatgatttcaggatggagagtaaattctttgtgtttcccatctctcagaaaaattgcttatcagctaaagttttcgaagagtcagtttatgggaagctattttggttgtctagctacttatgttatcattattcagtctaaagtcttgcctattgctgaaaactttatgcaaaacaagatattgtggttatttatttcttagccattgctttgttgtttacacacccacataattaccttgaacaccacaggaaaaaaattgcaaaataatatttcctaaacacactttgggtttacaaagtgattataaatggcttttaaagaaagtaattcttgttcatttcattgtattcaagcttctctacttaattgtgctgtgtgtgttggaggattgtggtggtaagttgagatatgtagacaaaacagattttgtcatttttttcagtagacaaaattataatagtgtggagatactgtcattttaaaattaatctgaaaaacatttattgagtactttcaatatgtcatcagacaacttcacctgtctttgcgtatgaagtttttgtttgtgttttgcttcgattagttttgtaaaaggagacagcaacccaaggactttatagctataaaaaggcaagggtggttactacaagctaaatatgagaaaaaaacagttttgattcattccttgaatgcctccatcacagagcagtttttagcaatggaagtaagattgtgaaaggaaaagaacagggccctttacagagctccaggaatccttttgtggtactttcagcaagtattggtggtagaaaattaatagatataataaacactgtgaggttggctggcattttatctatcccttgaacaggtttaggaaatataattgacttgtgtccacaaatctgaaatacaatttttttgtgtgtaatagtaattttccctgcagctttggcattcttttttccattaaacgtctcagttttcagtgaggggaatacatccttggtcctactttgtcattttgggatgatttattttaaaattacagtaagggactttgttcggaattccactaggctaatttcaaacccagtttgctgactccaactcgccataatgttccccacctccagcacaccgaacaggaagtggcatactcagatgccaggaacaaggcgattgctcagatggaataacacttggcagtttggaaaaatttgttgatgtaagctgaaattgtaggttagatactgacttgtgggatacatttctgccaattatggtccattgtacagtcaaaaatgggaaaaattacttactgcagctggctttttggcattgaaatcactgatggaataatcagagggaaatcttctaagttatcataaaagatggattgtgacacaggatgtcagtttccagggttatccgttttacctgcctcacatgactggaaagctttttgtttaaggaaagaatcaaagagccagagaactgttgagcactccttgacactgacttgcccaatgataactgattcctacaactagccttcctgtcctgctacttcaggggcctatgtttttaagagctgcagccttgggaagattttttttccgtgcctctcctgtgtccaaagctcctgaagcatctgtaacttcctattccaggagtgtacacattctgtaactagaagcctacagctgtaatgctgaacaccaaaataactacagttgatcactggaaacatgcctaaggctgaacataatttttcattttcattcatggatttgtacatattctaaaaaaaagttcactctgaaaataatatttgcataaaaggaaataagagaaaacatactacccacccatgtagagcaaatgagctacatctctttattgatgaattttaagtcatttgggtttttccatacttatttctcattgaatgctccttttccagaagacctcacagttgtctgactgtgtcctccatcacagtcctcccagtattcaggacagatcttaggattcctctcttgagggtcacgtatccctgctttgtaattcacctcctctgtcctctatttcaggatgctcggctctaaatacactgcttgcctcaaccttccctttggattgtaagttccttaaaggaacttaggcagccgatgtttcagcctccccagaatctgcctcctctttttctggaaatagtaccttaattactcaagagaacctcctctcccactttgcatacaggccaagtggcatcccaattaagattttcttctcgtttctgcctggaggtgatcacatgattcagttgaggctatccagattatctctgccctgagaatttgagctttgagtagaatccctgtaagaatggaaaagagagagatctgattcctcttaggagagttttctgaagagaaggcaggatatcctgctgcttgccttgacttgcctacttcccttcctttataagccccggttgagtagcttcactttagagtatgcgagttgacgcatatcttgccaatacatcttttaattttgtcccagttggcccaaattggttggtttttgttgacaaagtatcctaatacagcctccatcttccagttcctatttatgtgtcatgatgatctgaagcatttcaaaagaatagtgaaggttattgcataagattcagaaagttccagtattcaatgggatcatagatatgaattaaaccaaaaaatattctttattatacaactttatttcttcccagagttttagaaatgtgtgagtttaaaatggagagttcgagcaggaaataactggaaattcatgaccattatctttaaaaatgattttttaaaaattttagaatagttttaaatttactgaatttttgtaaaatagtacagagtttccatatagcccacacccagttctcccactattaacattttacatcagtatggtagatttgtcacaattaatgaacaaatattgaatatttttaactgaagtccatagcttatttagattcctctgtttttccttaatatccttttcctgttccaggatcttatacagggtaccacactacatttgaagtcacatcctttaggctccttttggtgtgatagtttcttagaattttcttgtttttgatggcctttacagtttggaagagcatggtcagatattttgtaccatgcttccgattgagatttgtcatatgtttttcaaaagtttagactggggtaatgtgttttagggaggaagaccacagaggtaaattgccattctcatcatcacatcaagggtgcaaactatcaaaatgcttattgctgttgatggtaactttgatcacctggctgaggtagtgttcatcagggttctctttcttttttttcctccttttacacattgcactctttggaaggaaatcactacactgtgtgtagcccacactaaagagttgtaaggtgagagacagacaggtacaaagaaagaggcagttattaattccaggatttaaaaaaacaagatggcattatactccacctctttaagggtgtagtttgtatatatatattatccataattcttccacacaggagatttatctattttccttttttattttatagcttatttatattaatgtagatacatgaatacttattctataagtactggttataatctagtactagtttatttattatgttgctcaaattgttacagccttggccatggccattgggaactctttcagtggctcttgtgtccctttggcatactcccattgttgtggggttttttggtttttggtcttttttagcccttccttactttctggcaacacaaaatgctcttggcttatctctcatacttcctgctccagtcctagaatcagccatttctccaaggaaccctggttctttttagtggagaatggcattaaaaatatgtatctggtgttagttatgctcattacacctagagtgtcattgcttctaggtcttctcagctgaaagaacaagaagatgtatgtgtgtatactaacccatctgtatacacatatctataagtatttctctgtgtaatcatttgtatctattaagataaacatgaacacatactgatatctccaactctaatctttcaccacattctaactttgtcctcttgcttttctgtaagatcccaatagtgaaaatctggttcccttcacccaccattcattgtccagttccagcatagatgtattgtttcagaattgttaactcatactcctgtggagaacagctgtatcaactagagtacagtgcttatagtgcagttactgttacctttagccgtatagagtgtactcttagtgtaccttattccaaccccctgcagtgacgttgtttcatactgttctctttaaaattatgttttaaatttatccaggggataatgcatagctaaagatgacaattcgtgctgataggcttataataaaaactagcagcccctttctctcactccttgtgcacctttacctgttccccaagaacaacactttcaactcttttagctgttcacatcaatttgtctaaaatctaaataatgtactttacagcttgagatatcaattttaaacattatacattgatttcctattattgtaggtaaggatttagctttattgtacctcctttccctgacctatttctttacaacatagttatttcacattttttattaaatcaacatttagtgtttacattgctttcctgtttgtttttttaaatcctgggaccaataattgactctttctttgtacccatttctcaccctataagacttttcccacatgatcaaacttaccagacagtatccagtttcttcttactcctagttcttacttcccaggaccctctgtttactcaggctgcttcattgagtgtatttatgcatagctaggaatagggctgctggtgtctgggaactgaatggggaaggagactaggtgggtggggggttctcattgtcttctatgtaggctttcatttcacctccttgttcttagattgatgtctcacctcacctcaccttccactgtgcccaggtcactaagtcacaagcctttctgagtcacttacagtgagactgatactactatctcctggcattggaaggatgtgggtttcagttgcctcattgggcatgaagggcttagggacctaagggtgtatatgcttttcatactgctttctaaaaaactttctgctttcaaccctatgacttaccctgctttagtggtatgtggtacctctaattcctgcaccttcctaaggttcttcgcagtaatgcatttgtttctctcaggtataccctaagattgccccatgggtacataagttactctagctttactgtgctgagtcagtaagaattcctgtatctgcttgacatcttcattttgtgtggttcagtgttacagatgtctttcgcctttttttttgtgctgttggttgttgtgagaggtgattgtggaaagaaaagggtgtgccaagttaaacctgaagtcccatacctggtctacattttgtatgaccacactaaactcagctcatgcgacctctttggagaaggtactcctgaatcttccaaagtaagtttctttgtctttggcttccacgtcattctgtctgtggcacatgccatactcttgtcattttccccactagacaataaacacatctagggcaggaatcatatctaactaactaacgtatgtgtactgtgaactctgtgctgctgactctactagatatcctcaatgtgtacttacttaaatctaagaatttgctacattaattgtaaactaaaacctctgagatatattatgttgctcaggtaccatctgagaagttatgtgtcaatgttgggctgaaactagaatttcacgttttaaagccttaaactggttttatgtcccacaactatgcggcccctggaaggtattcttgtgtgacctagaaaagattggaagaaattgaggatacttcaattagggaggttccccaaataacttgatttttctaattagatagagatatctttcatatttaaaattttatttctgtgcagatttgctgtgactttggtgtggcctaatctttagcagtaatcactttatcagtgaaatttaacttagaagtccagttagggttaagataaaaaggccacatgaggtaacaaatgagaatatgtactctggagttatacagatctgagtttgaactttagctccttcacttaccaaataaataagtcatcaacttctttcagcctcaattcatctatgttaaaattgggataatagcaatacaaacattattggtctgtatgaagattaaacaatataaaatatgtaaaacagcataatgcctggtatgtggtaagctttcaataagtgttaccttcatttgttatatatatcatgacagttaatacaatgctgagcgaatatttgatgattgtctgaaataacttgaaaaagtttagtgaaaaaattgggggatggaggggttgggaactgggcacagacaattcagccatctaaggaagcagtggcactttcttcactgagccctattaaattgaaagattgtgttctagcaccagggaagagtagctatatgaatcatttcttatgatctaaagtccattagctactccatttagctgttaatgttgcgaggccattggcggaaataaatatgttatttggtaatggacttgttttcttaacaattataatatattctttccaaatgctgtaatttaattctgccattgtgctaattagtcagccgatcagccttcagcattgtttcaatatcccacccaccacatttttatattaaagctcatttaattggtgttgtgggttgaattctgttcctccccaaattcacacataccctaacccctagtacctcagaaggtgatcgtatttagagatatttcatcttgaaaagattaaaattaggccattaagctattagggtggggtctgcttcaatgtgacttatcagaagaagaaatttggacacacaaagggacactaggggcatgcagagggggaccaccttgtgaagagacagagaacaggcggccatctgcaagccacagaaagagacctcagaagaaatcagccctgccaacagtttgatcttcaacttgaagcctccaaactgtgagaaatacatttctgttgtttaagccaccctgtctgtgggattttgttacagcagctaagcaaactaatgtggttggcattgaggagcaaaatttagactggaatttctgatttattttattctgtatagcttataaagcacttatcacacacgccatttgaacttcacccaatcctataaagtaagtgttattattaactcccgttttacagatgaagccattgaggctctgagagtctacacaaacacatagctgctcagggggcaggtggaaattgaacctgggctatttgatttcaatccccctttctttttatgtttctcatttctctccccctttactgtgaatgtagagcatgcacctgttcttttctattgcagttcattcatttgtgcaactgacaggttaccactggtgactgtggattgctgcctaatgctgggctgaagaaaacaacaaatttgccaatctcaaaagagagcatttttatttattgctcagcttccagaacctaatgcctttcaattttctgtcattgttccactgaaagtgaagaatgtaatgttgatatacctcttgttttttctgcttttatgccactccatgtggttagaccaccttttaggtgttcattcattccacaaatatatactgagcacctgttttgagccccgagtttggatgtcatgtttttgaggcaggagttaatgtgctcagcatgaagagctgggtctgcacagaaaactgctgcttcttgagccagggaggtcttcccatgatactatattgcagcttctttgctgtaatgaaaatacagtacacctttccccaactcccaaattaagctttcagtgttcttcattctctgaaaaacttttatagaaattctaagaagtgtgcctcaaaataatatagtaagcaacctgatattactggttttatataatcttagtgcactatcttattcataattaaagttacaacggtgactatgtggaagtatcttggaggagaaagtgaatagatgaggtggggggacatttgagtaataactttgattttggatgtcttctctactatttttagattataatttaaataagttcatgtgtattatattatttcaccaaaaattttactttaagatatggagaatgctccatttttccccgtaagagtagcaataatttttaaaattgtcttttaaaattagattaaattacttaattccagagacctgtgttgttcttgtgtgacaacacagagtatgcaactttaagttactggccgtctaattaaaaagatgtttccaaagtatgaccagcattggaatttgttcagacccatatttataaacagtaactatgacaactcattcctcccaaccatgctcaacccctcatactttcccaactgtctgttttacaagatgacataagtagagggtttggaaaaaagaaaaaaaaatctttggatgataaacgctttttgcaaacagagcctataaagctgtttgttcagcagcatgtgaatcggacagtgggagttcatcagacagcaaggattaaccccctaatttgtttctctcttttggaagagaacagactgctgtgaattccgtgtactcagcctgagctgccaaacatgattgaaaactatttgactgactggtggccaaaacatgaggcagggaccattcatcattttcctgctcttcactaccccatataataagttttgttttgtttgaaaggagtaaatgtatgttacagttttcaaaccaatgtctccgacaacctaaaagcatttcaatattgtacccttttccaatagaatggaaagatgctacatatctgtagcaattttaaccaaattccttctagttacctccatttccaatgcagaaactcctctcaagtgaatacatacacaggttataatatacttgatgagccagtttctttaggatgagtacatacatgactggttttgatttgaccattgtggtgtgcagtgggcttactgtgtccataccagtgtcagaatagtcagtcctctggtgcttgattgggtggcatagcccataagattagctgacttttaaaatcaaagtaataggaggactatgcaatggagacaactcctcaacattgacccatcccctcagtccagttccatatgttccattgggaattaatttcctgcaggcatagaggagtcgtaagagttgcctctgccagagaagccccatctttccttgagccaggagtcagtagaagatagtaggctacaaaccatttgactatacctctatgatctcttgccactgaatatagaaaaggagtataaagaagcagtataaaatatgaaattgaattgtcagtggctagatagttagacatatagtctgggtattcaaagggagtgccttttaaaaatgtgctcaacccccattagcccatgaaatgcctcctttccgttcctacactggcatatctttcaccagaagcatttaaccagattctagaacctgtccattgggaataatttagtcaccttcttcaacttatttttctctttttcccctctcaaatgtcattttttttcacatggctccagtctcaattctcctcttattttatccattgtccccagtaacacactcttctttgtccatctagtcatacatcaatccacctatctattcatccaatcaactattattgagccccaattacatgcatgtgaagcatattctcaaagcaccatttccctggccaagctaggatgataatgagagataagatgctctgtttcagtttggttattcaaagcagaccctataataaggaattgggagcaagtagtttatttgttaggtaattccaggaagcaacagtgaggtaaagaaggagaggaaagggggaaaaaaaacaacaaaataataaaggtgcattaagatgtgagaaactgcttataggcaactgggtttagtcctgctgggaattttttgagaaactttgtagaacgtgcctcagaattgtgcccctgaaggatgagaaagctgagatgtttatccatttacttcagtcctcactggctaagagttatcttgggggcattaaatccctggcattttcaggatgccctcccagtaggctttgcaagccttagtactggagagagccttcaggcagaaaagcagaagacaagggcatgcatagtttctgttcacctaggctgcaggtgaactcaaaagtggatgcagaggttttggttggggtgggggtaggggtgatggtggtgattccatagcatctgcttcaacctctgtgttaccacccccaactgccttaaatggaagcatatcagagtttttcattttctggtaaagagtaccagggtgggcatttactctatgtaatgtgcagaaacacagcactgtgtttagaattggacttactcatttcctgagtatatgtatagcttccctttctctacaacctcttttcagcagatttatgcagacaagaaaaatattgtaacccaaagcgccactgcaaatttccctgtgctgacattaatcatgcccatttgatttattatctatcatttgaaaagaatattttgcaactcttgtgcattgatttttttttaccaagaatgattacatccatgcagcataactcttctaaaggctaatgcagtttgcttttatcacccattcactccctaattatggtgttttcgaaagcagacactatacctggaaagttgggagagaaatatttgattcacccatctttcagagaagaggagatggatttaaaccaggctagatactgtaactgattattgagtatttggcttggggggcttaatttaccagctaccattgaattaattgaaatataaacttctgtggatattaatactttcaagagtcaaagtttaaatgccatctactttggatccgttcaaaatattttcactaaccctttataatttaattgactttttaacttttttgttctgttttgttttaacacagcgatctacccttttatgtaaccccttctgctccacatatcactgggctggggccaaaagtaactgagtgactaatatctgggaaatatttattgaatgagtgaaagaaatccacttgggatttatacccaagaacaaatgctcattaactgtaaattctccttcttttgaggttcatatatagatgctctatatgtgtttatcaaacacctatcaggttatgaaaagaatgcaagaatgcctctcttttctctccatttatccaaatctatcatttaaggccctggcataatttctccttctttaatgaagctgcttcaatttcttccaattcagtgcttcatatacttggctgcagttggggagctgtaaaaaatcctgttgactaggctacaccctagaaccctagatgatttaaaccagagcctttgggtgtggaattcaggcctctgctttttttttttttttgagacagagtctcactccatcccccaggctggagtgcattggtgtgatcttggctcactgcaaccccgtctcctaggctcaagcgattctcgtgtctcagcctcctgagtagttgggattataggtgcctgtcaccacacccagctaatatttgtatttttagtagaaacagggttttgccaggttagccaggctggtctcgacctcctgacctcaagtgatctgcccgccttggcctcccaaagtgctgggattacaggcatgagccaccgtgcctggcaaggcctctgcacttttttttttttttgagacggagtcttgctctgtcgccaggctggagtgcagtggcgcgatctcagctcactgcaacctctgcttcttgggttcaagtgattcccctgcttcagcctcctgagtagctgggactacaggtgtgcaccacaacgcccagctaattttttgtattttagtagagatggggtttcaacatgttagccaggatggtctcaatctcctgacctcgtgatctgcccgccttggcctcccaaagtgctgatattacaggcatgagccaccgcgcccggctggcatctgcatttttaaaagctcaagttattacaatgtgcagccaaggttgagaacaccactgtacctggatgtgattgctctcttctctgaaaacctaggaaacctcgatattaaaagccacctcttaaggacagttgtaattggcctagtattctggcttaagttactctgaagatcaactagcctaaccacccttccaattccaagatacctctgacagccttctggttgtccagttcaaatccttaatactgacatggaacttattcccagtgcagccttgcccatctttgggcagctctgaccagtccagatataagtctgtctctttgtagcttcaagctattcttcctgtctctatcactttggggtggggctgggagtgagggaatctttctaacaagtgttttaaatgtctgaataatctatttattcaataaacgtttatggaatgcctcctatgtattggacactgggctacctcattgaaaagcgatgtacaaattcctaggaggatttgcaagccagtcctcctttcttctttttcttcttcttcctcttcctcttcctcttcctcttcctcttcctcttcttcttcttcttcttcttcttcttcttcttcttcttcttcttctcctccttctccttcttcttcttctccttctccttctccctattcttcttcttcttcttctctttttattgtactttaagttctggggtacatgtgcagaacgtccaggtttattacataggtatacacgtgccatggtggtttgctgcacccatcaacctgtcatctacattaggtatttctcctaatgctatccctcctctagcccccaagccccggagaggccccagtgtgtgatgttcccctccctgtgtccatgtgttctcattgttcaactcccactcatgagtgagaacttgcattctgtttgttgttattttgttattaagctgccacatttctgacataaaagaatatctttggctgcaatagtgaaagagaaaatgggcgtaagctgcaacatgagaaatttaggtagcagagcgatgactattaaactttgagaagttttctgtttaacgttgtgaaatctttccttgaagctttaaatatgacatactttcatgtgattctatttatatactgccttgagggcagagggcaatgccctgtgttccttctgagggttccttctgagtgactctaagtctctagatgaggtagccctgaggaagcaagaatgaatgattaagatacttcctgatgatgtttttaggggaaagataaacaaggttgcttcccctgctggctggtgttccccatcgtgcatgcatccagatgaggtctccaaggaaaatcttggtccagcaatgcttgactgtgccagttccctgatgctgatggctttgctgggaaacaaagcacattaagggtggatctaggtcactctggacttcatacctttccaaggcaaggaaaggccaagccccaggggctccattcacattattgtgctcctgaggggttgcgctcctagacttcatcagtgtcactggaaatgatacctcccacagtcatttaatgaggtagtcctgggcatatagcacagtggagataggcaccttgtcaaacaactggtgctgcagaagtgctgaaaaccctatgctgtctcattggagggaaggtaaggggtctcagagactctctcctaggaattagaacatggttccacttactccaacctagaaacacatcagagaggaattttatactccaggaaccaagctaactaagatgtttccaccacctttttttgcctgcttagatttcagatccttctttctttctaatacaccaagccctgagatgacatgggttccttctaatctcagagtgtgaaattttctctctggaatttaattctggtttattcctccaccttgccctgctttatcctgtggcatatgtgatgccacaatgcagttgtgacttccctggatgcatcagcgttaaagcagacacaagcactgaaaatatgcagggccagaccagcaggtcccgtacagctgaagttcatcatggtgttttacaaccaaccaattactcaattcattttatgggttgactgtgcccatcttttactctcatgaagcattttctatcgtaagacagaaagcgagggaaaagtgctctttcagttccaaaccctggggcatttatgcactaataaccttcctcctttgtgcttttccaaagaatgtaaaccaaagcaattaaattaaatggagttaacattggcatggtagcataaatcaaacgtcaggaaattcattattaaggggttatcgttcctttcttatgagctatctagtatctgccttctctgaggtaaaaataagccaaaaatttggtcctgatataaatgaggggactgcatgagagagagacagacagggagagagagaccttgtgtttagcagcagataggcagacttgtgatttgtgggcgaaacatgtttatcagatgcttgtctctttgcctcttaatcaggttcttcttcccatggcatgctaagcaggcaaacacagttaagcagtttacctctgtactcaacagttccagaactgaaagtaaacagccttgtgtgtttaggctgcagccaccgggctgtgctctgtagagctgccagatttctccacatcactgattctcccagtgaaaagcaaaggcttcctcttcattgtgttcacagactgaaagttgcttgcaggattggcttccgaagttcagaccctgatgaaggaaaatgatactccgagtctgagggtggcaaatcagaagaaataatttgtttggattcgggtctgattttaatttcaggagtctggggcctgaaagctttctgctgagtctgaacacaaaccccaaacttctcaactcaggttgcttttaaggaattgtaaactatttaaaacctatatatttaaaaaattataatttattcccaatgagaggatcctctccccagccaacgtctattttgcacatgactttctaatgaactgttaacaagcatttatattaagagcttgctcgggcttttgaatgatggaagataattctgatttacatgagtgatagtttaaaattccaggtgctttatttctgtttattggggtgggacaggggaaggactaaaactgcctacaaagaccctttcaaaggcaaaggaatagaatgtataacattccattttgtcagcatgaggaaggtcttatttaagactctctgaacagatgtgaccaattgtattggtgaggaggaatgttggaagataagatgttctgctctgtttgaatgtgtatttttagcagtgtcctattgtaaagaagttatgcccattatcttttgacttgctttatcagattaaacaaagatgctcatctttctaggctttctaatatgctccctcaatgcaagtctctcagctccaatgctgtgtgttagagtgtgataccccctcctgttactcctatttggctgaatttcagaaatccatttagatactctcacggttttgttcagcattgctcaaaacatggcttctcaccaattctgactgtctctctgaaacatgattaattttttctatgtctatctttacactgtagagtttaggttgaaaatatacttttactgtagtctcttattttcaggaatgtgtacgtaagcacccaaatgaattctactctgagatacaattacccatgtatgcttccaactgaaagcatccactgaaaaaatatagatagagaattcagtagctctgactgttagagcatctcagtaggcaaaagtttccttacagtaattgctatgctttggaaacagcattttctgtgtactaagaactcaagggagagctgtgttcaggtcaaagcttgggtgaggtataataagaaagaaccccagctggagcagtgaaaaaaccaagaggcgagaattttgtcctctctgaacttctcggttagaagattaagagggagatataggttccctgagacatattcagaaactataggggtttctatggcaacagaaatgaaaaatgaaaatacagtctcatcttctcttgttaagatccctcagtttcacatgagcccaagatcaaggagtcaaatacagagaaagtcacagagcaaagagggagccatgtttcttttcgtccagcagatggctagcaacaagaactgcttagaagaccttcacttgttgaggaattgagagaactgttgaatttccttttttccaggtgatttttgggaaagattgaaaagttaatccaaagagttggttgagatagagcatttatctcacttggtagctcccccagtggaattgaagtccacagaattgctgtctcagaagtttcattctttggttagctgtttccaaagtgtaagtgagtccttcacaaacatgattaccaaaagtaataaataaatacatatctggcagtgaggatgattttttttggagatttttagttttaaaccacgtattttactggaagtataatgcacccatttcccagtggttacatggaaagacttcgttcctcttctggttctcccagcaatgacttttcagtcactgaagaattcagaggacaatgacaactcccttcacaggatcatacagacacctgtcatttgaatgcctgggaaaaggataggaatggagatgtatctggttggactccaagataaggaaaaacttttgatgggcaattggaatgtcagcagatttatatctccttgaacttgggtctgtcaacactgccatgagaaggaagatgtttttcccacagagagacatttatggggcaaagacagacatcagtgtgctaaatcttataaaattcctttgcatcatccaccttgacagatggtcttcaggaatgtgctgaacctccaaaacagagggttgggaggaaactcaagagtgttcttcccctgtcttctgtcaatgactacgacacactgaaggccacattgaccttccatcaaacatacatgcaggcttcaagccacccttccttcttccccgtaagggacaggttgaagcaaagatcatgctattaggtattaggtaacaagcctccacttacagagtatcctagggatgaaaacctttttgccttatagccatgctagcttcaaacatgagataggtaaaatcgttttgttttcaactttctttccatttacttccctttaacttttctattatgccacaaaggacaagtatgtgttttccttataaaaagaagttttggcaaaaaatgaagttttggtcctatagttcatagtggccccagaaaaaattgccttactatttccacaacaccattgcttgttttttgtttttgtttttttatatagtcccacactttcttttgctcctgtttcatttactaacttggaatgctcacgctcctgggcctgatacactcctaggatcacctaggctgggtgaagcttggccttcagaggagtagacagagcaggaaggatgaccactatggtcttagcttcctttagtatgacttccctttcttcagctggagtcccttccctaaacacctgcagccatcctgtggctttgcatagtggagcccagggactaacacgacagtggtctgagtgtctcagacttcgagactattgctttctcctctgttccaatctccaaaaagagttctatgagaataattgcccaaagagaaggtacttcatttggtagggctgggaaaagaggcatcagatagcatcttgatatggtgaaagatttgaacagacaaagatctatctggtgctagtttagttgccttgaatcatcattacagatccctctggactatttccctttagccaatcagcaacttccccagggagaaacttgagatcttttattctagatttctggatccctaacttgttccaatgttcctttctttttaaaattatttttagttttcaatttaaaattttttcaaacatattttttaaaaatgcagaaaatcagagaaagggcagcatgtatatattcactacccagattgaacggttgttaacactttgctatgttttcatcagataacttgggaagaaaggaaggaaggaaggaaggaaggaaatagtgcaaatatagttgaagttttactcagtatttcctgctctcttccctttcttccctatataatttacttaaaagtttgtatatattattcctatgtgcattttgattatttttattacatatacatgttctcataaaccacatagttattgatttttaatattataactttaaacaagcagcatcataaagtatgtatcctttttcaacttgatttttattcaacattattattacatttttaaagactcatccacattgatatatctagctctagttcatccattttaattatacgaactagagttcgttaaatggtatagttgctctaaatgccactttactatacaaagctgattatgtttcttgcctactcataacaacccagccccaaactgcctttccagtcatcgtgaattacatgttcttggaccctttccccttggtcctcctgtctttcaaaagatgtgctacattatgtgatgaattaattgtctgtgctttgaccccagtgagtacaaacagctttgtgagcagcctctttcaggtaagagagttcatttgagatatgagattttgtttgttcaccattatctttccagcatctaggagagtgcttgattcttaataggtgtgcaatagatatttgttggacaaatgtctgcatgagtgagtagacggctgtggaattgggtttaatgctgtgattccaatgcatataataaggaattaagttctttcctaaaatactcacatcacactctagcaaccattggcttcttgctagttgatttattctctaagaattgccacaatagattaaagagatgatgtttgtcaactctttcagatggtagaatccttgcttgcctcagagaggaccactgaatgtttgcaaagaactaccacaagccctcaccatggggaattggtgatttgaaaggcctggcagatgttacactcttttgccatctgtctcttggaagtagcttcaatttggctttcagtaggccccagcaaggtcatgaatatcagatttggtgagaaaacgccaagtgtgtagcttcagtcaaagggagacagcttttcccttatgctgctcttctcagcagcccaggcccatttgttcttcctctgtgtggaactggatgctccctcctgtagtaaatggttagagggtccagaatgaaatggaaagtggtcctgtatcatcagcagtagcttcttgtggactttgtcaccctcattcattcaacaattgtttactgaacaagtaattgacaagacattctaacaccgacaagttgtgtttaattcagaggaggagactgaacgctggtgtttccaaggcactaaataaatgctaaaacagggagaggaagcacacagggcagaggaacacttaggaggagcaccatactattctatggtgtggtggtcagcaaaagcttcctgggggaagtgaccttatctgtaaaatgaaatgggattaatacccatgttgcaagatggagccaatgtaaggtaatgtctttaagtttcctgctgcttgcttagtaatagcagtgatgaccatgtggtattgatggtgatgacagtgatagagaagaaaaaaaaatggcttcacaaccagatagtccggtttcaaatcctagctcttcttgtccttagctctgtggccttgagcaaatcacttggcttctctgtgcctcatctataaaatgcgaatagtgctacgtaccgctaccacaactgtaatgattgcagaaaatgttcacaaggaacctaacagtgcctagcacctggaaggcattcagtaagaggtgaaaatgcaacaggagcttgaagagaaggtagcagtaggagccatcagtggatatggagggaagagctctgcatgtggagtctagggacctagattctcatctgactatcactgagaagctgggtgcccttgggcatgtcatgtctggcattctctggagtctcccatcagtgcagagaggcccatccatgaatcaggtaatttttaagtgagagaaacacacaacaagcctaggattaaggatggtagagagattactgtgtgttgctatggcatgggaagactttgtggaggagaaagccctcgggctggatgctgaaggccaagtaggtgttagactgggggagctaagtgaagagggcattccaggcaggggcatgattgagcaaaaggggccaagtcacgcattaagtatgtcagccgcttccctcatctcctcacctctggggcagccttactcgtggagaagaatggataataggaaggtcttgacttcagctcagaagtttgtttctttgatagtcaggactggttctgggaaaattgtcaagtcattgaagttagtctgtgcgaccattcatcttaatgtgagcaacccacgttttttgcctgcacattgctgccacctgggctaaacaagccccccactcccaccccactttgcaagcctacaaaatatgccctgtagagcagctcctttttgattcttatttccaccctccaaagcatacccagaagcacagtatgtcaaagcttagagggagctcggagttcattattttaagcccccttattttattatgaagggccatacccaaagataagcacttacgggcagaaaaggaacagagacagatcatcacggtctcccagttgtgttctttcttccactatgcagcctacatttctctctaccatacattttgattacttaacctaggacatcaatacctatgtattaatcaggactcttgggattttaaacgtcaaacacctagagaaacttgtttgataagcagggaagttattggcttgtgtaactgaagagttttggtagggctgaatccaggtttccagaagatgtcaggtgtttgcctctccttcacaaggcttaacttttctcagtgtggcttcattctcaggcaagctgcctacaaatagtgtccaaaaggccttaatggcaacaggcttatatcctacaaatagtgtccaaaaggccttaatggcaacaggcgtatatcctaccatcttggcatcccaagaaacatagagaaatgtctctggcataggtcctagatagggttttcattaatttggcttgagacatgtgcctactttcattgtgatggggttatagaactgtgatagtcttaaactaggtcaggtacccaccactgaaaccaagactcaaggtcagtctcacccaaaccatggatgactgtggggaagaggaggttcccaagaggttaccaggtttctgtttccaaaagagagggaaatagatgttaagctagtatgtgttcactcacccacacatcaccctcacacaacccaccacaagctgataacagtttaaggtattgtattcctgatagcattagccttttgtgaaggactgtacgtgttttagttgagtataacatggaaatttggggtaccatggaaaggccagtgagggggttagagaaggtggagattttgtatttcagggttttttaggctccctcaaattatagcacaaaatatctactttgtggcatagcataaaatactttacttataaattctgtcctgatgatagccaggaactcagcctgagatgaaaaggtttccattagtgaaccacatgtagacaattgtaagttaatgctaattcattatcctcacacctgggctttccaaatttgtctacctcttttttttttcttaaccatgtattgcttatctttctcatgaacataaccaatgtcttatgagcccaagtcaagtagtgaacatcagataggaaattataattttgtgtatattctttccctcatttttgtggcctttttgtgtagttctcttgtgcctggagaaaactcagggtttgtgtgttaagaatgaagtgcttgcattccctcacccagatgcagtgcagcaatggggtacagtgggaccacattggaaggaggtaagattggtggcaggtagttaaaaggtagcattgtttactgtgggtctaatgcagtatttctggactgaatggaatggaagttttgcctaacatcttttagaaattgttttcaggtctgtttcaattcctaatgttcttttatataatttctgactcatttgcttaatggtttcatttgtgtttaaaaaagcaacatcaaaccttcattatttactttccgtgatgctttaaataccacagaattcagtaaggccatcaaagagacagagaggccaacattaaacattaatttttattactttggcaaagaattcttgagataattcagcacagaggaaccagtacaggtctctgatagctgtaccaagtgctgattaactcaacctcacaaaatctcttgcctgtcaacaattagtggaaacatacagaaatatctaaatatcccaaagatattggggagatatttggaaagtatatgaaaacatttagaaacatcagaagtttgaaaaacaaagttttccacatatatgaatgagactggggaagggagtatggtctgttttcttctcacaattttatcaccctggcagttattggtggagagaaggttctcagtaagcatatgacgtatctattactttatctttaccttgatttctccattcccatagctttaaaagtcattagaggagataaaacagggtcatttattttgtattgtcatatgtatggatttagcagcatgtgatatctttccttccttccttccttcctccctctctcctccctctctgggtattccctcctttccttcctccctttttctttccagtatttaatgactcctactctatgtcattgtctcttatgactgagagatgcataaggcttagtcttgccctcaaaaagcttacagttttttgagaggttacacacaagtaaatgggcaatttcaatatagtataataaatattatgatagaggaagtacacagtgcctttgggtcatttaaggagagcacttaaactcagggaatcaggaaagccttgtcaggggaagtgccatctaatctgagttttgaaggacaagttgagttagccagagctagttttctatggctgagtgggccagatgggaggagcctggacctgaatttaatctccctgctggggtaaggcaggtgtcggtggccacccccagcttcaggtgctcagatagagtccagtccagtagtcatagcatggtagccaaaggattttgccttgagttcataatcaagaaacgcctccaggccctggggagcaagagaggagatagtagtactggaagtctgccagaccttagaccttaggagagacacttgtatgaacatggtcaagtgaaattctagtgtctggagaccatgacacagctcagcctgcacagggcttgggacgtgagctttgtatgcacagtgcagtccaggatccagccgacagtccagttgttgcctatacccgcagtcaattgccatgttttttaggaagcctctgtcgagcgactctagaggtgtttctcccttccctcttattactaaaccttacagaagctaagcttgcttctaagatatcttttaggtttaatattcacaggattacagtgtctgcattccttagacgctcctatcatgctgtgctagtcgggcactgtgctaggcacagggaatgttgagataaaaggaagttggtttgttgtttaaactacccagattgtgcattgttaaaaattattatttttttggaactcttaaaattttgttttgcccaaaaaattacatgacactttcctcttagaaataagttagttatataatacagaaatgtaaaggccaaaacattaatattttccttctttaaattctagcttctttcaccagcgttaacaactgataaccttctcttgtgtatctttttagtccattttctatgcttgcatatccatatataattgtatcagttgagattccagtaggaaacagatggtacattcaaattagaataatttagaccgggtgtggtggcttatacctgtaattccagcactttggaaggccaaggtggaagaatcgcttgaggctaggagtttgaggctgcaatgaactagcatggtgccattacactccagtctaggtgacagagcaggaccctggtctctaaacaacaacagcaacaaaaccaaattaggataattgaggtttagtttaataaagggactatttatatgatgtagagagggtatagggaaagcacaggggatcatgattatcaaccctaaatctgaaggggcacagagaggaagtggtcatggaaacctggacacagaaagggtgctgcagaaaggaccctctaatgggcactgagacctgtgatggagggatgcagccagttcttagcaaccacaggaaaggggctgggaataaatgcactccttcctctctgcttctaagcgcccccattgactgaaccctatgggaagccaagggaacaagaaaacctattgatgtagtccatataggtcagcccccttagccagagagctgagtggagaaaggtggagagtggatcagaggggcaaacagaaggtctccagtacaaatacatacatagcatatagttttaggagcttttactttctgtgcttccttgttacagaaatgagattgtgctgtagtacgattctgggactttttgttaacacaatttgtcttgaagcctttttgcatcagtatgtatggatctaatttaattattttattcattggctgcttagtatttcgtcatacaaggtatctgaactttttaaaattatgtatatgtaatagttggtatatacaacagaatatgtaccacctatgtgagttatgaagcctagcaataaaacagtcatctgtaaatttatctctcaacctaagatcactaataccatcgaccttagtcaatcaaactacttgacctcagatcatcaggcaatcaggcattagttagaattacctaaggagcatgcatgtgcagttcacaatagggtttgggtttctatgagaatctaatgctgccactaatctaactgacaggaggcagagctcaggcagtaatgctcacttcctgttgtgcggccatattcctaacaggccacagactggtaccagtatgctagctgggggttggggacccctgctatacagtcttcctgtgtcccctcaccccgccaatgctagtctgaagttttttgtgttaattctcttatactttttaaaaatagtttttccatattatgagtatgttgaaacaatatattatatagttactttttaaaaagctttataaaattgccgttttagttgtacatagtcttttacaatttgcttttttaacatagcattcatattgcagtgtgcagctgtgcttcatttattttcatagcttataacactccattgtgtgaatatgccgcaattcacctctccattctactgttgatggacttttgggtcatttccagtttttgctgtttcaaacagtgctgcttatgaacatttttgtccgtgtctcctggcacatacatacaagagttgctctagggtatatacctaggagtggaatttctgggtcacgaggtttacacatacttggctttgctaggtaatgccaaattgttttcaatgggattatgccaatttacattcccattagaagtatgtaagaattctggttgttccttttcctccttagtgcatggtatttgcagaaggcttaactttttaccatcaatactcttttcagggataccaagcaaaaacttaatgagagtctgactctgttatcataataaatatttttctacttttctctgtaaaaatgattttctctttcttgccctattttttttgcctcattgttccctaagtttatgtcatctactaataaattatatttaaaaataattaatacattaaaacaaatctgccaaatgggcctttcaattctttccaactctaaaataaatgtaattctagtagaaatccatatacaaatcatggttcataaaactgaaggttaacattgctaccatatggagaagttagctcacatacaaaaagagaaaaccatcagttctccaaatatttctttttaccaaatttgactttaacagcaaactggattgtgtgtactcttgaaaggaatagtgctccatcttgctctccctctctttcttcatccttccttagttttgttctttctttctttgcttcttttatgtattcattcactgattcactaaaacccagtggagaagacaaatgaattattactgtgtagcctgcaaatgggatgatgaggaatggacagatgtcttttggagtgagagaaggaaacttgacttctgtatttcttgagttcacttcagttcttaagataaagtaggttctactgagtatttgctaaatgaatgaacaaatcaatactctaaaatgttttcagctttttactcattgtagtgtaggaagagctacatggagttgaatttctatcaactagcccatcttttattactggagttagtcttctttggtaatttaatactcagagtacctcatatgatctctttatcgatgccttcaggagacattaaacgttctatcaattaattatacttaaaaagaataccttttggattcattcaagcacttcatcttctttccccaaatcttgggaactggtgtcagctccttaaaatgagccagcatgctttttcaccctcccatataagtaagagcttgtaatcacccagtgtttctctgacctagaaaagctgagaaattcacataaatgaaaacacaggggcttacaaaattgctttcggccctctcccttagaagcatatctggcacttggtaactggctggatggaatgtgggtactacatggagtgccctggtgctgctgctgctgctgctgctgctaggcttatataactttgaaatcagaaagcagattcagtggggtaggggagaactgcttttaacaagctgctgggattggctgaacttgtgctggccttgcactcttactattataaacttgatgtctttctcatttgtaaactttatttgcatgccagagctcagctgaatttgcctgggttcctagtttctttaatcttttgtcctgactggcttgcatgtaaatcagcttcagactttcagctgcccatatattgccctagtttgcactctataaagagttctttctttgtaggctcctgtccaaagcatggcagtatgtcttaaaactgtacaatatggttactattagtagtaatgagttgttattgagtgtcagtatgaggttgagtagatggagcaaccaaggcagcttagaactgagggtttcccagctaacatgctgtggaaccctggaaaatttgccaagctcctccaggtctcctattccatcctgccagaggtgatgtttttctttcctgctaggtatgtcatgaatataactgagaaccatgattctaaaacaattagaatgaaactttgtgattttatttgatgagataagcactgttttcatatctttacatacatactgcgttgttaagtcctattgtcataaccatgaattaaatgtagtcatttttatatttttaaatatagcaatgcaagaaaactgaactgatagagtgataataaggcagataagtgaaagaggaaggtgtttagccattcaagctactgctgaaatagtgaatctctttaatggtaatatatgagctggaatgtttatccttatcctttcctctagagaagattaatttatttggcaatatctaaataactgagaatggtatattcctcattcataacttagagaaacaatttggctacttttgttggcagaacctgaaatagcattgcccttccaaagactgtttaacttgatttcacaagtaaaccacaaaatgcaattatttgatattttaccatatcccattcccttctttcatccccataatgcagggggctgagtttggatttgcaaaccttactccttagcctaagcccttacaattgtttgtatgtaatgccagatgcatgttaaggaaggaatcctatagaggcaggttacttggagcgaagttttcagggtggccagctctgcccagttgccttctttggtcccagcgagatttgtagttttggtttctctgtttgaggctgggttgggtgcagggaccaagcaaatgaaaaacagacccttggggtataaaagaggtgagacataggtcaaacaacctatggctcctctagctgatacagaagatccatcaccaacaacataggtttatggctcagtcccatgacctgggtggaatatccggagcagttctggaaatataccatccattataatcatctgagtgcttgattaaaatgtatattcctttaaacacaaacaacaaaaacaaaaacatgtagattcctgggacccatgctcagattctgattcactagatctggggcgggacccaggagtctgcactgatgcagatgtcacagacaattctgatgctggtgctctaagagccacacttggaaaaattcagtttagtgcctctttgtcattcttccctttggctccttgcctttatttcaggaaataactatgaatatgactttcaatgtcacctctaggagctgcagccagacattcctatgatgtacttatagctaatctagttgagctccatttgagaggattctagatatattacttactagagatctggctttctagaaggctcccactggatccaggtaatgtccagtggcttgaacgatagaaagctggagtcagcagctggccttccagacccatacaaatcctctttctttggaaagcctctagcacttcactgtaaaataacagataatcccaggccagaattttaattagaaaagctgaatgacctgtaagtaaattattaagaatttcaatatcagctaagatcaatggaacagaacagacagccctgaggtgcatctgtagatgcgtgtacacaataattaagtttgttataaagatcctatatactattttctctgtatgtaatggtgggacctattttcatacaatccatagatacaattgaaataatacaaataatacaaatcattgataactgactaccatgggtcaggccttgttctgcacgatttctatatattctgctaatactcataataagcagcactttaagtattattactcttctccttttatagttaagaaaccaaggcacagggaagctaagtaacttgcataatgttgcacagcaagaaagtagcaggctggtcctcttggtttatttaagttaaaatgaaataatggaggaaattaggaatctgaagaaacctccattttcaaaagagtagaaaaatagatacctgaagggcatcgtggggtcataacataacaactgtgagaagtgttgtagctttttgtatgtttgtgaaatttttcaaaaatgtgtctaggtacagtagttgaagcttctaatgcatattggggttaattccaggactcttatcgtcactcagggtttgacaaagtaatagttatttgtattactaaaccttttaggctggaaggttttgtacattaatagatgttaaagatcttactgcagaaattactgtcatgattttggaagccctagtttaacccacattgatcataatatgtctctggcatggtcaagaagttcttttttcctgattcaagtactttataaagcatatttaaaggctggcttcaatctctctggagttatacagcccttctgttagtcctggtacaatccctcttgagaattttttcttttttttagtgttatcaaaaacacagtaagacgattgatattgcttagtactgaatcccggagttctgtctatgatcaaaatatcctctggcccaccagccaagattccaaaagtggtctcattatggttcatacccagttttccatcctacagccttgggttgagagctgcagcctccctccaaagtcccctccaggcagttctgggagttctgaggtgtttctagtctgttcagtccatttgttcatgaccccctgcttctgtcgtctcgttagtatatcctgatataataaaagtttgaaaatataatcaatgctagtaaggaacagagtcctatgctgtaccatttctttctgaagtgtagctttgttattaaaaacaataataaaaaaaggactggtacaaaatttcctgttctggaggtgtggagtttttcatatgtcaaccagctttaaccttttgaaggtttaatgaaatcagcaaatataatccactgtacgagagtggatatgaatcaagtctatcattgttgaacaaacggcattaatttccagtgcacatgtggatctgagttttaaaatattggtttgaaaaatgtcaagctgctcattgttttagaatatttgagcagcttgctagtatactctttttaaacagttgtacttctaaaaggttacagtgtttgcatatttattcctttcaatttaaaaaattcttccagtggcctgggtagtagggaaatacctcgaattcctttttttatggattgtacttcctagagggtattaaaaaaaactccctttcacttttagcagtagctgaagctacaggactcactttacaccccagcgctcatcatcatgtctccgggtgaagttctcttcagtgtccccagaagctgtagaattagattgcttaaagctcgtggaaaagcttatatctcctatgtccagtgtcagccccctaggaagaaaagagctctgggggaactaatgcttgttgagtgctctaaggaaccagggattggatgatgagcaggacggccatgggccctgctctcctggagatcatggttgctgttcagccagggtcagtggggcagagagcacagtcgtctcaaaagtgggtgtggggagatccatgaggatgttggaagcaaatataaaactgagggttttctcattttgaatttccattgttgcagatgtttcataatgcagatagtatattggtattttggtgcatcttttacaacaaacttaattattttgtatacacatacacagatgtgcttcagggctgtctgttgtgttccattgatcttagctgatatctttaagaaggattgacaactatattttaaaaatctaatctatctaatcaggaaattgatttaaacaaagcactccatgccatacaagatttgattgagctgttttttcttttttcccaagatgaaagagtgcctaggagcgtggttatttttgcccctatatccaatttagcacctctttcaagttaggtttgaagttggaagaattacaacatatttctataaaataatctgtttaatgatatgatgtttcatttcttactaaaacaaaacccttcccattaacttgttcgcttgtccccattttatcatatatgcctagggagaagtctccattaactggtttcttcctgctcctaaactgtatcctctttcttaagcaagttctccacactattagtttgctttcaggttcccctgtgtttgctctctgttcaaaactggtgatgctgtgaattgtagtcagctcaagtgacttccaggtgacttgccttcagcagtggctgctcatttcatgcactgcagaatccctgggtcatgctgacctgttgatgataccagcatcacagactgcacatatcaggcctgctttctatgatgctggttttccaattaactttgtgaaaaggtatatccctgcttatgtcttcctggttatccagctcctcttgcatttgatttcatcttcagcactcgtctgtttgccagttttccatagtagaaagatagattttttttcaaaaacgactcttcccttttagttccattccataggacttctaaaacagatacttgcattgctttcatttccaaaacaaaattatttgataattacaaaaataattctagaaaataattgtcatgttagtttgctatattgaatattttttgggacttctagatttaatgtatcacatttcactaattgaaagaaaattattatcagcaagataaatctgtttgggagtgtttacttatttctttaattttctatttttttattatactttaagttttagggtacatgtgcacattgtgcaggttagttacatatgtatacatgtgccatgctggtgcgctgcacccactaactctagttatatctcccaatgctatccctccccctccccccaccccacaacagtccccataattttctaaattaacatgcccctccataattctgaaatccaaattaaactagtatttctggtacctcaagattccctaaatggagcttcctgggtcagtacgccacttaatctaacttgtgaagaaagacttcagcactcaaactcattctgaccctgtggactttgcttcagctgctccctttggctgtagttctctttctcagagcttcatgtggccagctcttatcactcaagtctcaactcaaaccttactttcttggaaagaccgttttctggccgctgaggtctctgccactatctgtcatagaatttgattttattttttcacatcatgtgtcagtccctggaattatttttgttaacttgtacatctactgtcctccaattagaatgtaagttgagaagaacagagccattgtctgtcaagttcattgctgtatccccagtacatagtatggtggccagcacacagtggtttgataaattcttggtgaatgcatggatataacatttgagaaatgctgcataaaatatcattcaatgggtttctctagagtgagatatattggtacagcattttccaaatatatttgactaagaacatgtatatatgccatgtgccacataatgcagttttgatcaatgactggccacatgtatgaaagtggtctcacaaaattataatggagtaggctatatcatctaggtttgttatgtacaccctatggtgcttgcacaacaaagaaattgcctaaatgacacatttttcaaatgtatccccattgtctcctactattggtctgtatgactgtcattatgtcagtaccatattgttttgattactgtagctttgtaatacatgttgaaatcaggaagtgtgatgtttccagctttgttgttttttcttataattgatttggctatttgtggccttttgtggttccatataaattttagaattgtgttttctatgcctgtaaaaaaacaaacaaacaaacaaacaaacaaaaaactgctattgggattttgatagggattgtagccaagcagcttggcttcaaaaatgcattttaaaactttttttctcctttctcttttctccttaatctcaagatgtaaccttgaagctaactgcagaagcatttccccttaaccttaaaataagacttcatgtccctctctttcccatcattatctaactgtatgctagtatctaattatgtgcttacttaaagttctgggacttaatcttgagacaggcagaccaaacccggaaaccctgcttcaaaatttcagataacctcaaggtagctagtcaacaacttggccattgttgagatgatgccagcccatgctccaggtggaccaagacccaatatagcaaccaaaacaagacacgcagatctagtacttagcgcgactcctgcttgccttccatatcaagtctcccctttttaaatacttagcttcttcctagaaattcaaagtggttactttggatagggaatctggccacttccccattactagttttggttaataaagtcactttctttctaccagatctctctcttgttaattggactctgtaagcagtgagtggccagacctgtgttcagttacaagatgacattgaatctttaggttgctttggatagtatgaacattttaacagtattaatttttccaatttgtgaactgcagcctgtaagttttgatatattgtgttttcatttgtttatattgaggtatttctaatttcctttttgatttcattttgacacaatggttgtttaaaagtgtgttctttaatttccatgtatctatagatttttcagtttttcttttgctattgatttctgtgtcattccattgtggtcagaaaaaatacttggtatgatttctaccttcttaagttggttaggactttttttgtaacctagcatgttacctaccttggagaaaaatttgggggcacttaagaaaaatgtgtattctgccactgctgggtgaaatgctccgtatgtatctgttaggtctgtttgatctataatattattcatgtcctctgtttccttacttatcttccgtattgatgtcctcttcattattgaaagtgtggtatcgaagtttcctactattactgtattgctatctatttcttccttcagttctgttaatgtttgctttacatatctaggtgctctgatgttggatgcatatatatttataattcttatatcttcctgatggattgacctttttaatcattgtatatgtccttctttgtctcttgtgatagtttttgacttagagtatgttttgtctaaggatagccacccatgcattcttttggttaccatttgcttagaatacctttttctagcccttcactttcaccctgtatgtctcactaagtctaaagtgagtttcctgtggagtgcatgtagttgggtattttgtttgttttccattcagctactctatgtctttggattgggaattaattcattaaaattcagtgtaataattgggaaggggaggatttaatattgcggtttcattagttgttttcttttagtcctatagtccttttgtcagtcttttcctttcttactgtcctcgtttatgttttcttgattttttttttttgtattcatatgctttaattcttgttgacatttttagtattataccttttcatgggttttggaattttcgtttgctgactcattttgagtgggatgtttttacattcactttttattacattttttccctttctctgggcttactcttgttttccttgaggttttgtgatcacttttatctggtctgaaagacttccagtccagacccaggttttattatgttctatcagccacccttgccaatggtgatattggggatatcacatactctgttatcaagcgagcaggtggtttgattctgtgcctgggtctgaatcacatctttgtcaacttttccctcacaggcttaaatttttataaaactgcttctcttagtgtgtcgtgttttttgttgttgtagttgtagttttgtttttagcttcttcttattagcccaacctccttgtttggctttacagttaacctggcttaggtctccttatctccagtgagccaattttagattctcttatcctgtaggagcagaatgcccagcagtcagtgctggcttctaaatctggagccttgcaggttccctgacttcagacttactcactgcttgtgattctaatgcgtttctagtccacagagatgtttatctggttcttggaaacaaactataaacatttttatgtttactttttatgtttcatctttaattatcacgtttggaataggaggagttttataatggtgtgaatttgctgaatcatgttgaccagaagtctcaccattacttctgaagcattttaaagcatatttctgtcctaatttcttgtccatagctctgtatgattctgacctttgaagactataataaaggttcatcattttttaatgtacttattgtttatactcatcactgagagaaaataagttacattacacagtagtcgagaataaacttctttaatgggtttatgtgactaaaattgtaaaggtcaggggaattaatgggaaatttgttttaattatgcattgatcacaaaacataatattgttttctttaaggaactgaacttgctggattctgaatcatattttattactaaacagaaacaaataaactcagattgatttattgaccctgctgtatgccaggccttgtgaggaatacatgggaaggaaataaaaaggtctctgtcattagaaaggctggtgtttctcagctgaaggctgaggttggagggtctcctcctcccctctccccagtagaaatctgtgagaatctgaaataggaggctttttaattttcaaactatgcaccctatctccatttcccagccccctaccaccaggggagtgtgtctgttgcccctcaactgcttcagaactactatcagagccacttttaccaagaacatacaccatagcaattggacattatgaaaacaataaaatatgtaattaaattctaaaatgaattaggatgctagatggattgagcatacactggatactaggcaatgcattaggaccttccttacaattgctgttacatcaactctgtggacagatgttaacatccatttttagatacacaaaagagggagcgcagagagctcaagcagcttgctgaggttcctagtaagtggcagaggtggacttcaaatcccggcctgcttgcctctgaaacccagatcttaattactgtgttgtaataagagggagaaagacaaggttaaaatatgtcctactgtattgtggtttactgaaggaatttatggagattaaaattcataaattgttatagagttaaaacagatgaaataatgcttctttgacagaccatttagttttttctttcatctttaaacaacgctgcactaaaatttgtctgtaatggcataaaaaaaaccctgatatttgccttttcttctccattccccatgcttgtcaatcgttacagagattatgctcaaatgtgatatcaggaaatacttttagtccccagcttaagcttctcatttctatgtgaaatatggcagacttttgatgctttctctaaggtcccgttctggatattctccctgtgttcaaggcccttttagggagagagccagtctatggccagtcttgccaactctgtaaatgcaatttacattcttaaaattcgctatcaccaggtcaaaactagcccctggtgcattttgggaagcttcagttcaaacacctgaattcattttcaccaatgctacctggttaccttgtaactccagagttttttagagaggttttgtatatgattgcttgagctatagctttttccctttttgtaagctattattgaaataaaaacgtaacttacctatttcacggtgtatggatgtttttaagtggaataagttcatgctgttttaacttaggttcaccaaacaacatttttagaatattttcacctttctaaataatgtgcttttgattgatactccctctaattcaaactggcagtgcatagtaccctaaaccagtgcccgcataagcagtctgtataaaacatgcttatgcttttcagcttcccaagtgaatctttcctagagagaattgttttttttttgaatgtttgaggtcatcttacaataattatgcataatcagtaatggaaacaatttaaagagtttacactatgtgcccggaatatgatcatgataaacaagtcatctcatttatttcttacaacacactttttaagggtaggttcgtattatcattcccactttacagagagagaaacaaaggttagagagattaagtaacttgctcatgtcaaggtggtagtgagaaattattgaaagcacccattatgccatgtgagtaagcaaaaactggcagattaatttttagcatactcaaataaaaggtcatgcattagaaaaaaagcagtcaaaagtagcttctgccccatctttagtgaagcatacagagggatatgattgaaatagtcctcagctctgggtcaaactctctggcttctattttcaggccctgccacttgggcaaacattccttctctgtggaaaagtagaatgttggccacaatctcctaaagtcattctagctttgatagggtgtgattgtaggagcctgcaaaggaatctagaatcattgtaggtttcctaatgtctgtagctctatgcaattaaaaagattgagtaaatcttgggagctgtcaagaaggttcttacagtttatatataacatacaaaaaaatgtataggatatatcatagttttgcttgctacatctccaaaatctagtggaattcaagaaagtttcagaaggaaccaccaaaatggcatgatgagactattataaggggtatagcaatctttagcctgcaaatagagaaaaaagtcttatttagaaatgtctacaaaattatgattgttatgtatttcatacttaagaaagtaattttagttgagataaaatgaagtactgttttacacagtggatgataattttgtggaactttccatctgtagaatcaaaacataaaaaataaatgtgaaaacaggcaaatgtagaaataacagtccatcatggattatcaaaggacactataaagtatggagttctcccctaaaagctggtattgatagggatcttagttattatgccttcctactgtatgtgccagggttccaatggaagttgtcaatacagcatagctccaattcaggaaggcaaattttaagtcataaaaggttctgtttaggatggcagatttccttaatcattaattttattagtagtataatataatgttaaatttttgttttggttccagttgaagagcagcatgatgataggaatttgcactagaaaacaatactaatatcacaggaaaacattaagagtttcttctctctgaatagtggtcataataagcccatccttccttttcatagaggttgatggtgtctttggagatgatctatctcacggcctcctcagggcaggtgtccattgtttacctggcaggtgttccttgcacctctgcttgaacactgcccatatttggcagcttatcctctggggagtactgttcccttgtgggactgctcaggtttattctttactgagctcaaatctatgtgcatatgctctttctcactggcctgattattccttcagggcaagtctactcttcttgcagatgaagcatctagccccttacagtcttctcttctccagtgtaatatattctgctgctcttcaagcagtgcatttctagacactggaaaatcctgtcagttcttttctgaccactgtctcttttccaaactctttcctcaggtgtcctggacggaaacaaaagggagtaaaaaagtgttggatttatttagaataaaaagggagtattacttcacataatcaacagcattattttatttttatcaatgaaccttaaaatctttaaaaacattttcccatgactgagatactgttagctcaatatgcttgtggccaccacctgagtttcctgattgttgccagacagaccgctatcaactcaccctctcaaagtgcagtgtgtgcttcagatttatccccactgaattatcttgtcagttttaagctattatttgtgcttcaggatattttacaatcttgattatttggtccaacatattaatgattcatcttatatttttatcatcttaaaattcataagaatatctccaaggtattgatggaaatgttaaacaagattgtatcaagggccgagttaagttaagcaatgctaacattcaaaacttaatgagaaatataatttagtaagaatggtactttgatgcttgtatttcctttaatcttgctctaatttatagcctattaaaatatactgtttatgctaataaatacaaattaaattttaaaatacatgtttttgtttgtattgttttttcaaaaaatgcacaattgagaaaaaaagtccacttttctttctttttttttaaggttttccacaggttgtgattattcaacacatggctacaatcgactaatgagatttaactgatttaatgtatgataatataatctaatgacaagtcaaaataattagggggacagggacaacctcatgagtgttgactttaaaaatctaaatccacaacatgacaataatgtcacagtgtccattgatgaagaaagtgaacagtctttttttaatgatgttcttttattttagttgattgcatttagagagaggacaactaaactattcattctcctttgtggtatctattaagttttaaaaattaccttgtctttctgttattttttttatttatttattatactttaagttttagggtacatgtgcacaacatgcaggtttgtcacatatgtatacctgtgccatgttggtgtgctgcacccattaactcgtcatttaacattaggtatatctcctaatgctatccctccccactcccccaaccccacaacaggccccggtgtgtgatgttccccttcctgtgtccaagtgttctcattgttcaattcccacctatgagtgagaacatgcggtgtttggtttttttgtccttgtgatagtttgctgagaatgatggtttccagcttcatccatgtccctacaaaggacatgaactcatcattttttatggctgcatagtattccatgatgtatatgtgccacattttcttaatccagtctatcattgttggacatttgggttggttccaagtctttgatattgtgaatagtgccacaataaacatacatctacatgtgtctttatagcagcatgatttataatcttttgggtatatactcagtaatgggatggctgggtcaaatggtatttctggttctagatccctgaggaatcgccacactgtcttccacaatggttgaactagtttacagtcccaccaacagtgtaaaagtgttcctctttctccacatcctctccagaacctgttgtttcctgactttttaatgatcaccattctaactggtgtgagatggtatctcattgtggttttgatttgcatttctctgatggccagtgatgatgagcattttttcatctgtcttttggctgcataaatgtcttcctttgagaagtgtctgttcatatccttctaccacttgtatggccatactgcccaaggtaatttacagattcaatgccatccccatcaagctaccaatgactttcttcacagaattggaaaaaactactttaaagttcatatagaaccaaaaaagagcctgcattgccaagtcaatcctaagccaaaagaacaaagctggaggcatcacgctacctgacttcaaactatactacaaggctacagtaaccaaaacagcatggtactggtaccaaaacagagaaatagaccaatggaacagaacagagccctcagaaacaatgccacatatctacagctatctggtctttgacaaacctgacaaaaacaagacatggggaaaggattccctatttaatgaatggtgctgggaaaactggctagccatgtgcagaaagctgaaactggatcccttccttacaccttatacaaaaattaattcaagatggatgaaagacttaaatgttagacccaaaaccataaaaaccctaggagaaaacctaggcaatactgttcaggacataggcatgggcaaggacttcatgtctaaaacaccaaaagcaatggcaacaaaagccaaaatcgacaaatgggatctaattaaactaaagagcttctgcacagcaaaagaaactaccatcagagtgaacaggcaacctacagaatgggagaaaatttttgcaatctacttatctgacaaagggctaatatccagaatctacaatgaattctgttatgtttttaaaataattattccttatggactttcagtctaagctaatttttatttgttctctccagcaggtctatctttataacattcaagctccccctactccttatccttggagttcacttttatggggacaaaagatgagttttctgtgctttggaaagcatgattatgcttcatgttagctttggaattagaagaaatcattttcggaccattttttttgagttgtgatacacaaacattataaggttaatcagcattttggcttattagtggcccttgattcttaggaaactaagataattctctttttcctgcagatgtgacatttgactatgaatattgaagttaaacttcaattcattgtattgtaaatggaaaagaagagtttttcattttaggtatatatacataatacatatattcttttccttggctctcatcatgtttatattagatacaaaactagttaacatgtctagtctggcatttttcctccaagatatataaattctaataaaaaataagacaagattggggaatggggataatagtattcttttaaacaaggatgcaagaaaatgaaatgtttaatttttgcaacatctcctttctaaaacaaaatatactgatggaaatttggcttgtttcctagagtctcaacacaggagttattaactgcgatgaccgggctaatactatgtgaggtggagtatgataaaaggattaaaagctagaggtactgtgcttggatagcaagctggatgcttgtgcaggcatggagcctttcaaagtaaagttggctccttgacactctgtcctgcagcttgcgctgatttttaagatcattgaaaatcaggtcattgagaagtcttcttttagggatgtctgtaacattctttgactgtcttatgtttaagctagaatttaagcatccaaataaaagttgttctcaggtgtcatcatcataggaagccattcagctaccctaaagttcactaaaaagtcctggaacttgaggtgattgacttctgactccccattgtcagtgtggtccagggacatggcaggcaggagccaactgcttaaggtagaaatgctttgagtaactttcatttaaactgcacagactatcatggctgggtatttttcaaagctacatagggttctggaattttagaaaccattaggggccaagaagaatctgtcagcttatagatctaaatgttcaaaatttaagttaaagcctgtttcttttggtaggaagcaccttgactcccattttttataatgaaagattgatgatatctctattagcctgtttaaactgagccataaaagagtctgtaggaggccaggtacagtggctcatgcctttaatctcagcactttgggaggctgaggcaggcagatcacttgaagtcaggagttccagaccaggccaacatggtgaaaaccggtatctactgagagtacaaaaattagccaggcctggtggcacgtgcctgtaatcccagctactcaggaggatgaggcatgagaatcacttgaacctgggagacagaggttgctgtgagccaagatcacacctctgcactccggcctgggtgactgagtgaaactgtgtctcaaaaaaacaaaaaaaaaaaagtctgtagggtaccaaatgcttttttttttttggagacaggatctggctctgtggtacatactggagtgtagtggtgtgttcatggctcactgtagccacagtcttctggactcaagtatcctcctacctcagtccaccttcccctctccagtagctgggactatagacgtgcaccactacacccggctatttttttttttcaatagagatgagttctcactacattgtacaggctggtcttgaactcctggcctcaattgatcctccctccttgacttcccaaagtgctcagattacatgtgtgagccaccatgctcggccttcttcttttctaaaatcccacccacttagcatgacaaaggcctgggacataatggtaagtgaatagttgtaaggaatgagaagttttagctgtgcactgtaccatgcttggatttgattatgggaaagatgatcaatattaacatagaagttacctaaactctctgtgtcttttcccttacctcaggaagttcaaatacaatgttgtaattcagctcttctactcttcctgtcctctcaaatgagacaacttatactgtggttgctgaggctaaatagaggaggaattcaaatacatggttcttctacttaagatcatctccagttgcatcaaatcatgacttctggatgcaacccagttgcctccatttcatgagaatggtttccttccatagacattctctgctgttcccctatcattgtcaaatcaatgtttaatcaattccagccatttcttgcaaatccactgcaatcacattttataaatctacctagtgcttggttttcatgcgccgcagataaattaggtccttcttgttttatcctgagctatcagtctagtaacatgctcacagcatgcaaccaggaataggcatgatctcctttttgtgagtctaatctgagtgtcctttacaagtaagaggggatagtctgagagtggaaacagctcttttcaggaccagctgggtgatccatgagcatttgaacagatggcccatttttgtgggaaaggattctgtatcctacaagctaacacccaacagcttcactgaaaaaaaaaaaaaaagcttgaagataagaaatcaattcaagaggaacccacatgtttgctgtgttgcctctgaacacaccctgtatgtcaagagcttagctttattctgtagaccacctagtcagaatcattggggaggaaaatatttgttcaaacatagtcccttttgtctgtgctgggcaatagcacaatacattcagcaaccaccctctgaaagccaaggctttgtctccagtggggattatgaaaacatggatttcttgagaagtgcctgcccacctgtgtttagattttaaattttaggaagatgcttgacagccagaaaagaggtgctcagggaaaagtctgttgagattatagagactttttgaaagaccattacctcctttaaaatgattagaatagaagaggaattcttgaaaactggcatggaatatcgtattagatggaaccttggaaggttttatttatcccttctcttttagctttctgtctaaggcctcagattgtagtctattttagaaaatctccaaggcaggaaatttttcataacctttcccctgttagtcattttttttaacttcaacaaaagcctgcatcagaagcttcttgctcgcttatatgaccctaacgctcactgctgcagtccaagcctggcttcctttgcactttcttttgctgttcatattcttcacagtgggacctgtcttagctgaagcccattattaggtcactccttggcctcttctctaaggctaaataatgagttatttttttttctccttttttggtacatcatattttttcaaccatttaatgatttttgttgttgaaaatttggggatttcctgtgtctggaaatgcattaggcctcaaactttgtacccctaagacttttcctgctaccttttaaaagacaccaagtaaaattaagactaggagaagacagctgctgcaatttttaaaaaatcacaaaagcaaaaaaaaaaaaaaaaaaaccaaaaacaccgagtagctgtctttctggtttttgattgagcaagatatttgtaaaatgaagcatactttattgtcagatgggcctgttgtttactgacaattgaccaacatgaatgtggtcaggtttagatgaatatctatacaactcacataatttttaatgaagggagttaaaagctaagcatgccaagaaaataagtatgactcaaaagtggccctttcttagtatattggatgtattatggcttctagttaccaagggcctttgaagatgactgggccattattttaatactttttaatatgcttctggattcaattattgcagatttttacaattatatttgatctctagttagtttataaggaggacactatctttgtcaggttttaatatcaagattgtgatagctttgtaagtaaatgtagatattttctatactttttctttgctttagaacagttgaaatagaacaagatcaatctgacatctaatgtttggttgaactcacttgtaaaactgtctgagccccttgacttccaaaggtaggtttttgataattcttgctatagtttaacatatcacacatatggaagactttatttatctatgttcaatctagagaatagtaatggaaggattacacatgttctcaccactgagttgcagaaacagaacactatcagtgtctttgaaggtcactgtgttcccgtacctgatcacctcctcctctctgccctaacccccatttgacataaacacaatgctaactttggtataccattgctttgcttttcttcatagttataccatctttgtatatattattactgaagattatattatttagtttagttgaaatttatattatagaatcataatcttctacttcttttgtcttttttgggtttttgttttttgttgcctatttttgttttgagattcatttatatttaataatgcatcactaggtcattttcagttcactttactactttgtaatagtccattgtatgactattccacaatgtatcgattctactgatgatggacatttgtgtgttttcagtttgagaacttctgaatgtgtctgtatgaccgttttggtccatgtctcctggtattagaattcctctaatgtttacaccaagagtggaattgttggattgtggaatgcccatatgttcaactttataaggatatgtccaattgttttcccttaattattttaacaattttctgcttctaccaggagtggataagaattcctattgctcagcctccttgccaagatctcatttgtgtgattttaaattttttgccagatagttgtaaagtggtatcttattaaggatttaatttacatttacatttccctgattggtaatgaaattggtcaccttttcaaatgcttgctgtcattcataatttcttttctgtgaaatgcctctttatgtgttttgcctatttgctttttgggttgcttggcttttttattgatttgtaagaattctttacccattttgaatataaatcattttgagttatatatattgtaaatgtcttcttctaatttctagcaactcctctcattctatgatttctcttgatgaacataaagccttcattttatgatagttaaatttatacatctactattcatgctttgaatttttattctatttttaaaatctccacactgaagatataaagatatttttctctgttgcacttaaaactatcattatattgtgtttatttattttccatcttcccaccagaatctaaattcaattaaggctagaatatttgcttgttttactcatttcggtatctctagcacatagtgggaactcaataaaaattgttgaaggaaaccatgactgaatgccagagagggtgaaatgttcttcagtatcttgcattagctcattttcctaagaatgcacatcctctgaggctatttcctctccctagtcctgccatatttttcatatgtctcattttcatctcataatcaggtggatccatttggactcagtgtcttcatatgcaccagtaacagaggggcttgtcctcaggctgctgtctgcacatctttgatttcgtccatctccactctcagacctacagctggcctgcaggtggatgtatgccgttgtcattctggttccttctcctagcaggctttcatccagtgcatttctgttcgactgcggtgtattcttcccctattcccaaggccctcattcccaaggtagtcagggctaatttagtctgcctcgcaaataacaaaccctacatttcaaagaactagagttcccattctgcctttctagttgttttgttacagctgctactgctgttgttgttttcagagtaactttttactctatactgcatttggaaaagatgatggtgaaaaggaagttgggggaaaggaattggtcagtgccttgagtgcctcaggatgcagaacacaaggggtagatgggcaggtgcccacttctctgttgattctaggccatgcttttgctcaaaggaatccagatctggcaacagaggcagtgaagggactgtgcattttcctagcatttatcaggtgatatttttcatgaaactgcagtttactgcatttctgggtagtctgtttttgtttgtttgtctaactcagatccaagtttattataactaatgttcttttatgcctgaccctgacataagggagattttcagtagccttgtgcattggtatatttttctgggttatcttttgtgaggtaacattaaggaatgctagccacattccattttgagtgaaacctcctgcactgctattttctaagtgtatgcagaagctcatatatttggaaaattcaagttcattcaaattgctactgaattagaagtatctttttgtcattacctagttttaaatcaatagatattaaaattactactactatttcattgttgccccagtttttttttctgatttaaaaaaatatactaaaacaagctctcataatccagagaatatgtaatcattcttctatagcactataccaaagaccttatcctatgggatatcgcttagtttcctatcattcaaaaaccatctttccaattttttaactaccagtttaagtaacagtaagtagattacagaatggagaaaacataaagaagtatgatcgtaaacaacttcaatttttctgaaagaaatctgaaggataaaataatagcttccttgacttagttgttcctatatattatctgagaaaaagtttattgaagcacatttttacacttttaatccactggaacgtcactgagaaaatgttctgagagtcataagaatgttgactaattgggctgtttgtcccacatgggattacaccactactttctgaatcagaagttcctgctattgcaacatgaattattctttattttttatttttccctcttagaaacaatccatttgggttcattacatagccatttgttagtttgggggattgtgcttgtttgtaactacaatgaagtcatactagactgggtccgtatgtaagtcagtgggagatcgtgcagctgctcagtgaatcattcagtgcaaagggtcaccctaatattttaaccccaaagtcctgctttcccaaagtcatgggtaatttttattttaatcatcaagaagattggttcaactttggtttacttagtacatgttgcacatacatatcaatctgtaaaacttctaaaaaaattatattgaagtataatattctcagagaaagtgcacgaatcctaagtgtatatggtgaacttttacaaactgagtacacctgtgtaactgctacccagatcagaaaacagaacatgaccagcaccccaaaaggtttcctctaccccctttttgtcacaaaccctcctcaccaagagtaatcactctcctgttttgcgtgtttttatactttatataaatggatttatacatcatgtgttattttgtatctggcttctttcattcttcattatgtttatgagactcatacaattttatcatgaattgtgttttttcattttccatttctatattattgctatggagtgtcctattgataaatacaacacagtttattcattctattgtcagcagacatttcatgagttttctttctttttttttttttagaagggttaggcctattatgaatactctgttatgaacattccagtacatcttttttggttaaagtatacacacacacacacacacacacacacacacacacacacacacacatcctgttggatatataacgaggagtagcattgctgggtcatagttttgtgtatgttcagatttaatagataagccagtttttccaggtggttgaatgtacttacactagcaatgtacaagagttccagttgctctacctcctcaccaatatttggcatattttgtctttttcattttagccatctggttcaatatgtattgaatgtggtttaatttatatttccctaatgataatgaagctgagtatcgtttttatgattattagtaatttgcatatctttctttgtgaattgtctgttcatatacatatatatatatgctgaatattttctgtttttccgtgggttaccttttcactctcttagtggggtcttttgatgactagctttcctagtttaaaaaaaaacactctcacatattaaagatcttagtaaatatttagaaaattgttaaccaatgtgtgaggatctcagtagtgacatgtttaactcaaaatgtaatttattatttttttcttttatggcttataatttttgtgtccagtttaagatatctttgcctactccaaattggtgaagttattctatgccttcctctaaaatctgtgtttagatatgtaattcatctgactacatatttgtatgttttataatgatcaagatacattttttttcaaaccaatattctatataccccagcatcactttacttggtttataacttgtttgaaatgtgtccacaaaatttagtttcagtgaatttttaaatattttcttataattactaatatttcctaagaagaattttaaacctgtgatgatttcaaatgtgtaatataatttctagatttatttaatactaatgtcagttgaaatttcccttaaaagttctcctgttcaattggatctagttttgaaatccagctatttatttattcaacatcaatctataatgcataaaacaattttttaaataaattattgttctcattttctcatttaaatcaattcaacacatgtttattacgtttcttctagaatttgggacagttacgaatgtggttgaagtttcaagcttcatttttatatcctttaggttttaagccatataataaatttatcaaatatctgtcagtaataagccaatttcttttctttttttttttttttttttgagatggagtcttgctctgccaccccggagtgcagtggcgcaatctcagctcactgcaagctccacctcccgagttcacaccattctcctgcctcagcctcccaagtagctgggactacaggcgcctgccaccacacccagctaattttttgtatttttagtagagacagggtttcaccgtgttaaccaggatggtcttgatctcctgacctcgtgatccacccgcctcggcctcccaaagtgctgggattagaggcgtgagccaccgcacccggccaagccaatttctttagtagtcaaaattatattaataaagaaaggtacaaagtgaggatttttattactattaggatagacttagaccccttatacaattcctcaataccaagttttccactaataatgacacatatctttaaagacataaaaataggaaagaaaatataaaagtttcatttttatattttgaatacctataaatgtttactctttgatgtcatttttgcttagttttattttttaactttttattatttgttctaggttgtactggtcagtggacatctggacagctgggatgttgggcagggtgccatggatgatggcggtggagcctttatatcatgggaagcactctcacttattaaagatcttggtaaatatttagaaaattgttaactaatgtgtgaggatctcagtgacatgtttaactcaaaacacaaaatacttaacagattagttactatggtatgttcaaagatcctcttgaggtcagttgattcccagaaaagaaacaacttatgctcttaaagaaatttttattcatgtgtacgccagacatctaaagtgtcaaatgttattatcagccactggggaaaatgaacaagcaaataaaactgaagcaaatgtaaccacaccagctaaagaatatgcaaggaaaatatgatgaaatgcaaagaaaaatcagcagcacctcctacttcctttcccttattcatcttaacacattatcagactattaggacaatggataaaggctggtcgtctttccatcatagaaataaaagagtaacctagatagaaagaatgatttccatagccacaataaggaatccaggcagataattctttgttgcaaggtctgtcccatgcatgataggatgttttgcagcatccctgacctcttcccactagaagccagtagcaccctcccctaacctcaagttatgataacaaaaatgtctccagacattgccagatgtcccctggggggccagggaagcagttgccccattttgagaaccactaatataaactaataaaaatatctaggtaacctgaatacagggtcattttgttaaagaaaacaaactaattggaaatcttacattgtatatacacttttaccataattaccatacatgacagaaaatattttgaccacctactttgctttttataaagcactttgtaaaagctgggcatataggtttaaaggatgtcccctgttcttaagactcttagaatggagtgggtaaccttcacacatacatacacacatagttatcaatatagacataatttcaacatctaattttagaattggggaaggtttgagagagaagttatccagcaaataaaactgaaaatcacacattccttcacagaaaatctgggagacgctatgttaattctctcctcctcttctcttaaaaatattcccttggctatctcttctttctgtttctcatatcattccagaaagaagtgggttctagaggaaagcaggaaaaagtcgaacatttttcctcttcaaaaatcaccgataatgattttggacattaattttatttcagtatgttcaatcagcttgattggaagcacagtggtggagtaaaaagagaaattttctttagacccatttgaattggactttaggtcactttactatattttggtccttaagcaagtcatttgaatgctctggacttcatttttctcatctctattaaactgtaagcttcagagtatttcatttgctctagattggaataaaaattgtatcttctttaagctttgaatcttacttcttcggtattcagcatgggaccctaaatcactgttaattgaattgaattcagttgcatggacaaatgttaaataccatgcaaaagtgaattgagtatcttttaccagttctcaaagtacatcgacttcagttgcttttgatagctagtgaccagtctctttaatttgggacttaaatctccaaaagatttctgaaagtctatgtaaagatatgaatagaactctaaaataaagagtaatatttcttttgagtaggcattatgaggcaccatagtatactgttaaaaacataggattctggagccagactgccagggttcaaatctcagctctgcagtctgctaggtgtgtggccttaggcaagttactttgcctctctgtgcctcaattttctcatctgtgaaatgggataataatagttcctatctcataaagttgctttgaaaattaaataagcagagtatacttagaacatgggctggcccaacccaagttatcaataaatgttaacttttataacttaacttaataagcatgattctgacagtaccatttttttaatataagagaagatgataatttagtttacctccatccccattagtgattgctttgcctcctaacttttagtatattagctatactaatgtaactttagggccagttgctatgtatccctaaaatatcctttccctttactacttaagtcaccatcccttgtatgatagaaacccagtgacccctccactttttttcatttcacactaaatttttagaagtcttaaatttctcctggttacttctatatcctgcttatgtttaatgcccagtatctactctgcacctcactttccatgattgcacccattgagtcttactctttaattttgaaattgtggatttctatttgtagattgcctatgtattttaacatgaagagctaggttcagcatgtgatgtgtatgaattctggatgaaaattgctgatatacttgaactagaaatatgcccttgggcttgaggccaagaaataggttcataattatattacttaattacatggaatccaatctgtttaattggtaaaatgtgaaagctctgtggcaatctctttttccaagaaaaatgagactccttttggatgctattccttggatgatgtgtcatgcagcatgtcagagtccctcagtggagcgtgttaacttgaagagctggtccagtggggatctctgatatttggaaatatttttctaagattcatccttctggtatcttcttctttgtcttcccctctcaccactcttatagattcacttttttgctcaagccttcagcttaaattatattcaattaatctaacagaagagttatttgtgctttgtaaatataatcagtctttcccgagtaactgtctacagaaggctgtttgctgtgaagcgtcgttgaatacttttctgtgtctgtggtttactggacttgaaactgtttatttgaaatgttattttctggaatgttctggtgtcagtggacaaagcctatggccaatgatgctccaaaatgctcatttggcacttagaaaataaactaccatccatcccaaattcttccaactgtatcattttctatgaagttagaattttgagtttccaggtctaaagaaatgaaagatatgagaattaacagtattacctggttgttggaatgtggaatatataagaaacatttttccagaaaaaatgtaaatgttgagcctcctgactgtgattactatagagcttgaaagtctatgtcttagaaaaatattttattggtatgtttcttcattcattcactcaacaaatacttgtgcattgactgctggttcatgtatcagatgccttgcactaaagaggaaagagaaatggccctttaagtccttgaagtaggagagacatttaattcaaaaattgcaatgaaattgtggtaagttctctgaatgtaggatgtacaaattactttgggcacctggtaaagaaacagaccaacatggcttggctgggtcagagcaacttcactaagatgttatttgaactttctttcataaagataaatagaaattcctgagatgaacagtgcagaatgaagtattcccagcagagtacagagcttccagttctgtgtgtcattaaaaatgagaagaaaattgttgacagtagcagtcttgggattatagggggagacaggagttgtggaattacaggagaggttcactttttacctgatatatttgtataatgttagatttttgtgtaataagtatgtgttacttcagtaatcaagaaaaagctatcaaatactcctctacccctactcccaaaaaagaaattaaaaagaaaagaaagagttttggtattgtcattatcataaacaccctgttaacagaaacaacacagcagaggtaaggagttggaagagttgtccaggagtcaccaagcctccctggcccagaatacaaccatgaagacagccaaaggcatgccagggctttgatgcaagttccactgtagctagagccttatgcagccatttccaatgcagtgggttctctcttagaaatggggacccatctgggaagaaggttttcttccctaaggctctggtcaagactgtcttggaaaagccccaggaaatgtaattcagagtaacagagaagaaaatgaacagcctccagtgaaatggaagcctaaagggtagagctagagatggctggtgtcctgaaacgaatctgggactagcccagacctacaaaagatatctcctttggaaaggacctccccactgggtttagccataccgctgggtataataaaaatattgagagctagcattgactgaagattactattgtaagcattgtgctaagcactccactgagtacatattctcctttattcctgaaaataaacccaagcagtaggtaactcgtgttatattcattttacagaagaggaaaccaaagcagagaaaagctaagtaccttgcccaagatcaccagctattatgtgaaaaatttaaatctaggcagcctgacgccatgcccaacactcttttttttttttttttgagacggagtctcgctctgtcgcccaggctggagtgcagtggtgcgatctcggctcactgcaagctccgcctcccgggttcacgccattctcctgcctcagcctcacgagtagctgggactacaggcgcccgctaccacgcccggctaattttttgtatttttagtagagacggggtttcaccgtgttagccaggatggtctctatctcctgacctcgtgatccgcccgcctcggcctcccaaagtgctgggattacaggcgtgagccaccgcgcccggccactcttaagtactttataatattgttttaatggaaaaacactgccagtctgtttctaggaacactcatcctcaggataaaaagagatattataaagaaaggggggaaaagtgtcctatggtcagataagtttgggaactccctcttggtaatttctttatttgtaaataacatttgttgggagagtattcactccgtgggtatagcgtactttggaacacaatgccctgcggcattttttgaggtggcagaactgagtaaggatacaagaatccttacacagatgcacttctggaagtgagtacaaatagccttggatttgttttcattctagattttctaggctacctttgggagcctgagattgccagaatattgacaagctagaaccatatgatgattccttaattggcatgatagagcctattgttgtgtctctccctgaagaacatttgtatccacccaagtgcaaactctagctgacaactaactttttatccacactatctgagtctattttttcaaaatgaacgtagtattattggaaatatttgaaatatgctaatgactctatcaggtttttcatggccccagatgaatcagaatttgtaagatttttattttctagaaggaatttttattttaaaacattccatgaactctccctattgccatgttggatacgctttctgcacaattatttgggaacaaaggaagggagactaatggccctgggaaaggtatcctattaaaatcactggtcctcaatatgtttagtgaataatacatctgcttgtgaagctgtccagtctgaagctgtgttttaagtcttaaatatttcccccaacattaaattttatttttattaatttaaatgttaatgcgtagatgctgcttgcttctttggttctgaattttggtcttgatgttttataattgcacttatcgatgaaagtacctaaaccagtagaagaattagaaacttgaagaaattgtgaagaaggattaaaatggcagataggaggcaggactagtttgcagctcccattcgaacagacagagcagtgtttggagactcacatagtgaacttttgctctaagaactacctcaagaacatatcaggaaagccaagagaatccacagaccctttgaaggaactggatcaccactgcaggcttcctgagatgccaaaaaaaactatgagtctgtttgctttctcaaaggagaggctcttggtctggggcaagttctcagccctagttacctgttgcctggaaatagattcagtgctgttatgggggcactgtgggagtgagaccggccttcaggattgcaggctgcatgggagcagggtaaggcctgtgactgccagctttcctccacctccctggcaacttgtatgactcagtagagacagccataatccccctgggaatataactccattggactgggatccacaccctcatagcccacagcagctgcagcaagccctgccaaaggagaggctgaactcagacatgcttaccccttcccccacctggtagtctttctctacctgccctggtagccaaagacaaaggtcataatcttttgggagctctatggccctacctatcacctgagaaaccacttaaccaagtgttcctagggcaactaggaacacagctgatacactcttgtcagtgccacctcctggctggaggccaaccaacacaaaaccaacactctaaacaaaaacacaaccaaggaccctcgcagagacgacttcactcccctgctaattccatcagagcaggtgctggcatccatggctgcaagacctgaagacagatcacatcacaggactctttgcagacactctccagtaccagcctgaagcccagtagctcctctgggtggctagacccagaagagcaaaaacaatcactacagttcagctctcaggaagccccattcctaggggaagggaaagaacatcacatcaagggagcatcccgtgggacaaaagaatctgattagcagccctgaatcccagaccttccctctgacctagtctacccaaatgagaaggaaccagaaaaacatctgggtaatatgagaaaacaagtttcttttacatcccccaaaagatgataccagttcaccagcaatggatccaaaccaagatgaaatctccaaattgccagaaatagaattcagaaagttgattattaagttaatcaaggaggcaccagagaaaggtgaagtccaactaaaagaaataaaaattatgggatatgaaacaaaaagtcttcagtgaaatagacagcataaatgtaaaacaatcacaacttctagaaggcaagaaatgcaaaatgcactggaaagtctcagcaatggaatggaacaagcagaagaaagaaattcagagttcaaagacaaggctttcaaattaacctaatctgtcaaagacaaagaaaaaagaatgaaaaaattgaacaaagcctccaagaagtttgggattatgttaaacatccaaacctaaaaataatcggcgttctcaaggaagaagagaaatctaaaagtctgaaaaacatatttgttagaatcatcaaggaaaacttccctggccttcctagagatctagacatccaaatacaagaaactcaaagaactcctgggaaattcattgccaaaagatcatcacctaggcacatagtcatcaggttaactaaagtcaagataaaggaaggaatcttaagagctctgaggcaaaagcatcaggtaacctataaagggaaaaccccatcagattaacagcagatttctcagcagaaaccctaccagctagatgggattggggtcctctttttagcctccttaaacaaaacaattatcagccaagaattttgtatccagcaaaactaagcttcataaatgaaggaaagatagtcttttccagacaaacaaatgctgagagaattcaccactaccgagccagtactacaaaaactgctaaaaggagctctaaatcttgaaacaaatccttgaaatataccaaaatagaatctccttaaagcataaatctcacagaaactacagaacaataacacagtggaaaaaaaggtaatcaggcaacaaatagcatgatgaataaaatagtacctcacatgtcaatactaacattgattgtaaatggcctaaattctccacttaaaagataacagaatgacagaatggataagaatgcaccaaccaagtttctgctgtcttcaggagactactctcacacataaggactcacgtaaacttaagatgaaggggtggaaaaagatactccatgcaaatggacaccaaaagcgagcaggtgtagctattcttataccagaaaaaacaaactttaaatcaacagcagtttaaaaagatgaagagagacattatataatgataaaaggactagtccaacaggaaaatatcacaattctaaatatatatgcacctaacactggagatcccaaatttatgaaacaattactattagacctaagtagtgagatagacagcaacacaataatatgggggactttaatacaccactgatagcactaaacaggtcatcaagacagaaagtcaacaaagaaaaactctacctaaatgataccctacaagtgaacttaacagatatttacatgacattctacccagcaactgcagaatatacattctattcatcagcacatggaacattctcctagaccatatgataggccacaaaacaagtctcagtaaatttaagaaaatcaaaattatatctagtactttctcagaccacagtggaataaaattcgaaatcaactccaagaggaacccttaaaaccatgtaaatacatggaaattaaataatctgttcttgaatgatcattgggtcaacaatgaaatcaagatggaaatttaaaaattttttgaactgaataataatagtgacgcagcctatcaaaacctctgggatacagcaaaactggtgctaagaggaaagttcatagcattaaatgcctaaaccaaaaatctgaaagagaaccaatagacaacctaaggtcatgcctcatggagctggagaaacaagaacaatcgaaacccaaacccagcagaagaaaatgacgaagatcagagcagaactaaatgaaatttaaaaagaaaaaagataaatgaaacaaaagctggttctttgaaaagataaatgaaacagatagaccaacgagattaaccaagaaaagaagagagaagatacaaatatgctcaattagaaatgaaatgggagatattacaactggtaccacagaaatacaaaagattattcaaggatactgtgaacacctttacacacataaactagaaaatctagaggagatggatatattgaaagtatacaatcctcctagattaaaccaagaagatacagaatctctgaacaggcagtgagattgaaatggtaattaaaaaaaattccaaacaaaaaaattccaggaccagatagattcatggctgaattctatcagatgttcaaaaaagaactggtaccaattctactatttcaaaggataaggaaatagagaatcatccctaactcattctatgaagccagtatcaccctaataccaaaaccaagggaggacataacaaaaaaaaaagagagagagagagaaaactacagaccaatatccctgatgaacgtagatgctaaaatcctcaacaaaatactagcaaactgaatccaacagcatatcaaaaagatacttcaccatgatcaagtgggtttcatactagggatgcagggttgatttaagagacataagtcaataaatatgatacatcacataaacagaattaaaaacaaaaatcacatgatcatcttaatagatgcagaagaagcatttgacaaaatccagcatcgctttatgattaaaaccctgagcaaaattggcatagaagggacataccttgaggtaataatagccatctacaacaaacagataacattatactgaatagggaaagttgaaagcattccccctgagaactggaacaagacaaggattcccattttcaccacttctattcaacatagaattggaagtcctagctagagtcatcagacaagaaaaagatatcaagtgcatcccaatcagtaaagaggaagtcaaactgtcactgtttgctgatgatatgattgtatatgtagaaaaccctaaagactcatccaaaaagctcctaaaactagcaaatgaattcagcaaaggttcaggatacaaaattaatgtacacaaatcactagctcttctatataccaacagcaaccaagctgagaatcaaattaagaactcaacccctttcacaatagctgacaaaaaaaaaaaaaaaaaaaaaaaaaccttaggattatacctaaccaaggacgtgaaagacctctacgagtaaaactaaaaagctctgctgaaagaaatcatagatgacacaagcaaatggaaacacatcccatgctcatggatgggtagcatcaatattatgaaaatgaccatactgccaaaagcaatctacaaattcattgcaattcccatcaaaataccaccatcattcttcaagaagtagaaaaaacatcctaaaattaatatggaaccaaaaaagagcccgcatagccaaagcaagaccaagcaaaaagaacaaatctggaagcatcacattaccctacttcaaactaaactataaggccttagacaccaaaacagcatggtactggtataaaaataggcatatagaccaatggaagagaagaaagaacccagaaataaagccaaatacttacagccaactgatctttgacaaagcaaacaaaaacataaagtggagaaaagacgcctattcaataaatggtgctgggataattggcaagccacatgtaggagaatgaaactggatcctcatctcttaccttacataaaaattaactcaagatggaacaaaaacttaaatctaagacctgaaaccacacagattctagaagataaaattggaaaaagtcttctagacattggcttaggcaaagacttcatgaccaggaacccaaaagcaaatgcaacaaaaacaaagatagacatatgggactcaattaaactaaaaagcttctgcacaacaaaagaaatcatcagcagagttaacagataaccacagagtgggagaaaatctttacaatctatacatcttacaaaggactaatatccagaatctaagaactcaaataagcaagagaataacaaataatcccatcaaaaaagggctaaggacatgaatagacaattctcaaaagaagatatacaaatggccaacaagcgtatggaagaatgctcaacatcactaataatgagggaaatgcaaatcaaaaacacaatgcaataccacctcacacctgcaagaatatccgtaatcaaaaaaaaaaaaaaatagatgttggcagggatgcagtaaaaagggaacacttttacactgatggtgggaatgtaaactggtacaagcactgcggaaaacagtgtggataatctttaaagaactgaaagcagatctacatttaatccagccatctcactactaggtatctacccagaggaaaagaagtcagtatatgaaaaagatgcttgcccactcatgtttatagcagcatgatttgcaattgcaaaaccatggaagcagcccaaatgaccatcaatcaatgatgggtatatatatatcatggaatattactcagccacaaaaaggaacaaaataatggcattcacagcaacctggatgtaattgcagaccatcattctaaatgaattaactcaggaatggaaaatcaaacatcgtatgttctcatccacatgtgggagctaagctatgaggatgcaaatgcataagaatgatacattggactttggggactcaagggaaaggatgggggacagcaaaggataaaagactgcacattgggtgcagtgtatacttctcagttgatgagtgcaccagaatctcagaaattaccactaaataacttactcatgtaaccaaacaccacctgttccccaaaaacctattgaaataaaaaaaaattttttaaaagaatttgttcctttcctttttttaattacatgtaaaactaggtttatggccatggggcatctgtgactcctcctctttttctttagagatgatcttctcattttttattctgatatgttatttcctctagcggcaacttatgttagtgaatggcttttctgtaagacccatggcagatacatatttttttttctgctgggaattgctgagagcttttcctaaggtttgaacacatttagaagcttcactaacacactcaacaaccttatgtctcatcagtttacatagacatttctactaggatgtgtaaaaagacaaattgtgtgtaaattgatttgcaaaatacatctgtgagataaagcaagatttgtttacaatgagtcacttagaatgtggtctaccttttagtctggatttggtatgagagattccatagtcattttagagccttaggctacatgaatattgctgttgttattgtatcatttagttagaatatacaatttctgtgcaaaagtagacaccacccagggtatacagcataataatgaccagttcttttctatctgacagtctggaagggtggcagatgaatgctatgagagggcccccttttctacagcatgcttagcttcctccccgatgtatgctttgatttggccttagaaagtgaaggcatgtggttgtaaaggaagcggaagcttaagaaattggtatcatttatcctggagaataagggccatagaaaatcttactaatggtatccttagtgccccagtggatttcctcccacccaagaatggaatacatacaaatccatggtagggctgtctggaaaacctaggctaccttattgcaatggtatcatcactgtatcacacacttggctcacaaggagacgtcttatttcaataagaagctttgactgcccacttcatgtcaggcaaataatatggacaggacacagttccttgcgtcaaggagctcatagtcaggcaacaatggcttcacatggatagaggcatttaaaccaggccttgaaaagttaggaagtggtaaaaaaaaaaaagaacaaattagaactcatgaaagtacatagtttgaggagtagaagatgtcttcataaatctagagtaatgggtgagtgaggagggggtgggaaacgagtaaagtgaaggatgagagtttgtgaagggtactggatgcaaagctaaaggttggagttggtgctataggcagcaggcaccactgaggattttaagcatgataggacttctttctaaaatagggatatcacattgactattttaactgctaaagtactatgataaatagaatagagatacagaaaaacagagtagggagatcccagttatactgagcctagagaactacagctttggagttgcttagcaaattttatttgctgtggtggatgagccagcttctacttctctatgttaaatataccaaagaggaagtgatggggtttccagggatgctgtgttcttcgcctacacgcttctctgcatcatgctaatgctgcattttgcaaaagctgtggtttacccagcttccaatgaattttgttccagtaaacttgcctaaaaacagaagtctgcaaaaaataagaaaatatgctatgaacatctgatcggacctttatggttaactgggtttttttaattgccgtggaacgtaagggtttagttagtctattcttaggctcctcgactcctgcaaacattctcaaaaataagcactaggaaaagaacgtttctactgggtatgtgacaggataaagaaagtattgagggaagttgattattataagagtacttatttataatcctgctcgtgccctcctcatattagataatcattatcgatgagctgatgcttggcccatgtgcttgcctgacactagcattttcagactacatgtgacccagatctcactgatttttcaacctttaagtcctcctttcttaatccttaaataattcaaaatctctaggtaagtgagaggcagcatggatagtagaataagcatgtgctctatgttagaacatcttggattccaatccttctgtgctatctagtagttgtattttcctggacaaattatttaacattctatcattatatatagattttgaaacagagtctcgctctgttgcccaggctggagtgcagtggcacaatcttggctcactgcaacctccgcctcctgggttcaagtgattcttgtacctcagcctccagagtagctgggatttcaggcacacaccactatgcccaactaatttttgtatttttggtagagacggggtttcaccctgttggccaggctggtctcaaactcctggtctcaagtgatctgcccacctcggcctcccaaagtgctgggattacaggcattagccaccgtgcccagcctaaattatttaacattttaaatctcagttttctctttttacaatgggaacaatttatcttcagttcttgataggataatttgaaataatatacacagtaactggcccctgctaagccatcaataatagtaactattattatcagattctaattgccaaaacagcaggttggatgttccaggagaggttataatcccagtatcaactctcagctctcgagtcttcatgtctgtatcccattgcaaagttcagcttggtcaggggaatcctcacagtgaggaggccctcataataaagcccacatgtgagtttggcctggataagttaactcacaaaccttcaccccagtgtagccaccatccatgagtatacatgaggctagtgtataaggctaattctctcctcactgttgtagtgaagagcacttaatagatgtgtcataaatgttatgcagacttaacactctgaggacatggggatgcacagatcatttttcccatcccttttgctctctctgtgatgtccttaacctaaataacagtgtgtagagaaaaatttataatattcctgaggaaaagaatagtagaaacagtaaatagctgttaaggtcaatataatttactacaaaataagttgtttgagatacagaaaaaaatcaaggcagagaaaacacaaccaaatctagtgcttactatttacaatttaccctggggcctgaattttcaagaaatctttctgttttttaatatagtcacaacaccacaatttttaagcattttcagaagatcctcatgcataaaaaaccaaggatggtgaccactgatgcttgtattattttcctttctctgaaataatggcatcttttaaaaggaatatatttaaaatgtaattgaaattattgagttgttgctctgattaatgtatgtgggaaaatagaagtcaggaaatgtttcaaaagctatatttctgttctcatcgccaatcaccatagaccctagatccatttagccatcccatattcacttgttttaggcaggatgttagaataaagaaatattttatgaagtgcttcatactggaatttactccttttctgaaagagggaagtgtgaatttatcttttatagtgaaataattttacctgaagtcatttcaatgtcatttttggtcataaatgaagagtttggtagaggaatctttgaactaattacctttctgaaaccttacagtattttgttgcaaaaaacaatggttaaacttataaagcagaggtttttggtaaagatgcaaaacatctacctaagaaagccccatgtcctatattttcatttttataatctataaacattaattgaacacctgggagaatggaggagagaaccaatatttacctcctatgtgacagttacttaccatgatctttttaaatcctcaaagccgccctgtaaggcatgtattattaccactggcaggtcattgggcctgtctgggactcagttccttatcagtaaactagatggtaacatgcttgcaggactgttatatggatcaaacataatctaggaaaaacacatgtctattagagttgcaaagatggaaaatacatggcacatgatgttaaagaaaactgtagtggcagtgctgctactaatggtgatcatctcatggcttgaattgaaacagagcactttggtggagcagtgatgtgggatatagagtgacaaggcaatgttcatagtggttgtgataaggaagaacttcaataatgtcctacagcgttttataacagaagcatcattttactaatcacaaatatataacatttcccgatttttttaaataaaagaattggcagtgaatactcttgctttaggacttaaatgaagtagagtcaaataagatttctcatccaggtcttttattttttttctttgatatggagtcttgtctcccaggctacagtgcaatggcacatcagctcactgctgcctcaaattccctggctcaaatgatcctcccacctcggcctcctgagtagctgggactacaggcatgcaccaccatacccggctaattattaaaattcttttttatagagacagggtctcactgtgttgcccaggctggcctcaaactcctggactcaagcaaccttcctgccttgacctcccaaagtgctgggattacaggtgtgagctactgtacctggcctcatcccagtcttcttaaattgatgtgaagatggtagtagattatttcagattttaggatgaactaataatagcagttagcatgcttgaacagactgtatctagttctgagctaaatgctggatatgtgattctcattgagtccaggaggtaggaaccactattactcctttgacagatgaagggactaagactgataatctcacaacttgcaaaactagaaaatctcatatttcttttttgtaaggttgttttttattctttgcccttttttaaactaagaaatatttcaaatattgaaaaataacattgaatatcctccacctagatttcataaatgttaacgaatctggatatttgtttcagatccttagttcagaagaaattaaaagttaccaatacagttgaaacctgttttctacctctccacaatccatttccttctccctctgcagatgtaaccagtgttctgagattgttttaaactcactctagaatatgtatataaaaaatggtatcatatagtttttgtgattttgaatttacataactggtattttcttccatattcaggtttatccttttgtttatttcttctatctttttgaggtaaatatttagtctattaattttcagtctttcttattttctaatgtatacacttaaggccatgcattaccctctaagtactagtttagctgcattttgcaagtttgaaatagtgccttaaagtttccaaaatagagagttattactgcgttactgagctccaattttgttgcatatgagttgtagtgtggtctatagaataccaactttttgttatttattgagagttaactttggctcattactggtcaatatttttttaaatgattatattgacttgaaaagaagatatagcctccctttgctgggaatagagttctacatagttcattagagcaaacttactaactattcaaaagtactgtgtcatttgaaagaagtatattaaaaggccccattaggattgtgattttataaatttctcctttaatttctatcagcttagctctatgtagtttggggttttattgctttatacagtttagccaaaagaccttctttatccttaatgatgaattttctctgcaagtctattttatcaaatattaatatcatagaaccaattcttttttggttacttttttttttttttactattccttttctgacttacctcggttgttgtgttttagttgattctggtatattttaaaatatccaatctgacaatagcagttaacagggaagtttgtcatgtttattgtgattacttacattttgtgattttctaacattttctattaaagttgctattttgctcctttttttctccttgtttgctttctattggattcagtggtttttcttaccctctctcctcattttctctccactatttagaaacttatacattccctttcttttttttagtggttactattaaatatcacatgtatatttgtcttaattaaataatatagtaaccacagattgcttcaatatatccccttccatcatatatattattgttgattagtgttttagttatgccttgtttataaactgtccccagatttgttataacatggtcattattatctgctgtggtctgaatgtgtctcccaagtttcctatgttggaaatgttggaaatcctcaatgcaacagtgtggggaggtgaagtctctgggagctgtttaggtcatgagggatctgcccacatgaatggattgatgccattataaaagggctggaaggagggagttcaccccatttttcccttctgtcttctatgtgaggacagtttctcccctctggaagatgaattgttcaatgtgccattttggaagcagagactggatcttaacctacagtgccttgatcttgaacttgtcaggctttagaactgtgagaaaataaattcctgttctttataaattactcagtctcaggaattatgttgtggtagcacaaaatggactaagacattatttgtttggctttgccacttactggctgtattactttgcaagttttttagatgtgtgatgcctagtttcctcatggatatactggggatcataatagtatctaattataggtttattgtgataattagatgagcttcatcagttcctggcacataactgctcagtgaatttcagctgttatgatttagttagtacttattagattgtcaacatgttcactgatatgtttatgaactattatttctttctcctggttcagttaccttcttcctgaagtaggactcatagtagttcctttaatagagttctgtgagtaataaactatcagttttatttgaaaacacgtttactttgttccatctttgaatgatgttagttgaatgtgaaattgtagatagcagttatttttttcccagaatttggaagatattattttattttttctggctcttatagttgttcttgaggaatctagttgtatcagtgatgatctgcattttcaccatgatttgtttagggacactttaaaaaaatatttccttgctcttacttttttttcttcttcaatctgagaactgggagctcttatgtttttttttttaattcagtaatgtcataagctattattgcctcaaatattgccttcctgcattctattctgtccttctgtaatccatacagaataaatctatcattttgtctcccatgtctctcaatctcactctcaggttttccatctcttcaacttgctttacaactttctgtgtgattttctcaggattcatcctttcaatttatttctctttggttgtgtttttaattctatttaatccttccatttagttttttagcctgatgcttggcatctggagaagacaagaacaggaaaatcaggacaatgacctgactgtgtcacccattggcatgaaataatgaggaaggggtgaggagaactatgaaaagcatgaatggcatgttcagtgatcctcaatcagtttaccaacaagttttcttggtattttaaccttttgtgtgtgttttcaaaggcgttgtaaaaaacaaaacaacatataaatttgttaaataataataatgtatctccagattttgcttatcacaaaaatttataacaaccatactttaatttaaatgaccagtgttactgtatcaaattggtattctttcaactaagagaaaagaaattaaatttgccaatttagtttatttggggtaccatctcacccataaagatataatttttctatgttttttagaatacttgaaactggttcatagagtccctttcgtgatcataggtttgtaaacactggcataacattactgattggagctctagaaagcgggaagtcattcttgcctaccatcttttattcagcatttagctactggctgatctagaaactgcatctacagccactgctcattaccttcttgacccaagttgcagcatctacagaagatggagatgcagtttgtaagtggtccaggaatgagtgttggttagcttttagaggatgttgcttggactagcacaaggagtatcatacaaaactctcttgttgccacccttgacaaatgaccctaattttcatatcggattagaaaattcgattggaccatcaaagcaaatgtgttcttttatggtttattagtgattcttcccagctttggtaagtgcaatttatataatcagctctcaaagattttcactatgggtttttatttattcttgcagaatagtgccttagaaaattttatacggatttttttttgcaactattaagcagttttcccttattcccactctctcaaaccccaatgcccagcatgaagaagaaacaaatctctattttcaaatctaagccactcatgacacacccagctgggcttactctgaaattggatttccattgaaggacagtgggcagaacactaatcacttgggggcctggggaaacagtgggagggtgaatcaggaagccatcaggagatgcagccctcttgctgctttatgtagttagagagagagcatatttttagaatggactttgctaggaggataaataatacagttctattatttggacgtttgaatcacacacgtctagccctttaactcatctgatatacccctatgtactattatttttccatagggagaaaaaggcattaagtgagggataggtatattaatgaatatacttagagttactatattgaaatctggggaatatagatacagagaccaaaatggggagtggtgttgatcattgttggctagtggccctgaatggagcagggagtaggttcctgaatgggcacaggtaggaatcatgtgggaaatgggcacgtgtgcatctttcaaatccctccatagggctgctgcctactgcttgtattaaaaggcattttatgttgcatctacttgaagatgcctaaatatgctatactttcacctctcctcattcaacatatgtccatatgttatgtatacttccattgtcagatttgagctcttgaagcatgatttttaatctgtgcatgcccacatccagtgcaaagtaaaaaccaatagtgtctttcaggtttagaactgaccacagtcaagtactttaggacaggaaagtgagagggccagagggaagcttcgctttggggagtaaaagaaccaatctacagaggcccttggtctcccacagaaacacagaaatgataaggaagtataactatgactaaagagaaaggaaagaagagagagagaaagtgaagaaacacagccaagtagaagcagagcctgctcagggaagcatagatgggttagaggagggacatttgggatgcacatcagaaaatcagatgagaagtccgcgtttgtctgttttgtctggtcaccataattgtgctggctctgagtttcaacctttgttaatcatacagccttgtttaaatatggaatcatttttcttttgtccttccttgactccatcttaaacatcacattactgataactcagagaacttttaacctaggcaatcttcatgtgagttccattcagttccttttgatatacacatatttaaagtgacagttatttcctcttatggaagatagattttatttaataattttttcaagcggagagattagttgtggtcacagtagaaaatttttcataattctccaagtactataaaaagtaacttgatggcataaagtgaattcccatgatgagagtcatcctgtcactgtgaattgctgtgatcatctttaaagtgatatatctttccacactgtctgtcagcaactatgtagggtttgttttagattcaaaaatgtgtgagattagttgatctatatccaaagaattcagacactttttgttgtttttggatctagtcactgttcactagttcagttgtggggtagttttcttatgtttatctgtcctgaagttttatattcagaggcagtttttacatgctctttttttcttacccttcacttaatgaagcagggttataggagaaaaataaccttttatctttcctcagtgatattaacttcattgcatttaactttttaataaatcgtatgcctactaatttacagaagccttatttctaaaaaatgtaatatatatgacttaagactgatcaacatcttcccctttctactacatacatattcggagtttttattttgttttctttctgtatatttcagactgggaaaaaatgtactatttgtaagcagatgatttaatttcagtaaatgtttttttatttctctctccctttgatttattgcttggaaaccatgagaaacatccaagtgcagatgctgttttcccactctgacaaaacattgcttgttgacctcgcaaacttagaaagatttatctcctgtgattcaatggtggaagtaataatattagcagttaaaattttctaagacacgatcaggaaaaggagacttcggtcgttctgcttcttgttaagaacagctggcaatttaaaaagcagagacttgctaagggggaaggaggtaaagaagatcaaacagaaatgcctccccctttagtgaagtatgaactgagggtgctgcatagtagcaataaaatcagattcttaaatgctttcccttgtttagtgtgtatatgtgcttatttttatttagtcttcaaagatgactttccttatatatttattctcttcgcaggaaatacatcttgaccaaatattttttgccaaatacttgttgtatattaaagccagcttaaaatgtcatatttgctgtggctatgttgagactctgacaagattatctgcagtgtgagtgatgtctgcaagagtggcctctcaccatgccttctgcacattgattccactaatctgccaggaggcagaggtgattcctatcattctgagagcttcctatagaaggcagggcctctgcagtctctagaactgaggaactaaatgaaggccaccaaagtgaccattaagttccttaattgtgaggaagcatctttaagaggaaatgattctacagccagaaatatgcgtgaccagttctacaggatgtgatgtcatgtgactggtggagcttgtctttctatcaaaggcttgtacagaaaagggaaaagaaatgggcatgtttcaggtcagttctgaataatggaagaaagaatgaaaggaaggagaggggaggggaggggacaggagcggagggaaggggaggggaggggaggggacaggagcagagcggaggggaggggaggagaggggagtggaggagaggagaggagaggagcggagaggagaggagagaggagaggggcatgtgagctggatttcttcaaaccccaccaacctggacagtgagtcctggaatcaaaataatggtgagcctcagcatctaacatcaaacacccagacttccttctggtttaagaaattccaaaggctctcagctgtgataaaattaaaaggacatattcctatttgttctttttgttattggttctctgtctccccctgaacctttagccagaaatagagatgcaccctttcttcttcagtagctttgaggatcaaagaatcttagttgccagagctgggaggggaatctcaaagattgcctagtggaacaatatgattgttcatgtgaataaactgaaactcagagagaatgtggtctatgcaagacatggcccatagtctgtgtcaaaagccaggttttctgacttgtggcccagggctctctgtagtattctgggccagcaaaatcccgtgtctctccagacacatcttctcttgcaccaaatgggcctccttgctgtgtcctcctcaaaccaccctcactcccacctctgaacctttgctgatgttcacaccctgcacagagtgcccttctcctccaactcctctgctcagcacatcacatcccctaatgctcagcccgatctcatttccaaagttaaggctctgctactcttccagcccaaattgatgtctcctctccctagaccccttcaggtcttttttcattccctgtttcatgtttgattttaacttctcaaccagatgatactttcccaagcctatgtttttgtcttttccacagcagtcctcccagcacctactgccaggccaagtgcttttctctacttcagtcttcttctctgttaaatgtgaataataacacctgctctaaatctaagcctagtggactcccagcttgttgaagggcatgttgaatagtcttatgtactggaagtttgagcttttgggagggtaaaagaagggacagggatgcctaggcacacagaactcaaatgcagttatttgggttttcctctaacttagcctccactggtcaaatgtttttagcacctgcaccagcagccatttccatgtatcccttctccctggagacagtacaaacaagagataattcctatcattgttgggacagaagtctctcaaagcccttaccaatattatagttttgagattcacagtttcctctgaaacttcccctttaggagggatggaaaccacaggatgggcattctggtaaatgctcaacatagatacctatggactgggtagcaggtgacccctaggaaaacctcaaatatcctataaggtcctaataagggccagttattctaagcaaaggagcttctgtgagtcatagtgcaatccatagatatgcttgttagctccttatttaaacccttcctgaaacaacagccaagaaaggaaaggactcaaggtcacctctggaatcagaatctactcagtcttttcccatcctagtttgtattcaccatattcagccctcagccaacttgaggcagagtgccttggtagaaagtggttcttagagacaggcatccaggcaatgtagcaaagtagaaagagccctagactagaagtataaagacccaggtttgaggcctgactctgccacctgctgtctcaaaaactgcaataatataaagtctcttaccaattctagcttcagtcttctcctttgttaaatgtgaataacaataatgccttccctgccagtcatggtggctcacacctctaatcccccctactttgggagaccgaggtgggccaatcactcgaggccaggagttcaagactagtgtggccaacatggcaaaaccccatcctactaaacatacacaaattagctgggcgtggtggcaggtgcctcttgtcctggctactctagaggctgaggcacaagaatcacttgaacctgggaggcagagcttgcagtgagccaaaattgcaccactgcactccagcctgggagacagaacaagagtctgtcataataataataataataataataataataataataataataataataatgctttccctacatctagctataattatttctttaacatttccttccctgctacattgtcagctgcataagagcagggtctatgtgtatcttgtttaacactgtatccccagaaccctagtaggacatgtactgtattaactggttggttgactgagcaatagggagaagtttagagcaagtgcaagctattattatgatccttattatgtttgatgttgttgttatgtctccctagagtttggtggattttggtttggatttccattccactctccatcattgagaaggaactgagtcaaaagacccatagtggatcagcagagaccaaccactcaccatggtcataagtaatttcagagcccatagtatctctctgtagattcttccctagtctcagtacttggccacagagtggatggctttgatcttacacagattgattctatatcccttgatgggtgtgtggcagcaatcatcaacagcaaggtgaccttctctgcttatcatgactggccccttttcttctataattttcttctttggtttttgatgtatgagtatttttagtgacaaagataattaggtactttagtgacaaagataattccaatggtactgtactaaatgtggcttctgcctgaggatgcacttgtgtctgaggaggatctagactgtccaagtgagctcttattttaaagcccctcttacaggttggctcttaaggactgaggagaaagcagggcctttagcatcagacaggtctacttttggaagcccatgtagttgacaatctagctacatgggacaatgtagctacagggaaggaaatgttaaagaaataattatatgtgtgaagaatacctagatgtagggcagatattattattatcatttaacatgaggaaaacttagtctgagagaagcaagaagctttgctccaagtttttgagacagtgacacagataaggtgtctctccttattgtataatagggacaataataaagccatcttcaagggatgttgtgatgaatcagtcagaaaatgtatgtgaagttaatgagcaaagagtctggccatagtattaattagtattaatactattaataagtattcaataaaggagagtctcccactttctttccttccactctgttttccataaattaaccagagataaaagtggtggaattagacttcagtcctgtaatggtgcacctgaagtgcttcctctcaattcatatccatcttccagattgcttgttgtacccatattttctgttaacacaaattggagggagtatcatgactttcatttgttgacagatacacaaatgggcagaacacaatgatgaatgtctcaattcagacaggaattgaatgttgcctgtggggtaggctggctctgccacctgcactgacaatacatcatccctggaaattaacccatcttcaccatagccattgaaatggaaagaagtgcttgttcattaaaaacaccttcaaatggaaaggatgaaggtctagcgtagtatatatggtgcattaatatctataatcatgtttaatttgcattagtctaactctgccacttggaaactgtttttaagatattgtgttgcctgaatgggtttgtgtatgcattatttgcttcttgaataagagctgaacagaagctaatagctttatataaaatatagtgattaccaaattcaagagtcaatgtcctgtttcacattcattcttgctcacttttagtacaagcttatgcatcatcaggcatgttgtatacaaaaataatgatgtgggtcctggtctttataggtctaatgggtggtagttccatatttctgtaaattttaaaagcattattactcactaaatatggatcattttaaaataattagatatatgtatgaataggcttcatatcacaaagttttattttctttgttaaggatatgaatcctaatgtctttactattgaatctgctaattcaaataatatctatcagtaggtagatgagctaaacactaagcctgtatgtcaaattttatacacgatattatgcttagatgcatacatagcaaaaccaatatttacaatatattggtgtacaaacaatatattggtgtaaaaaaatgattagtgcttcatcaagttaatacattcaggtatcataattatgtattatttcatagtgtatcaacaaggagaagagaaactagttatttcaagcaggaagtgatttaatttagggaaatagattctataacagaaagaattaatgtttaccaaacactatattgttctcccgttctctcttgctgttaattgggaccctgtgatagtcctggctgaaggactgtgaaggggagggaagaattaatatcccagggcctaactggttaagagcttgtgtgcctctttcaaccctcactttccctggaataaaccttggagctatatgttgaaatagaaaataaaaatatggatgaatcttggtcgtctgagtcaccagatagaggagatctcttgccaatctgcacgggattttgcatgaacaaaaagtcaccttttactgggataagccacagaaatttcagagttttgtctattgagacagctagggttagttactgtaaaaatactagggcctggaaaaatgttggaaggattgagagagggaagatcaggttgcaactactagtatgcagaaaatcataaagcataggaactgcaggaaactgtcaccaatgatctcagctgtctacagcaccaaagtgagtggtcagtaggaagatacttggaagctgttagcaaaagctcacatctggggtctacccaagtccatgtgactgcctgtctcaaaagagtaataatagttctatttatcttttgtctttgaaaccttgcatgaatgagtctaattgtcttaatttaaaccataaccctgctggcagagattctaagaaatgtagttctcatgcttccaatccctataatactaaggagagcgtagaaggagaaaatggtgtcaaattgccaaaaaaaagaacctggcatatagaagtagcccaattattaggtgatgacatgccccagtttgtctgggacagtcccaatttattcctgttgacctagagtaatttttgatagtaccccgtttcaatctcaacatgttccctgcttggacactaaattatatggacatcgacctattaataacatgataaaaatactttatttcatcaaaaaacacttattcaggatatgctaagtgctaatcattgtgtgggacattggtcaacagaggcatttatgaccttggcattcatgaaacttagagtcgaatctagtgaatgatgggagcctaaacaaggcaatagctatgaggatggagcagaggaggcatactcgaaagaggttgaagaactaaatcatacaggtcttgataactagcatactggttaagacccttaggctcttacgtcagactatccaggtttgaacaccagctctatcacttgttgggtattttaacttgggaatttaccaactaatctctgcctcaacttacaactctgttaaatgggaattataataatacttataagattgttgtgaaaattaaatgagataaaaatttataaagtttataagagggcctaaaatatagtaaatgctcaagaaatatcattatagtgaagaaattgtggtggttgttgttttataatggctgaatatgagagaactgttaagaaaatcctaggtttctgacttgaatatcttgatggatggttatgtaaaataataaatgcagaagaagctgatttatgtgggggaaaatagtgcatatagtttgaatggattgctagaagagtaaacagaggaattggcattctaatttaagtgggggaagtaatgcatttggtttgattatgctgagtttgagggactggtgggaaatccaaatggcaaggtctgatagcagctgaatagttagaattggggctcagataaagatctgagctgaaatttagacttgtgaggtttttttttttttaaaaaaaaaacacttctattttaagtttaggtgtgcaagtacaggtttgttacacaggtaaacttgtgtcatgggggtttgttatacagattatttcatcacccaggtattaagcctagtacccattagttgtatttctggatcctctccctctttccaccatctcacaccagtcagaatggctgttattaaaaagtcaaaagatttgtgactttctagatggtagctgaagccaaggaaatttgggagatgaattagagaaggtattcagagtagaccagaactttaaagggcagaggaaaagaaacatatgagaaagacaagaaggaattgccagaaaaatagaagagaagcaggcaagtgatgtgaaggaaggcgaggaaggagagaaagccagaaagaacagggtggacgatggtgttaagtgtcaagcacaaatcaagaagatgagaacagaaatgatttccacagattcagcaattgagggcttttgctgattttagtaagaatagattcagtggagtagggaaggtggaagtcttctcaggtcaccaagggtagaggtaagaatgagaagagagaacatatagatcatgaaatattaatcttcagggtgcttggctgtgaaggaaaggaaagggtcaactggtggctagaggctttttaaaagcacagcctacaagatcctttggtcctagagttgcacaaaggatttgcagaccaggaaaggtttagataacatgaccaccaaagtcttccccatttcaaagtgtttattatttcatgattctctgcttaataagtaccaaggttcagcttttattttcacaggttgttacctgtaaagagggtacaaaatctgttttatcctaacaaatttaagttagaatttagtttgatcttacgagtctttagggaaatatattttaggagtcaaaatgtgtatctgtacatagtatatttatgaatattgttcttaatttttaattcagtacctttacaaattattttataattggttcctgttttcaaccagttgcttgtgcttatatatgcaatttgtctatttttttcatatctgttttcagcttctcccaaagaattatcattaggtcataacactgggggaggtttactgaatgatcattcttttcaaagactttaccatttcccccagagccttggttggtttattgactagagcaaagcagttagtttgctattagtggaataaggtaggcaaagcatctggaaatgttctaccaggaggagccagtggccttgttttcgaaaagtcccaggtctcccatcactccctccagtcttgctagggcatgaaagaatcagaatttataactgcatcataattctgtactacagcctttcatctgggatcttctgtttggaaagtctcttcaaatgttttcttagcctcaagggaaaaatttctcccagagatacctcaattttgatcaaaagcattcacaagtccacttttagttttttctctaccaattaaagtcctcttagcttggtagattaaagctcataaaactggttccactggtttattagaaaactcactttagctagaagagtcgaagttttgatatacacagaccctagagagctaggaaaatcttacttttctccaaaggattcaagtcctattatttaattttcatctgattttggccaagttcagatttttgctgactgtgtaacatagcctattcatttcagctacaaatagttctcttttgtttccatttacttagaaattaacaaaatattgccatcattttatgtgttttcataaatgtatttaaagccttttataattatgatatttaaatattctgtttttaaattccaaataacattagttgagagatgcatctttgacataaaaaaaaatttcaggagaaaaatttcttgtaaaagcttctcaatgagtgtatacattgatcataagaccattctaattctagaaacattaaatatgaaaaagtatacttttggaattgaaaagatatggcattaatggtcatttcacttgacttgaggcttcccatgtgtgggattcatcattacttcatatgcatctatctaatcttcatttatccattcagctcacagttattgagaacaatattaagtcttaagctcttttgctaagcaacggacaatgaacactccctggtgctagttagcatccgaatttgtaaagtgagccatttgttgtatgttttaaccttttaaaaaattcagcatttttctctaaatattttgaaatctaactcaagaaaaataaaaatcacccagtggctttttcacataattttaatcacctttattcttctgcttatcctgtctcctcagtcttacattcccctacactatgcagcaacctgagttgatagctatcataccacgccatgctactctcatcatcatacggtggcatgattaagacagagaagacttgaaaataagtatgcttaaaatcttcagaaaataaaatgtgaataacatccactaaaaaataaaaacaggagtttatgaaataacaattaagtggtaatcaaattagaacatgcagattcaaaagacaaccgattgaaatgattagaaataaaaatgtatagtcatttagaatttctagaaaaaaatctaaataaaaggaataaataaagagaatgctgtcaaagggagactttataaattggatcacggaaattagaaattaccaaactgtgcaaaacagagaaaagagaactgaaaatataaaagattttgtaatgcaagaagttctattatatataagtaaatagttccagtgggagaaaatagagaaaattgctgaacagtttctagaattaaggcaagatgtgagtattcatattccaaaaaggacaaatcatgccaagcaagatgaaaattttaaaacctctttctatatttacattataatgaagctaaagaacatcaagggcagaatatttgcttttctgaatggggagatatgaaatatcattgaagctttccttgattactagaggtttattcctgcattctgttgtgataacactttcttctatgttgatttagttatttgcctgctgtaacttctcatgcagtcattgtactggcctccagctcacttttgtttactgctgttctatgctatttgctggacaaaccaaaaaactgcctttgttaaaagacttacaataaacaacaatagcttattaaacgaagaattggctttaaagaaggtacatgatactagcgtagcaaaagctaacattaatcaggtgttttctatctactagacatttttacaagatttttctcacttaaccctcacaatgtccccatgaggctggtattactctatcacccccattttacagatgaggaacctgaggcttagttagagaaactgattcacttgcccaagatcatgtggctttagcaagtatgttaagtggtgcctcctagattttaacaaagtcaaattctaagcccaaaatttttaaatactcctttttcttatcctttttttttttttaacttttattttaaggtcagtggtacaggtgcaggtttgttacctaagtaaacctctgtcatggggtttgttgtacaggttatttcatcacccagctattaagcctagaacccattagttatttttccttgtcctctccctcttcccagccctcatcctccaaaaagccctagtgtattttgttcccctctacatgttcatgtgttctcatcatttagctcccacttataagtgagaagatgtagtatttgtttttctgtttctgtgttaatttgctaaggataatggcctccagctccttccatgtccctgcaaagaacatgatctcgttcttttttatggctgcctagtattccatggtgggtatgtaccacattttctttatcgagcctaacattgatgggcatttaagttgatcccatgtctttgctattgtgaatagtgctgcagtgaacatatgtgtatgtgtctttataatagaatgatttatattcttttgggtgtatacccagtaatgacattgcttggttgaatggcatttctgtctttaggtctttgagtaattgccatgctgtcttccacaatggctgaactaacttacactcccaccaaaagtgtataagtgttcctttttctccacaaccttatcagcatctgttatttttgactttttaataacagacattctgactggtgtgagatggtatctcattgcagttttgatttgcatttctctaatgatcagtgctgctgagcttttttttttttgtatgattgttggcttcatgtatgtcttcttttgagaagtgtctgttcatgtcctttgcccactttttaatagggttgtttgttttctttctgtaaatttaagttccttatagatgctggatattagacctttgtcagatgcaagtttgcaaaaattttctcccattctgcaggttgtctgtttactctgttgatagtttctttggctgtgcagaagctcttaagcttaattagatcccatttgtcaaattttgcttctgtggcagttgcttttcatgaatcttcatcatgaaatctttgcccttgcctctttccagaatagtattgcccaggttgtcttccagggtttttatagttttgggttttacattgaagtttttaatccatcttgagttaattttcatatacggtataaggaaggggtccagtttcagttttctgcatatggctagccagttattccagcaccatttattaaatagggaaacctttccccattgcttgtttttgtcagcttcgttgaagatcagatgattgtaggtgcatggccttatttctgggctctctattctgttccattgatctatgtgtctgtttttgtaccagtaccatgctgttttggttactgtagcctgtagcatagtttgaagtcaggtagcatgatgcctccagctttgttctttttgcttaggattgccttggctatttgggctcttttttggttccatgtgaattttaaaataaattgttttagttctgtgaagaatgtcaatggtagtttaataggcatagcattgaatctataaattactttgggcagtatggccattttaaagatattaattatttgtatccatgagcatggaatgtttttccatttgtttgtatcatctctgatctctttgaacagtggtttgtagttctccttgtagagatctttcagttccctagttagctgtattcctaggtattttattctttttgtggcaattgtgaatggaagtttatttatgatttggttctctgcttgcttattggtggtatataggaaggttagcgatttttacacattgattttgtatcctgagactttgctgaagttgcttatcagcttaagaagcttttgggctgagacaatggagttttctagatataggatcacgttatctgcaaataaagataatttgacttcctctctttctatttgaatacactttatttctttctactgcctgattgccctggcctgagcttccaatattatgttgaataggagtggtgagagagggaatccttgtctagtgaaatctgattttcaaggggaatgcttccagcttttacttattcagtatgatgttggctgtgggtttgccatatatggctcttattattttgagatatgttccttcaatacctagtttattgagattttttaacatgaatcgttgttgaattttatagaaagccctttctgcatctattgagattatcatgcggtttttgacgttagctctgtttatgtgatgaatcacatttcttgatttgcatatgttgaaccaaacttgcatcttggggttgaagcctacttgattgtggtggataaactttttgacgtgctactggattcagtttgatagtcttttgttgagaatttttgcatcaatgtttattaaggatactggcctgaagttttctttctttctttctttctttttttttttttttttttttttgtatttctgccaggctttgttatcaggataacactggcctatagaatgagttagtgagtagtccctcttcaattttttggaatagctccagtaagaatggtaccagctctttgtacatctggtagaattcagctgtgaatccatctggccttgagctttttttggttggtaggctatttattactacctcaatttcagaactcattattgttctattcagagatccagtttattcctggttcagtcttgggagggtgtatgtatccaggaatttattcatttcttctagattttttagtttatgcgcatagaaggttcataatattctctgatggttgtttgtatttctgtggagtcaggggtaatatcccccttatcgtttttgattatgtttatttgaaccttctctcttttctcctttgttagtctagctagcaatctattttattaatttcttcaaagaatcaactcttggacttgttgatctttttaatggctttttgtgtctctatctccttcaattcagctcagattttggttatttcttgtcttctgctacctttgggatttgcttgctcttggttctctagttcttgtagtggtgatgttaggttgttaacttgagatctttctatcttttggatgtgggcatttagtgctatagatctccctcttaacactgccttgtctgtgtcccagagattctggtacgttgcatctttgttcacattagtttcaaagaacttcttgatttctgccttaatttcattgtttacccaaaggtcattcaggagcaagttattcaatttccatgtaattgtatggttttgagtgaatttcttagtctttatttcaattttgattgtgttgtggtccaagagactgttaatatttccgttcttttacatttgctgaggagtgttttactttatgtgatttattttaaagaaagtgccatgtggcgatgagaagaatgtatattctgttatttttgggtggagagttctgtagatatctatttgatctaggtccatttgatccagggctgagttcagatcctgaatatctttgttaattttctgtcttagtgatctgtctaatattgtcagtggggtattaaactctccagctattattgtggtgcagtctaagtctccttgaagttctctaggaacttgctttatgaatctgggtactcctgtgttgggtgcatatatatttaggacagttagattttcttgttgtactgaacaatttactattatataatgcccttctgtgtctttttgtttatctttgttggtttaaagtctccttcgtcagaagttagaattgcaacccctgcttctttctgtttcctatttggtagattttcctccatccctttattttgagcctgtgtgtgtcattgcatgtgacattggtctcttaaagacagcataccaataggtcttggttctttatccatcttgtcactctgtgtcttctatttggggcatttaacccatttacatttaaggttagtatttatatctatggatttgatcctgtcatcatgttagctgattattttgcagacttgtttatgtggttgctttatagtgtcactggtctgtgtatttcagtgtgtttttgtagttctaaacccaaattcttaatgactactctatatcttttttagtggaaaaaaagactttatttcttaggaccccacacactataagcccctatatatttctcttgaagcctgaaagtcttgacttattcttcagctgtaatcagctgtggtgtactttggggacccatcactagatttgcactgtgaggttacctatgctccatttctccagtggcctggtgctatctgactcaatctggagtaatatgcatgctttgccaagtgaatttgatgactgaagggttccataagggtctaagataagcatagatgcatattggcatcatctgcttggaaggggcctttaaaatgtcaccattcctcactatgctacaccaaggaaggggggataattatcattgcttgtggtaggtgaggcaggatggtcagagcacgtactttgaacctcatcattctgctaagtactactatacgttatttttttgactatcattatcactgacatctaggatataagcacctgtctttactaatcagacttagtaagacattttggtatgtgttgagaaacagtaatattgaacatataaccttacagatggaattacattttggatttaactatcctgacatctttttctttaactctcctaattgatttccattatgttgaaatccaagtccatcctttgaaatgttagcgggaagactgaggattgaaatgtgtagatagaaaaatcacagaatttaacttaaagtacatgaaaaaattccaatgaaattataaccattaatatccttaatacataaaatattcatacaaatcaataataaagaatccccatgactgcaataaataaataagtaaaggtccaaaataaataatttgtaaaaaaaaaaaaaagtttaaaatgttaaatcccagtagcaatcaaatacatataattcaattcaaaacactgaaatgacacttgtagtcttttaaattagtgattttaaaaaaacaaaacaacaaaaaaacagaatattggtaagagagcaatgaaaaatgagttttcatacactgtgggaaaataatttggtaccaactatttaaaaagcaatttggcaatactgtatacatcaagagctacaaaattaccctttgactaattttacttctcataaattatcctgaaaaaaattcaaatatctggaaaagctttagttcaaagctaatcattacaatgttatttgtaatgttaaatatcagaaataaatgaaaattactaaaattgaaaaacagttaaagtttacttcatccttaaaaggaatatttcacagagaatacaaatagaaatacagagagactgtgaaatagcacagataaatgtctaagctttaatgtaaaatgaagaatatacatatgtaatggatcaactataagaaacttaaaaatatgattaagaaagaaagattaaacaaaaataccaaaatttcaacaaagattatctcttgttaatggggtttgactatttcttttctgtgtttcccaaatttttatgatgaatgtgatttattctattttaagagggaaagaaaatttttttatgaagaaaaattgaattaaaataaatttttatggggctgaagaaaaggcctctataaatgtgacttgattgggaagcttgtgaattttttctgtaggaactgagtatttatgatctttttttttttgagatggagtctcactctgttgcccaggctggagtgtggtggtgtgatctcggctcactgcaacctccgcctcccgggttcaagcggttcttctgcctcagcctcacaagtagctgggactacaggtgtgtgccaccacacctggctaatttttgtacttttagtagagacaggatttcaccatattggccaagatggtctcaatcgcctgacttcatgatctgcccacctcagcctcccaaaatgctgggattacaggcatgaggcaccgctcctggcctatgatcattttatatggactgatttaaaatctgttttgaagccaggtgcagtggctcacgcctgtaatcccagaactttgggaggctgaggtgggataattgcttgagcccaggagttcgagactacccaggacaacatagggaaattctgtctctataaaaaataaaaatacatttaaaaaatcaaataaaatctgttttgaatagccatcaaaaacaacttctcctacactaacatttaagagcgtgaaaggtggcaagaaaagttctatcatagcttagatcctaaactattctacgcaagtttttgatgggctctaacatgttaatagcatatatgtaacactaattacaaagaaacctcatttcttcattgaaaaggttatcagtttaatgcagtgaaatctgactatgtgagtgtgagtatatacagttgtgctaatatcagtttgtagtcgttcaaggctaatcttcccactccagaggaaatttttttatcatatatgcatacattgctgcactgaataatgggaacctaaaataaaaaagatcattgcctattttatatgctccataaaattcactgacagtaaccaccaacatcccaggtatcgtctgcagtttagaatcctgaatattttccccaaaaatgtccgataagggaagcaatttaagcaaggcagacagtgctgctaacagagaccatacagtttcagccagcgagtctgctgactgaaatgaagtccttggacctgtggtttttttgtggggttatttgctcttgtagaataaggctctcagaatttcaataaaagggtgaaaacagttttgaaactgagaagactgttacactgcctaagaggaatagaggtgtgattgagatgtggtgaaagaatctgaaagttgagttgtttttttttaagtctcttcccgtgtctatgtcctgccatttcttagatttatacaaacccgacccaaaaaagggtgtcaggggcttgaatccagcaggcactctcatacaggtctgttataccacttcaccttttatagtcagtcgacaggacagggggaattacttagtatacaaagaagtgcaagggaaataaaacctatgcaaatcacatttgtagccttctaaatatttgacctatatgaaaaattccagctttgatttcttagtccaaattgcaaatcagccaaacgtagctgattctgtcctatatgaattggttattactgtctttccctttcttagaacccctgggaacaaacaagaaaaagtaaggaaaacaaaatacttattaaaatgtaaatacagtggctggttccctgatatgttatgctgacaacccttgctggcaacccaggaggacccaggtgcaccaggaaccgacttatctggtcacagaacatcgggggctggaaattgacagcctctgaagggggccttttgttacttgacttctgtggcaggttgctggctcattctcctgcatggaagagttgaaactcgtctttcaactaaatggagtacatgagggcagagattcttttttggtttggcaacccaagtatattaggaaaaaataggcactgcaaaatagcaggaaagcatgaagaatgctttatgaagaaacataaaagaaaaccagaggaaagcatattcagcctcagtcattaaaaagcacactactgttcccagtcttgccttctccaaaagtttgtttgtttgaagtttcttctgcagaactctaagcaggtctccaatataccgacatctttaacagcattctggaatgagaggagtgtctattaagggagacatactcctctatttcatttggaattttacacaacagttttctgtgtggcttaatttttggcatcaaattgttttaacagaagctgtgcttttcagttagatctttatctttgagttctagtgtcctcccacgatgcccctaggagcctatcaaagcaggccaaccctgcagaaatgcctagaataaaataacatgcaaatgccactaagaacttgcttccctcctgactcatattttagtttctataaagtgtctgttttcaaaactgacagtgtctgtagcctgttaatggaagataatgatttgcacaccaaaatgggagtaatcacagggctatttgacactgtccttagaaaaattccttacttactcaaaagccaaagcaaagaactatttctaaaatgacaaatgtgtgtaaattttcaaagtggattgtgatttcacccaggaaaacacaggcagccagaacacagttatgctttagtgtatatggtgatctaattcttgaaataaaactttattctgggcaatagcatgcatttctagatgagaggagaaattgttattgctcataataaaggacgaaatgtttttcttatttgggaacttcagggggatgaagtaaggaagtgggctgcagaacactgggataaatcttatttatttaacatttaatgctatagtctgttaggaaacaaactcactgcggtataattatttaatactggacagtaaaatcatctgctaagattagattaagtagttgactcaaagtactccccaggttcaaggctcaaaaatgaataaatcaacatgcttactgtacagagcccttgaacattatgtgtgctgggatggtggcttcctgaactatcgcctcttgtttgggtctgttgtgaagtcaaggcttgaggacatgacctgacctctttatttaaaaaaaaaaatccatttaatatcagttatcacttgaagaatttaaagacagaattatttgctcagaaaaatttgatgctttgtgctattaaaccctcagtacacagaaatagatttaagcaacatggtggtgaatcaagccaaggagagctgggaagctggaattgatggctcagtattctctgtaataatgtgtcaatttatgcctggacattttaggatgtctgtttatacaaatgtgaacaaatgtacctttgacttgtagccagggtgaacccagtgccaaaagaatagctcttctcttagactgggtttctcatttttttcagttttgtgactggcctagggtgtattttccttattggagccttgtgttgttgtcaccttcatccatgccaggttctcataggactaatccccaaggaagtcatccccagtctactgggcacactgagggaatccacgtgtacaatggaggcttaagctgtgagctttgctatcaggagaacctggctttaagtcctgtttctgcccattattatatatgtgaccataagtgagttgcttaacctctctaagcctcagcttcctgatccatacaacaggaaaagtactagtacctgcatcctgtgttactgtgaggttcaaaaagtaaaggaactaatgcacataaagtgtttagcatattgcctggcacaggatagggactccataaatgccagctttctttatacaaagaaaaacgtctttgccctttagttaatgttctcctgtccatgtcaaggtcagcatgacaccatggtagtctgtctagcttgtatttgtgtctgctgctcacataattgtttcttcacttgctgacctggttggctgaagttttggccatgggccaccctgtctgtgccccctggctttggatcccatctcgtcctatccacaatgtcaggagcaaagccacttctttacatacgtggcagaatccagccagacactctgcatcagcaacgtctccacagccagttgcttggtcttcagcctgtcaggcgctgagcacttgttctccatctgaaccagctctgtgctggcctctagcaattataatgcacctgctgatgcctcagagagccaggccagactgacactttcctctcggtattctttaattctatgcttgaccagttccagcattctttcttcttggtcccagacactttccacctcatctcctacatgtcacatctgatttgtccttattgtagaaggtaggtgtaaggcctaaagagtgagtgtggtttgttgtcagctgctccaaatggggcagcattggcaggaggtgcaggaactgatagaataagatttctatatcttttcttgagtttgtgacagtgctgtttatggtcaccagtttttatttgaggaattatccatttatgcaaaaaatgttttttattctatatatcctttaaaaagacatacaggttgccctctggaaatgagtcttaagcatgtctatagtatagctatatcatccacatcttgagtcattttgctcagtggattttcttaattctcaattaatttgtattctgtcagacagtctagtgagggagtaacgagtggtaagttagaaggtgacaattttatccgaggtctgtgcatagggtacagtggaagaatggagacggtgatgcctcatggcctcagcttacagtgtgatttgtacattttctgtgatttctataagtaacaggctgacagtgttggatttgctgtgttgtgctttgtatctacctttgtactgcctcttttttcccctcccacgctgactttatctcattccttgttttccttgagaagattgcactggaaaacttgaagaggggttagaaggtggggccatagtagataccagtaggaagacttcagaacagaccctgtcccctgctgtgatgatgccttgtgacttaacactgatgaccttacatggaggatttagtgaaagttatattagaaagcaattcagttacttccagattgttattgaagtccagcctctgtggtctacctatgccattagtatttgtcctaggttatttttgctttcgtatgtcagagaatggtctcaacgtaagggggtctgagtcagggtggtctagttgaaaaggtatgggcattggagtaaaaatataaaaaatctggattcatatccagcctctagcactgaatagctctgtgacattgtgcaaattgcttacattcttttaacttttgtttccttatctgtaacttggggatccagatataataatactgtcaggtattatagaattattgtgaaaattaaatgagataatgtctggaaagaacttagcacagcgtctggcatagtgttaagtacccagtaaatcctgattctttctctcccccagcctcactgcctcaccagctgcccagctgtctctaaacacagcatcagtggaactgtaaatactttcacagttatgtaatcgctctccacaaattcactctttgatcacctttctgccctccctccagatctattcctaaactcaattttgactctccctctggtataatctccttctctctgcagagaacagtaagaccttaatgtttaaaaaaatcatttcttcttaaaacttaaaggccctaaaacatcattttgagtttttgtctccagcagggtttatttctgacaacaaaattaatatatttatatttaatatttggagcttttattttacaatcatcttgacagtaatatttttctgatatttgaaaagccccatgatttttctgtgcagagaatgcattttgttaatttatctaagtggctgctaggcttttaaggttttaggttcattttttatttttctggagctcagtcccctaaaatgcaaatgagtcttgagcagctcttccagaagataaattattcttcttttctgtctcctactgttcaaagttagtgataatttttagacccagcagttgaagattttgacattcctgttgatataaatgtggacattccaatgttgttcaacttctgactgtcttagggactgattgcttatctctatcagccaagaaaatgccctttgcattggtctcatctctcacccacaccaaccaaacacatatatgcaatctaatgtctataggtcacattcttgccactttatctctttaaaattggatagttttagatggaatttgcaggtgctaatatggaccactgggtaacagggatagatacagtagcattgttagattatattctctaagttgagatttttcacctaaaaagagacagaagaagatggaggttgcacagtactggtcagatcttcccatgcagtttatcttttggaagggcaacagtataaagcagttaagagcattaattggacattaggcagtcctaggtttgaatcctggctctgacacttattggctgtataatactggtcaagtgacttaatttctctacctctcagttttattatttgtgaaacaggatgacaatattacttgctttgcagaattaaatgaggtaatattttgaaaattatatgagctattatctaaaaacatttagcacagtgactggcacagcatagagtgcccagtcaatcttggtcccttctccccagttttgccctgaatgttggccagctttgctgcagatgctttctccactatgccattactctcatccaatcctttcctttattagctttcttccctagccctcacttcttctcttggacccagtgtgcgcgctctctctctccagaaaaataataattttaaaaaaatcagttcttcacatgaatgcaaaacacctactacaatgatgtgggtgatggtgatgatgataagaataatgtgggaactttttaccctttttgtcctctggattgtaagtttcatgagttcaaagataatgatttcttcagcaccaaatgccttggttcctggaccaggaatagttggtgaatggatgaatctgatattcagagttgcaatgattgcggcatttaatcttttttatttctgcacagttaatccaaatgagtatttattgatttgtatatatatttactacttctattgcaaaattttagtttcttcttttatgaaatagaattcttaaatgcatgcttgtgcatccaagaaggacagtgatgatgtgtttcaatgtattaaatgttgaaatttaaatgttggggcatgttcttgaaatggtgactacacaggggaaaaaaatttaatagattggttttaaggtttgaggacgggggtcctgggaaagtgctgagaatggaggcatagcattccttcccacactcagcacataactctgcatggatttggtttcatttcaaaaacggagtgttcacagactgaatacacctctgtacacttgaccctaggagggcagcagataaacttggggagtcttttttagacaatattcccctgaggttttaagtaaatttttacaagctcctagaaatacttttaagaatctatataaaatttctcccttaccttaacagcttttacttagaagatatatcaaaatgaccccaaaaagcaaaagctctataaggtcagctaatccattaccttagcaatgtgaggtgcataaaatgtgaaccactgaaatttcatgtaaacacctcgcagtttgctctaaattttcttttatctcaaggatgcaaatgtgtcttgtgcttcccataattgaagaatgaaaatgtttgagataaatagcccttcccctgagaggccaaatactttccttgaagaaatgccagtcctatgtccctgtgggtagggttcagtatttgtagagtcgccaattataatggcccagatctaataggaactcaaggattccagcctatttccacctaccccacctgcccaagaccagccttatttccaggctttactctcccttaggcatatgtggtggcaggcacctgtaaccccagctactcaagaggctgaggcaggagaatcgcttgaacctggggggcagaggttgcagaaagccgagaccatgccacagcactccaggctgggcaacagagcaagactccatctcaaaaaacaagtaataacaataataataataataatattaatgatttaatgttcaaaaatatcctatgtccaaaagttctttttataaatctgatccatatcgctattgttgcagcttaaaattctgttacacgtggtaatacatacattaacaaatacgtatagggctccttgatttaccaggggctgtgtgtgaaaactacattaatcataattaactgccaaatggttagaacagaaaataacagctttgaagtccagagaaaggagagagtggagcaggaggaattggagctggatcttgtaagatagttgagatatgcataagttgagagaaaaagaaaggacaaaccagatggcataaatggtgtgaggaaaatcacagaaatggaaagaaagtgaggaggccaatttacatggaaatgaggcttttggaaaagggagtagttggaggtaactcttggaggcagatcggaatctatctacatagggccttgaatgctatactaaagaggatggtctatcccatagaccagtggtgtccaaagttaggaagtgtgtaggaaaatacatttgtatatagaaaaagatgtattctttatatagaaaaagaaatatattttactaataatttcttgtattgacaatgttgtatatgtgtcatttatatgtaaatatgctatgtggtgatccacactcaaaattgttttattgatagagatacatgttcaaaagaggttggaggcagatgactgctataggtgataagggatgattaaaggttttcatgcagccagtgacatgttcaaagcagtattctaagaagatgaatctggcagcagttataccgagaggattggtggaagcagttagttggcgattgcaacaattcaaagggcttaaattatgatagccacagtaggaatgtaaaggagggggagagttccagggatgttcggataatcttattatttgcatggtgagattttcctttagcaagagtattcagcaatctctttgggggctgagaatagagcagtgctcaagaaggtgagtttttgtttgaaactgatttcaaaagtgggttagtggtcaggcgcagtggctcacacctgtaatcccagcaatttgggaggccgaggcgggcagatcacttgaggtcaggagttcaagacaagcctggcaaacatgacaaagccccatctctactaaaaatataaaactagctgggcatggtgacaaatgcctgtaatctctggaggcagaggcatgagaatcacttgaacccaggagtcggaggttgcagtgagctgagattgcgccactgtacaccaacctgggtgacagagggagactccatctcaaaaaaaaaaaaaaaaaaggattagtactaccccaaatgtactatggtctgaaaacctaaacttaaatgtgaccaataattaaaaattacattaattactggtcaaaaacaatataggattaatcctttaattgagtatagataacttcataactaattttatacacaaggaaaatctttgaaaatgtagataacatcttctccaccataatcataaaaaggagcatgataacagaagtagcttaataatggttcctgcattatattaaaaaaaacttatgcttcatatttgctgtttggtgttgaaaagggatcccagaaattttctcatctcagttgcttgttggagatgcattacttttttataatacatgattcaagtacaaacagttgtttttcctcacacagcttgatcttcacaaaaaataaaatttaaaaaaccattttggtaaatgtaaatttgtaaaaggaggttttggtacttgtacttgatttaccatcattttctttaaaattgtactgttgtttaacttctcaccagttgatgtttttgtaaggtagaactcttaacaaaagtgtgattcagagttcaaatctattattagccaggcttctcaatttctccttgcacataaaaacatggtaaataatgatagagaaaaagaaatagcatgtttgaaaatgccaactagatcaggcttgtgattcctacatgatactagcattatcttagacatgtgttgataaaagagccctactatcaggcaatttaaattaaaaaaaaaaacaaattcacatattttaactcttgccaggcatcggatataaacttaacaattatctcaatcaaggtaaaatagactatagattgtgtgtgcatatgtgtgaaaatgaacagaatatagtgtagaaaaatagatacaatatgacacataaaaaagaagataagattttaaagttctacattaagcaaaagtaacttttctcaggcattgctggtagaaatataaattggtaacctttctttagggcattggtggcatgtgtcaagagccttaagaatgtttatactgtttaaactcagttctatatttctatttttaagaacttgtcccaagaataaaatccttaaatgcccaataataagggagtagctaaaataagtgaagaaccatttttgaacattattgattataataaggaccatatgtgccctgactttaagtggaaagggcagtagaaaactactattgtttacatacatttataatttttgtacgtacatatttgtatacatacatttgtttacaaaaaatgtaaagaagtataacaatattcttacaagttgttttggtttctaattttttgtttctctcaattttaaattttaaaaaagatatgttgctatatattgtatttatattcagaaaaattatcaaaataattttaaaaataaaataattaaagagagctcccagagtttaaaatgtaaatacctatcatttaattcagttagctgatggaaaattttggtgaccattacatatttatttaatgacttagtcaacaagagctgttgatgtattaaattttgagtagacccagctgtgctacaaaagtaggtaatgtaatggcaactaaagcaaatgtcaaagctgaagcacatttaattatcttggctactggggtgttttaacctgtgttacttgtgctttggtctcacaaaaatggcatcttttaccaactttctaaactgagtaggcaatgcatgctttagattaaatgaaaaggtggtcccttttatttatatttatacaaatatattcattcagtcaatcaaataaacaaacatttattcagcaattgtcaaatgtcaggtattgggccagattatgaaaaagggaaatgagtatcagaaaattaatggtctaatgggaagatcaacatttaagggtggctgaaaatgaaaatagagttatgcatgcagttctagaggaacattgagaaaggggcagccaactctgcctttgagttaggggagccttcccagagaaagtattatagagataggctttgttcaatgaataggagtttcctagatggaaaaggtgaagaggtattctagataggaagaagagcatatacaaaatgtcaaaactctgagataacatggcctgttcagggactggtaggaaatatggtatagctagagcttaggatgagaagcagaagcagatcatgatggcagaccagaagcaagactagattgcagctgtcactcggatggacagaacagtgtgtggagacttgcattgtgaacttttactcaacaatgactgcaggaatacattaggaaagccaagagaacccatagaccctctgaaggaagcagattactcctgcaggacctgggagacaccccaaatactgtaagacaccccaaaaaactgtagaagtgggaaaaggagatcatctgcccctgaacatatatccccactggagagggaacctgaagttctagagtacgggagaagattccgaccttacatgcagctgagtcaatgtagagggccgagcaaaatatggggttagaggaagcaggagaaaagtccctgtgggctcgctggctcccctagcaagccacttctgcctcacctcacaggggtccttgaggaggggtgctagaggcactgggaaaaggccacagggagaaggaaacctccagctgaactttgtaacaatttgagctgatcaaaaagtctcctggccagaactggggggagggcatgaatccagtgtgcagactccacaggcaagggaagaaggaaagccctacttacttttgcagctgggaggcaagtagcctggggcaagttctcagccctgctcacccaccacctggaaacagacttggtgctgttgggaggggcacagtgagagtgagatcagccctttgggttgcctgggagctggatgaggcctgtgactgccggctttcccctacttccctgacaacctgcattacacagcagagagagccataatccttctaggaacataactccattgacctagaaacttcaaccccatcctccacagcagccatagcaagagtctgacatgcctagccctgcccccacctggtggtccttccctacataccctggtggctgaagacaaagggcatatactcttggcagttctagggacccacccaccacctgttcctccccatattaccacagatgatgctctcttgaatgtgccacctcccagcaggaggataaccagctcaaaaatagtgcactaatcaatcaaagctaaggtatcctcacagagtccatttcacctccttgccgcctccaccagagcagatgctaatatccatggctgagagacccatagacagttcatcacaggactctgtgcagatgaccccagtaccagcccagacctggtagacttgctgggaggctagatccagaagagagataacaatcactacagctcagctcttaggaagccacatccctaggaaaagggggagagtactacatcaaggaaacaccctgtgagacaaaaggaactgaacaccagcgttgagccttagaccttccctctgacagagctgacccaaatgagaaggaaccagaaaaccaactctggtaatataacaaaacagcgttctttaacatccccccaaaaaatcacactagctcaccaacaatggatccaaaccaagaagaaatccctgatctacctgaaaaagaattcagaaggttagttgttaagctaatcagggaggtaccagagagaaacaaagcccagtgtaaggaaatccaaaaaaatgatacaagaagtgaagggagaaatattcagtgaaatagatagcataaataaaaaacaatcaaaacttcaggaaacaatggacacacttatagaaatgcaaaatgctctggaaagtctcagcaatagaattgaacaagcaaaagaaagaacttcagagcttgaagacaaagttttcgaattaagcaaagacaaagaaaaaagaataagaaaatataaacaaagcctccaagaagtctgggattatgttaaactacaaaacctaagaataattggcattgctgaggaagaagagaaatctaaaagtttggaaaatatatttagaggaataattgaggaaaacttccccagccttggtaaagaactagtcatccaaatacaagaaactcaaagaacactgggaaattcatcacaaaaagatcaccacctaggcacattgtcctcaggttatctaaagttaagatgaaggaaagaatcttaacagctgtgaggcaaaaacaccaggtaaactataaaggaaaacctatcagattaacagcagatttctgagcagaaaccctgcaagctagaagggattggggccctatcttcagccccctcaaaacattttatcagccaagaattttgtacccggcgaaattaagcttcataaatgaaagaaagatacagcctttttcagacaaacaaatgctgagagaatttgccactaccaagccaccactacaagaaccgctaaaaggagctctaaatcttgaaacaaatcctggaaacacatcaaaacagaacctctttaaagcataaatcacacaaaaatacaatttaaaaacaaaaagcaaaaaaccaaagtatacaggcaacaaatagcatgatgaatggaatggtacctcacacctcaatactaatgatgaatgtaaatggcctaaatgctccacttaaaagatacagaaatgcagaatggataagaattcaccaaccatctgctgccttcagagacacacctaacacttaagtgctcacataaacttaaggtaaacggatagaaaaagagattccatgcaaatggacatgaaagtgagcaggagtagctattcttttatcagacaaaacaaactttaaggctctagcagttaaaaaagacagagggtcattatataatgataaaaggccttgtccaacaggaaaatatcacaattctaaatatatatgcacctaacactggagctcccaaatttataaaacaattagtaattgacctgagaagtaagatagacagcaccacagtaatagtgggggacttcagtactctactgacagcactagacagttcatcaacacagaaagtcaacaaagaaacaatggatttaaactacaccctggaataaatagacttaacagatatttacagaacattctacccaagaactgcagaatatacatattctattcatcagcacatggaactttctccaagatagaccatatgataggccacaaaacgagtcttgataaattcaagaaaattgaaattatatcaagtactctctcagaccacagtggaataaaactggaaatcaactccagaaggaaccttcaaaaccaggcaaatacatggaaattaaataaactgctcctgaatgatcattgggtcaaaattgaaatcaagatgaaaattaaaaaattctttgaactgagtgacagtagtgacataacctatcaaaacctctgggatacaacaaacgcggtgctaagaggaaagttcatagcattaaatgcctacatcaaaaagtctgaaagagcacaaattgagattctaaggtcacatctcaaggaactagagaaacaaaaacaaaccaaacccaaacccagcagaagaaaggaaataactaagatcagagcataactaaatgaaattgaaacaagaaaatacaaaagataaatgaaacaaaaagctggttttttggaaagatagataaaattgatagaccattagcaagattaaacaaggaaagaagagagaaaagcaacataagctcaattagaaatgaaagggacatattacaactgacaccacagaaatgcaaaaggtcattcaagggtactatgaacacctttatgtgcataaactagaaaacctacaggagatggatacattcctgaaaagatacaaccttcctagcttagatcggaaagaattagatattctgaacagaccaaaaacaagcagcaagattgaaatgataattaaaaaattaccaacaaaaaaagcccaacaccagatggattcacccagaattctaccagacattcaaagaagaattggtaccaattctattgacactattccacaagatagagaaaaagggaacagtccctaaatcattctataaagccagtaccaccctaataccaaaaccaggaaaggacataaccaaaaaagaaaactaaagaccaatatccctggtgaatatagatgctaaaatccttaataaaatactagctaaccaaatccaacaacgtatcaaaaagataatccaccatgatcaagtgggtttcataccagggacgcaggaatggtttaacatacacaagtcaataaatgtgatacaccacataagcagaatcaaaaacaaaaattacatgatcatctcaatagatgcagaaaaagcattccacaaaatctagcttccctttatgattaaaactctcagcaaaatcggcatataagggacatacctcaatgtaatgaaagccatctatgacaaacccacagccaacataatactgaatggggaaaagttgaaagcattccctctgagaactgggacaagacaaggatgcccactctcaccactcctcttcaacatagaactggaagtcctagccagagcagtcagacaagagaaagaaataaagggcatccaaattgggactcccgctgtctgctgatgatatgattgtttgcctagaaaaccctaaagactcctccagaaagctcctagaactgatacaagaattcagaaaagtttccggatacaaaattaacgtacagaaatcagtaggtcttctatataccaatagtgaccaaactgagaatcaaatcaagaactcaaccccttttaaaatagctgcaaaaagataatataataaaatacttaggaatatacctaaccaaggatgtgaaagacttgaacaaggatacaaaacactgctgaaagaaatcatagacaacgcaaacaaatggaaacacatcccatgcttgtgaataggtagaatcaatattgtgaaaatgaccatactgccaaaagcaatctataaattcagtgcaattcctatcaaaataccaccatcattcttcacagaatttaaaagcaaacaaacaaacaaacaaaaccagtcctaaaatacatacagaaccaaaaaaagagcccacatagctgaagcgagactaagcaagaagaataaatctggaggtgtcacattacctgattacaaaccatattataaggccatagtcaccaaaacagcatggtactgacatgaaattaggcacatagaccaatggaacagaatagagaacccagaaataaacccaaatacttacagccaactgatcttcaacaaagccaacaaaaacgtaaagttgggaaaggacaccctattcaacaaatggtgctgggataattggcaagccacatgtaggagaatgaaactggatcctcatctctcaccttatacaaaaatcaactcaagatggatcaaggatttaaatctaagacctgaaactataaaaattccagaagataacattggaaaaacccttctagacattggcttaggcaaggatttcatgatcaacaacccaaaagtaaatgcaataaaaacaaagataaatactgggatttaattaaacttaagagattttgcgtggcaaaaggaacagtcagcagagttaacagacaacccagagtgggagaacatcttcacaatctatacatctgacaaaggactaatatccagaatctacagtgaactcaaacaaatcagcaagaaaataaacaatcccatcaaaaagtgggctaaagacatgaatagacaattctcaaaagaagatatacaaatggccaacaaacatatgaaaaaatgctcaacatcactaatgatcagggaaatgcaaatcaaaaccacaatgcgatactaccttactcccgcaagaatgaccataatcaaaaaatcaaaaaataattgatgttggcagggatgcagtgaatagggaacacttctgcactgctggtgggaatgtaaactagtacaaccactatggaaaacagtggggagattccttaaagaactaaaagtagaactaccatttgatccagcaatcccaccactggctacgtacccagtggaaaagaagtcattaaatgaaaaagatacttgcacacacgtttatagcagcacaatttgcaattccaaaaacatatatatatactgtatatagtatatatatacagtatatatatactatatatagtatatatatacagtatatatacagtatatatactgtatatatagaaactgtagtgtatatatatacactatgtatatactatatatatacacactatatatatatactatatatgttactcaaccataaaaacgaatgaattaatggcattcgcagtgacctggatgagactggagactattattctaagtgaagtaattcaggaatggaaaaacaaacattgtatgttctcactcatatgtgggagccaagctatgaggatgcaaaggcataagaaagacacaatggactttggggactcagagggaaagggtgggaaggagttgagggataaaagaccacaaattgggtgcagtgtatactgctcaggtgatgggtgcaccaaaatctcacaaatcaccaccaaagaacttactcatgtaaccaaacaccacctgtaccccaataacctatggaaataaaaaaataaaaaatataataagcagaagcagaggatgagagtggaaaactgggctaggccagaaatggcctttatgcacttggagtcataatgtttctgcttcaccaatgattaacagtgattttcctggctaatagaatcttaatcattataatgaggtaggactgttgcctttgaattatggaaattatagctgttaagacctgttccacaaacacaggttatacatattatcacatctctttaatcttctttacagttaatcacccaagtctccacagggcttattagcaggaaggctattatctcctcttgagatccctcccactgcccctgaattgtccatgaatcctgactttactcaggccaaatgggtcagtcctcctgcagaagcccatagctggatctgtctgtgactgctgccctctctggtgtctgctatatggcaccatttgcacatccgtgtcacagggtacccattttgggtgacaaggttacaactctctttgtttacatttccatcctcagccattgttccctaaatcataaccactgtgccaggctggctggtctggaggcgcttctggagttggcctcatgctagtctgaaattagtccttctcctagaatctgaggccattttgttgagcccagatcaacagcccagattccgcccttctttaggatcactttatttccatggcttccaggaccttccctgctccgggaccttagtcagtgtcatcctgacccaatagatctctcatccccggcctccagttcgaggaaacggggatgaagacactagggcttccctccagaaggccctgggctcctttttccacacagattctcctcctgccaagtgtgcagattgtttctcggggtggctcaaaaggtagcagtttgcaagatggagtttaaaaaacagtttgttgccctgccctaatgctcccccaaaatgcctaattgctttatatttacataactaagaaagacaccaagggattcttccaaaaacaaagatcttcttcaaggtgatcttctgttctgcctttaaagagaagtagttgcagtttacttcactaaaataattaatttttgtctaaccatgtccctattttatcagtgataatgtgctcataaattatacgacagattatgtaatttgcccaaagcagaaagaggtctcagaccccaaacccatgcatttaaccactctgctttactacctcttgtcattcaattcacatgctaccatgtcattatttacttttatgtctcggatactgtactcttattagttaagtttattgcaggaatataaatctctttaagtgtaggcactctcttctgggctgttgctgaaagagagtgggacaacaggtgtatttgtgaactagtagaaaatgagtatatttactgcagaaggaagttgtgttttctctgcaaagttagatcacagaagggagaatgatacttatctatagttctggagggttgaaaccgaatagtaaatgggtgttaggatcaatacatattgttaagaaacagtgttctataaatttcatgatttaggaaagctgtctacaaagctggattaatctttttctgctgagggccaagtttactttgctctgcccctctctgtgcaagtgtaagacagtcaactgacctttcagattatcagcttaatgatagttctctctcagaattctttaaatttaagaataatgaaaaaaaagtccaaagagatctttttcatcatttctcttctccctattattattactctcctcaatgaaatgaaaatgaaatgcctgtgtatcctatttcataaaccaaaaccaagttctgacacattattggaagtttatgttgctttagaggaaaaccatgttggctataaactgttgcattatctggaaatcatactgtagattccaggaggtcaaggcgtctctggcaacttctatatatttataggagaaccgactgcctctcctctaacaaaacctcaatgagacctgactcctagccagctaagactcggcatggtcctccctgcgtcttcaaattctaggactttccctcatgtgcttgccttggactggagctgcaagctaccaagccagtgccagactgggggccaggcttacagcagagcttccacttaccccaaatctgccacagaattaattccctacgtttgacctcatattactttgttttgttactatcattgttactgctttagtattgttgttgtcgttgctttcctgtatatatttaagacttgtggcttttaaaactagtttggatttaagatacacaataagttctatcatttgaaaatgataaatatagatgtccttacatcaattgtcttcagatttcggatatatttagccttttgactttatccaaaaactaaacattctgattggccctcattttaaaagggaagaacctgtttctatttatttagatttgtatatgctctatattgggatgagggagctttttgtactgaaagaagttatgtattttcctacaggttagataaaatctgtgttttcccttggctaggtttatgcatgctgtataaacaaaggtgttctggggctcctaaggaagcggtctgaggaccatgtgtctcacctagttctcccacatgctctccctggtgactgttggcactgaccagaaaggtctagagtggtggagagagaagctaataaacaattcttgaaaacctactatgtgccaggactatgcttgatatacatttgctttgttttatttaactttcataacaatcccagcaggcaattaccattttccttattatatagatgaagagattaggtattataattaatctaatctcacagagccagaagtggcagagccaggagtaaaacacagctcagactccacagccaatgcctttctgtaccctacaccgtccatcatggatttaggtagcctggggacctgaactccccactaggtttaaggtctaattcttgaatgaaacctcacgcatttctcttaggttcagggacaatcagattgtcagagtagaaagagactttggattcaacatttgctaacccactggcttcctaacttcttcctaaggccttcactctgtgaagtaggtgctagggttccctgctaatgagtactaagcttctcaagggcttgagcaggcttgttagtctttttagggccagctgtgcaccaactatgctgttgttgtgttgaggccttagcattcctcacttcaaatcaattacttctttattaccttaatacatcactggccatgtggctgatttggaatgtaaaggagactaaccctgtaggataataactttcacttggcacacaaaatctatacggatattcagagcatttgcttttaaaaaatgaatattctgtagcctgtgctgcctgtttattcttatttagagaatttcgtcattttaataatttggtaatattttactggtaggtgcggagatatgtaaaaaaaagtgtatttttttcttttcttgtggatttaaaaaatgtttagaatttttatttgcagcctataaacaataatagtactttatcctttcttatttttgcctatattacaagcaagtaatttcatttaaattgactttaagcacattcctttgaaagaaaccgaagattgttatctttggcaatcctgattagatttcttcctcagacaacagtttattaagtttgtgctatgaatgtgggcaggtggtttgactcggtggagcaagtagtgggcactctagaattctttttctccaagtactcaaaggcctttggaagaatttcctctctgagcatttagatgttccttctactctgtgaggtgaaagtgtgttatgtggttttatttttcacttattgaatgccaattacatgccagccccagggttgtcttacatgtgttatcatatctcatttaatctgaaaaaggattatggcataggcacataatattatcttcatctttcagataaagaggcataagttcaggtaaatacatatcccagtagttacacagctagtgcctaatgatagcaggatttaccagatctgtctgcctttttcaaatataacaccttgcctgggaatgagctagcagaagacttttagaagatgagactggagaagtggcttcaaatttcattctaatcaagacactaagctttgcatttatttattccttcattaccatttattgggcacctaatgtgtgtcaaacaatctaggaattggcgacattacaatgaataaaaagcatagatccctgtcttccagaagtttacttctggttattggaggttttgagccaagaaatgacatgatctggcttagcttttacaaagaccctcctggctacagtgtgaagcatcacctgaagagaggtgagggcttcagcagcaagcccagttaggaggccactgcagcaatccagacaactgcggggcttggaccacagtagtggccaagatgagaatttggattttatatggacttagatggaaacaccaatgggattgctgaggaactgaatgtagaaattgcttgtccatgttttaactgcaactatggtcagcctgcatcctaaacctatgctttttaagttatgttaacatgctgaagtacaaagtgacttcacaactatattcaatttcatgaaaaactgtagctcctccttttcagctccttaggcttaggaaaggagagtgcctcttggagcctggaagaggcaggagagagctctgtgtcccagaagcatttgtcatccaggctgcagttagccagctggctccttcaaaagccacacacctgggtggcagcacatatgtggttatacctgagatatgtggtgtgtccatctcagagccactcaaagtccattttaacccttccctatggctccccatgaggaggtgggaaaacgaatcctcttaataagatttaagcacagcttcacatttttctgtctttgttatttctcagaaatgccattatcagtctgagtcagaacagatattaattcttggtcacaaagtagcacttttggcatactctcaccatttttttaacttcagaaacagcttccttgtaggtaactttcactgagctgacattgtcagccaaaaatggttctggagccacttcatctgccataaaatttaataagtccaggatacaaatttgtgtatcacaagtcaataaaattgccaccaagctgtttgtgtagtaataaggtcaataaatgtcatcctcattcaattaattttcattgaccttaaggaaatgaccttctatttccaagtaggagaagaaattggccatggagaagcataactgttgcatctgcttttcagttattacattactgaagatagcatgggcatctagctatgcttgtatattcagactaaaaagtaatctacatggcttatcctgaagtagacccaaatgatttaattacaattaagatcattgaaagaccccacaatatgcttggggtcatcctaactgcatcttccagatatgatctaatatctcactgatcttggccatccattgggttctgctgggcaggatatcaagttaaggatgtgatgagaggctctcactttctggcctgcaaactgcatttgtcacaacccctttctccattaacctggcctggagatcagccctgaagttgctcctttgctgtgctggccataccctgaaggagacaaccacaccagtgagagttgaatgcctctgatttcctccttcctccacaaggcagatgagggaccctgccatttttttataaaattcaaaatcaactaaagtatcacttttttattttattattttcccagggctgcgtccaaagaggactctgcggctggtgctctggactgcagaagaacaaggtggagttggtgccttccagtattatcagttacacaaggtaaaaacccagctgtggattgctaagcatttgtacatgtaatatacaaaaatccctctcattgtccatttaagacttcaataatactttctggtcaactggccctaggaaacacccttgtatgagccttctccctccagccctgtgaatgagaatgcactggtaaaccaatgatgctgtggtgtagagctgagggcttttcttcttctacaccacagtctgaggccaaagaaaaattccaattgccatgctgccatttttttcaagtctacctagttctgctgtattcatgtatgtcagagaaatagttataggcaaacattccctctccccaccgagcctatccccatacctcaatgcccgccatattcccagaagccttggcatttgagagccaggttccaagtcattgagtctgccaagagcattgccatgatggtggtggaaatggcagcagccacaggcctctgtcccaggaatgtggaggacagcttggtttgacaccagctgtcattacacaagtgtgaagcttgaagcaggaaggttattgtggatggtcatgattagaaatacaagaccacatggaagagaggggatagggagattaatatcaagagcaaattttgagacagcaaaatatacaagctgagaaatactctagatcaagtcaaatgttagttcaaagaggaactccaaaatcaacgcgcatatgctggcaagcagtgatggttgcccagagaggagcatttggtctgctgctgctgctggatggtttcccctgaatgtccagatgagaagaagcagatcttgcaagcttaaattatccaaatcggagaagggtttcttttgtgaattgtgtgtatgttatttttgaccttttttttttttcaaagtcagtctctattaccctatttcagtcagttagagtataatgagttcaaagtcatgaatttggtcactgaatacaattatttactgtacaaaggacaacttatgacctatgccctactctttcaccactttagttcttttggcctcaggtgatcctggggataacataattcaagacaagtgtcctttggttggtaggtcagtaacatcattttctatgtgttgtggtagaccacaacatcatataagggttgttctagattcagcaacattcaattaatattttctgaacatgtactatgttccatacactatgttatgcattaatgttagcatcaaaaagatctaccctgaccttacaaagcctacattctaaaggacactgacgattaacttgaattataaggtgttaagtctttctgggaaagaaattacatctaagctgagacctgaagactgagtggaagtaagctaaggaaaatggagagggagggaggaggtgggtactgcaccttggcagagggacctgtgtgtgcaaaggcaggagatgagacagaggaaagcacaccagagaaatggaaaggaattcagagtggctgctgcatagaatgcaagatgcacagtggtaggagggtggaacagagacgtaaacaagagcctgaacaagaagaacatatgaatcatatttagacgtgcggactttatcctcgaggcaagagagtaacttatttttaagaagaagctctaaaattctatacatattggactttatataaaaaaaagaatagttaaaagaactattcttttttttttttttttgagatggagtctcactttgttgcccaggctggagtggagtggcaccatcttggctcactgcaacctccgcctcctgggttcaagtgattctcctgcctcagcctcccaagtagctgggactccaggcgtgtgccaccacgcccagctaattttttgtacttttagtggagatggggtttcaccgtgttagccaggacagtctcgatctcctgaccttgtgatctgcccgcctcggcctcccaaagtgctgggattacaggtgtgagccaccgtgccctcttttattctcagtaatacactctactccaagaaaaatattggatttaaattgcaattgatctggctaaaaattttatcatcactgaaattcctagaatgtgaaaaaagaaggtttatttttctgtaatgtgagtttcactgtagcctatcaaagcacatggatgaaatcggaaatgcctaaaattctgaggttggcagaaatacacacactcaaaggacatgcaatcacataaacagaactactttatcttgacagcatccaggctgcctccatacaaatgtagcttcatgttggtggctagtctgcattgcattttcagagatagaaagaagaaattccagaaagggaaaacattggcattttgttttacagtaactctttacctcgcctttaaaaagacattgtgcatgctttacatgatacagccaatttcaaaggacttattctggattcttatgattagcatattgatattgacattactaagactataatcatttcaaaagtggctgagtttaacttaaaagttaatataataagcaagtcacaaaccacaagggtaaattagattgtctttagacttctctgtggcattactgaatgccagcagacagtccaacaatatccagttcactccagtcacaacagagagatcatctgttccaaataaggttatgctaactgctgaaacaaataataggtcaaatttcaatgacctaacataacccagaaatatattccttgctcacttaacatccaatctacagtagggctctgctttatacaggtattcagtgatccaagctgacataccctttaaaaacatggctttaatatgcctttgagtattgacatccagctggcaggcagggggatagtaggaggtttttatgggacagttctagaagtggctgacgtcatttctactcacactccattggcaagaactagtcatgtagtccaactgtgtgagaggctagggcatacaggcactggctgagcagccacttcccaacaacagctctatactgtaggctgggagcattctatagctatattctctatctttggcagaaagctgacccactctagggtcttcctttcacttcgttctggctttctaaacactttagctgcacaagaggccaactgccctgaggtctttacctcccatggtgctcaaagttgagatcagctctgtgagctgcctaaaagtactcatcttcaccactaccaggatgcctttgtctagcaacacacaaaaagaaaaggagtcacagtctttgaccagaaggaccttacattttacttcaaaaataactttaaatgcacacataagaaagttagtataacaaaccatatataatgaagttttaaataatgtactaaaagtattttatttttatggatgatgctatcattgacaaagtgccaaatggtgtaaaggctgaacagagtaaatggaaaggatttagaaaagggagaaatcactatggcatgttagtcgtgaggaaggaggcaacacctaatccttgcagagcaagtggatttcagccagtgatcaagaggggagagaagggacagcagctcccctttagatggatgataatggagtctcgaggtctgcctttggcattggtgtgggtgataccaaataagaacagaacttttatggcgggggtggggagatctattttagtgattgtagaaataaaaggtgtgaactttttaaatgactctgctaacatttttatgatacagttatggttattagtgatctatgtcaggaatcagaaaattatagctgatggaccaaatccagcctgccacttgtttatgtacagacttcaagctaagaagttttttcatatgtttagctgattatgctacagagattgtatgtggcccacaaaacttaaaatattaactatctgggtctttacagaaaaagcttacctacttctggtctataatgataaaagtcataaaatatcatcacattatttgtatacaatgatctctttctcgtttgtatgacctaaaatataattttgtaaattttgtttcgagcctaatattagcctatgtaagtatattgtaggaagatattattgtaatgataaaagcttgcatgcacaatctttttttttttttgcattcttatctggcagtctttaataataaagttggctaaacctacatggcactagctagggagaaaaacaatacgtagattattatttcttctttttgtttttctgaatgtaacattctttcttccccctcacaaagtcttttcaacagcgaaagttctacaaaggctattttaataataaatcagtttgtggaataatgaattattaatattcattatcctttccttagtaaatatatctttgtttacactgtactctaattaatatatgcagaaaatataaaatagttattttaaattgtgggtaaaatgtattgctgaactaattttcaaaattgtagttggattaaaagctacctttacttcataattatgctttcttatgacatatcagctcaattattataatacgtgctagaatttactaaatttactaaacaatttattaaattataaaggatgtgaggctatttatagcttgtgtatacattttgaaattcatatgcaactttattataatgtctaaaacacttcaaggaaacaaactttggcaaaaatggtctataagcattttagtagcagttactaagtaaataactcaaacaggaagtgttgaatatctcactgtagtactatacactagaatataaatcattcctgagatccattcagcatgcctctaacagttcatagcggaaagtcccataaaagatttctcttcttaagaaaatgcaagttcacatgtttcaataagttgttaaattttctctccttattttaaagtccttttcaccatgtctttgattgtcttggtattagcacataagcttgagaatgacttatatggacagtatattgtttgtgctttatttagaagcttcttttagaagcaactcatttttcttgctgttttattgaagtttaattagcatttggtaaatgcacatatcttaagtacacagcaaaataaatttggaaaatgtatacccctatgtaatcatcccccagatcaaggtatatagcattcctattaccctagtaagtttccttatgtccccttcaaatcaacttctgactctaccaaagacaactactatgctcctttgtaactccagattggttatgtctgttcttaaacttcatataaatggaaccatacagtacataatcctgagtctgacgtctttcactaaacagtatggttttgcagtttatccatgttgttgcattaacagtagtttgtccctttctattttttttttttttttcgagatggagtcgtgctctgtcccccaggctggaatgcagtgtggcacgatctcagctcactgcaacctccgcctcccgggttcaagcgattcttctgcctcagcctcccaagtagctgagactacaggcgtgtgccaccacacccggctaatttttgtatttttagtagagacagggtttcaccatgttggtcaagatggtctcgatctctcgacctcgtgatccacctgcctcggcctcctaaagtgctgggattacaggtgtgagccaccacgcccagccatccctttctattactgggtagttttctattgtgtgaatataccacagtctctttattctccagaacgaatgaagcaagaatattctgttgatggacatgtgagttgtttccagttttagctattataaatgaagttaccatgaacatttatgtacaaatctctgggtggacctatgcatttattttcttttctgggagtataattgctgggtcatatgataggtgatgtttaactttaccagaaactgctgaagaggtgggaagttgtaccattttacatttccaccaacaacatgtgggagtcctagttgctccctatctttcccagtatgtggtatcattagcctttttatttttagccattcttataggtgttatgtgtttatatttttcaaagtacagttctgaagagttacaagaaaaatcctgactcctctcctaatggccactattcttttgccctccctgcttcttcttgccttaagactttttgtttgtttgtttgtttgtattgttttgttttcttttgtatttgagacagagtctcgctctgtcgcccaggctggagtgcagtggcgcgatctcggctcactgcaacctccgcctccagggttcacgccattctcctgccttagcctcctgagtagctgggactacaggcgcccgccaccacacccggctaattttttgtatttttagtagagaccgggtttcaccgtgttagccaagatggtctctatctcctgacctcatgatccgcccaccacggcctcccaaagtgctgggattacaggcgtgagccaccatgcccggccgccttaagactatcttcatttcggtgttctgctttatgatttcagggagaccaaaggcctttttaccctgcatgaggtttgtggggctgttcatggttggagggaccttatttcaatttagagaaacatcttggcaagaggaggacatagaaatgccgtcctgctcataaccacggccgactcccaagaacacatgggggctgttgaaactcaactggagcccaaaggggaggacgattccctcaaagggcatgaggaggaagatttctcttttatgcccagaaaagaggttattctagggagaggggaaaagtccagaaaatgcctttatgttattctttattgataaattacattttttaaaaatatgaactctattggttaaatttaactggcattcacttaaaaggaaactttaccacatagagaagcatgttattgcactctagtgaataagagtttcattataggagtggaatttgactttgaaatttgaaaatatagatgagtttattgaattttcaaatcagtgaataaagtgagggttgtccaggtaccatttgcctaatctgcttttcatgggaataatgttgctgtcttctcttctcttctcttggaaggagaacaggatgtcatttctcatgtcctgaaatggacaaaggagaaaaaacatacctagcttcaactggatttctggcatttgttaatcttttccattttaaggaaaaatatgatctggcataattataatgagtaaggtaatctggccttgagaaagcctcattacacaaggtaatcaaataaaatagattgatatgtcttattctggcatgaaaaatattttaaccttttcctgatttattgcacaaacttctggcaattgaattacagggataatgaacactgttgtgttctggtagtcattaataagggcaatattttaaataggctttattaaatgagggatgggatgtatggtcattccaaatacacgaatttatctgaactctagccaactctaaaactgaaaaagcaaaattgaatattttgtcacaatttcctgttttgtcatactgaggaacaaaaattcctctttatgtatagaaatacactaaagtgttagcttcttttagcagtgaagttcttgccagcttcccaacctgcattaggtttcatgtttcactctaaaataaaagaatatgttagaaatgcttttgagacttcttcgtgctatctgggcaaatgtgtttctttggcatttttattttactaactctatttcctctatatgatgctaatttagatagagtgacactgctagagtaagggtattatactcatgttgagctctggttatacaaataatagagctgatgtactcattcagcataattgtgtccggactatgtctccagcacagcctttcttatatctttaatgttctgtgcagtatagacgtactaatcagaggtgattgtctcaatcattactgctgggcctttatgcatcctgtatttttctttcagtgcctagatattgcattagtctctcaagcacatcacaaaactggtttaaatttcatttgtctcagtgttttcttggtctggagcctttgtagttcctatattcacatgatttatactgcacacctgggagctcttaagggtcttattagaatttgtggattttatttttgtaaaaaaaggaaaggattgtcttttgagtttgctttctcctgtgtagaattccattatgactaggggacttctgaatcttatgtacatatggtaattatatatcaatgtatgccagtctaggcagagctatcaaaatatcccctttgatactaggagaatcatataccaccttgcgaataaacatgagtaggtttcaactcatctctttgctttatcgctctttagaagggatccttcttaactggcttttattatatttttctatataagagaaaacagtttaaagtaaaaagactatgacaactagaatggaattttttcatgtttctgggagagcaagaccttgcctaccattctgagataattttgtttaattcaatgccttatggtttcagattatagtgaagtttgacttgagtgttggttttagcccagtacctttaaagaaaagagaaatatcccaacttttctgctaccattactaacctaagtaaaacaattgccttttaaagttactcctaagaatgttgtgccaaaactttgaggtttcttgtcaattatttggctggcatttattctcccctcctgaaaccgtgaagaatggcttcagcttgtatctagtctgttttaccagcttacaggagagtgccttctggcacaaatagtttctgcctcagtgcctccctactcctaaccaggtcatgacctgacccagaaggacccataggatatctagtgcatgaacttcctgaggaaatcaagttggcacaccaggatgcacaaatctgaactgaggcatcatgccttgggctcacaagtgaactgcatgggtcagaggctttgggactaaattatctcattacatgtactggggccttactaagttacagagtcagcaaaccacttttcaatcaccagcactattttatttggcctgaagttgtcttctgcccttttgttttctaaatcaggggttggcaaactttttttttttaacagtccagataggaaagattttaggactgcaggtcatatggtttctctactcaactctcattgtaggcagtcatgggcaaaactagacaaatgagtatggctgtattccaaaaaaaccgtatttacaaaaaaaaaaaaaaaaaaaaaaaagaataaaggcaggtcagatagtttactgacgcctgttctaaactgttacaaggcagaagtttagaaaactttcttctgaagccttttcttatatcacggtcacagcttttagtgaaagagatttgtagcacatagtggaattctaacgtttagagattatgtcttggtaggctaataataggactgttggtaagcttagcatttacaaggttgcagttgtttccctgtaggtatttggccaacagaggccaacagaacacaccatcaccagatcagtctagtgccttacttatatcccactgagccacacaacaggcataattaccttgttggaggaagaagttaatgtacttcccgagtatttctaaaagcaagaacagaaccctttataaagatagctaaatgtgtactggaaaatatattttaaaggatatctattttaaatgtttacacatatagaagggtcttttagagaaatgaacattccaatacattttggcaatttcactgtttaaccacatcctagttttgtccattggtttgcttacactatttcttttttattttttttaatatttcctttcctttttaatattaaacaattgtgattcttttttttttgagtgacttcttttattattattattattatactttaagtttagggtacatgtgcacaatgtgcaggttagttacatatgtacacatgtgccatgctggtgtgctgcacccattaactcgtcatttagcattaggtatatctcctaatgctatccctccccactccccccaccccacaacagtccccagagtgtgatgttccccttcctgtgtccatgtgttctcattgttcaattcccacctatgagtaagaacatgtggtgtttggttttttgtccttgcgatagtttactgagaatgatgatttccagcttcatccatgtccctacaaaggacatgaactcatcatttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttgtagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccactgatggtgagcattttttcatgtgtctgttttctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcctatttgtcaattttggcttttgttgccatcgcttttggtgttttagacatgaaggccttgcccatgcctatgtcctgaatggtaatgcctaggttttcttctagggttgttatggttttagttctaacgtttaagtctttaatccatcttgaattaatttttgtataaggtgtaaggaaaggatccagtttcagctttctacatatggctagccagttttcccagcaccatttattaaatagggaatcctttccccattgcttgtttttctcaggtttgtcaaagatcagatagttgaagatacgtggcattatttctgagggctctgttctgttccattgatctatatctctgttttggtaccagtaccatgctgtttgggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctataaattgccttgggcagtatggacattttcatgatattgattcttcctacccatgagcatgggatgttcttccatttctttgtatcctcttttatttcattgagcaggggtttgtagttctccttgaagaggtccttcacatcccttgtaagttggattcctaggtattttattctctttaaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatatcacctgcaaacagggacaatttgacttcctcttttcctaattgaataccctttattttcttcccctgtctaattgccctggccagaacttccaacactatgctgaataggagtggtgagagagggcatccctgtcttgtgccagttttcaaagggaatgcttccagtttttgcccattcagtatgatattggctgtgggtttgtcatagattgctcttattattttgagttacgtcccctcaatacctaatttattgagagtttttagcatggagggttgttgaattttgtcaaaggccttttctgcgtctattgagataatcatgtggtttttgtctttggttctgtttatatgctggattacatttatagatttgcgtatattgaaccagccttgcatcccagggatgaagcccacttgatcatggtggataagctttttgatgtgctgctggattcagtttgccagtattttattgaggatttttgcatcaatgttcatcaaggatattagtctaaaattctcttttttggatgtgtctctgccaggctttggtatcaggatgatgctggcctcataaaatgagttagggaggattccctctttttctattgattggaatagtttcagaaggaatggtaccagttcctccttgtacctctggtagaattcagctgtgaatccatctggtcctggactctttttggttggtaagctattgattactgccacaatttcagagcctgttattggtctattcagagattcaacttcttcctggtttagtcttgggagggtgtatgtgtcgaggaatttatccatttcttctagattttctagtttatttgcgtaaaggtgtttgtagtattctctgatggtagtttgtatttctgtgggatcggtggtgatatcccctttatcattttttattgtgtctatttgattcttctctcttttcttctttattagtcttgctagcagtctatcaattttgttgatcctttcaaaaaaccagctcctggattcattaattttttgaagggttttttgtgtctctatttccttcagttctcctccgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttggatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttccagtttgattgcactgtggtctgagagacagtttgttataatttctgttcttttacatttgctgaggagagctttacttccaactatgtggtcaatttttgaatcggtgtggtgtggtgctgaaaaaaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattaatgtgtgggagtctaagtctctttgtaagtcactcagggcttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccagtttgccagtctgtgtcttttaattggagaatttagtccatttacatttaaagataatattgttatgtgtcaatttgatcctgtcattatgatgttagctggttattttgatcgttagttgatgcagtttcttcctagcctcgatggtctttacaatttggcatgattttgcagtggctgctaccggttgttcctttccatgtttagtgcttccttcaggagctcttttagggcaggcctggtggtgacaaaatctctcatttgcttgtctgtaaagtattttatttctccttaacttatgaagcttagtttggctggatatgaaattctggtttgaaaattctttcctttaagaatgttgaatattggcccccactctcttctggcttgtagagtttctgccgagagatccgctgttagtcttatgggcttccctttgtgggtaacccgacctttctctctggctgcccttaacattttttccttcatttcaactttggtgaatttgacaattatatgtcttggagttgctcttctcaaggagtatctttgtggcgttctctatatttcctgaatctgaatgttggcctgccttgctagattggggaagttctcctggataatatcctgcagagtgttttccaacttggttccattctgcctgtcactttcaggtacaccaatcagacgtagatttggtcttttcacatagtcccctatttcttggaggctttgtttgtttctttttattcttttttctctaaaaatcccttctcgcttcatttcattcatttcatcttccatcactgataccctttcttccagttgattgcatcggctcctgaggcttctgcattcttcacgtagttcttgagccttggctttcagctccatcagctcctttaagcacttctctgtattggtcattctagttatacattcgtctaaatttttttcaaagtttttagcttctttgcctttggtttgaatttcctcctgtagctcggagtagtttgattgtctgaagccttcttctctcaacttgtcaaagtcattctccatccagctttgttccgttgctggtgaggaactgccttcctttggaggacgagaggtgctttgctttttagagtttccagtttttctgctctgttttttccccatctttgtggttttatctacttttgttctttgatgatggtgatgtacagatgggtttttggtgtggatgtcctttctgtttgttagttttccttctaacagacaggaccctcagctgcaggtctgttggagtttgctagaggtccactcccgaccctgtttgcctgggtatcagcagcggtggctgcagaacagcggattttcgtgaactgcgaatgctgctgtctgatccttcctctggaatttttgtctcagaggagtacccggctgtgtgaggtgtcagtctgcccctactggggggtgcctcccagttaggctgctggggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcagggctccttgagctgtggtgggctccacccagttcgagcttcccggctgctttttttacctaagcaagcctgggcaatggtgggcgcccctcccccagcctcgctgccgccttgcagtttgatctcagactgctgtgctagcaatcagtgagactccgtgggcatagtaccttccaagccatgtgcgggatataatctcctggtgcgccattttttaagcccgtcggaaaagcgcagcattagagtgggagtgacccgattttccaggtgccgtctgtcacccctttctttgactaggaaagggaactccctgaccccttgtgcttcccgagtgaggcaatgcctcgccctccttcagctcgcgcacgacgcactgcacccactgtcctgcgcccactgtctggcactccctagtgagatgaacctggtacctcagatggaaatgcagaaatcacctgtcttctgcgtcgctcatgctgggagctgtagaccagagctgttcctattcagccatcttggctcagtatttcttttttaaacctgaattattttctgggagagaggctcttcccaagtgacccaaagatcattaggtctttgggtattcagtagcccttctggaagttcatcttctacttctggttactgtgattttctgtgcttccacgacactaacacgtaaacatcaaagagtggtctctctaagacagcttgaggagtgcacgagcagaagtactggcagggctgttcataaagccaatgccagaaagcagctcctcgctggcacatccactttgtactttgagacgcagtatccagaagccaggatgggcaatacccaaactatgttactttaagggctgaagatcaggcagggaactgagccccagaattgttagacattgttgtgagtgcaaagtgagcacttttgtctttctttctgctactcatcttacttgatcattcctgagtatattaaccaaatcctgtggtgtcttaaagataccatgtgtgccctgagaggctggtctcggtctagctttctgatttccttatcaattgggtcacatctgtattttctgctgactcacttatgtgtgtaaaaaacacaaaggcatacttttttttttcctaagcagatcggaacttctattccttttttttttttccagaagacctctctcgtgtactctcatcaaatgcttgtcctacatttgtaattattcattctagaagctgaggttgcccctagcaaccagcagttttgtctaaactgttttggtttcagggttgtcttaaaggagagtttctcaaaatccatttccaaagagcttttataccccacacagcaaaacatgtataaacaacaattcaaatttagggagcttaacaaggcctttcaacaaaggtttaaagtggtttcatcatatgatttatttaagattaaacagaatttctgttactagttaaaacgggagtgtaatttgcttttatggattcctatagtttcatttaataaaactcatccaatcagatgcactccctcccctgtgaaatcagaggcagtgccatatttgtaaatgtgtttcaggcaactctccaggtagtaactgagggctggaagaacgtacagcatccacctgccctcactgccatagctggcagtgttttttcccctccaaagctctggaaaatactttattataactcacagagccaaatgagaggcaatcaaactgttttgtcatttgaattaggaaaggtcaaagggaaaggaacataatagtagacagacagaaaagtgctttgtgaaaattacccattttttccacgtaaggaaaagtaatttgttttttttcagtgctagagatttttgttttgatagatttacagagagaaaagaaaccaccaagaattttgaaaggtcccatttcccaaacaaatatgtaacaagttcttaccatttaaaagatggcattataatctcttgcatctatgtgatcatttataaattacgctttcgtggacatcaagtcattgatgatagtaatgaccctggtggttgccagaccatgtactgttttccttatttcacacatgaagaaacagaggctcaaagaagtgaagaatgtacccaagtttgcatagcacagcccataaggtgcagagcctgaacttggacttcagccatgacttctatgaccacatacttctctgtcaccatcttaaatgtagatatctactaatttgtcataaactgaaggacatacatagcagcatatttaggaatgctggataatcagtaacatataaatagatgaaaggagaagttgcttcaaggtgcttagtttaaaacacatatagcatggtatcaattctatacaatggccaaaggatattgtgtaaccatgcagacatcagttgtcactagtaattctcaatgttttatattcacactttcttggtataaaaataaatatttgtatttgttcacgaagttaattctataaatcctgctacaatgagttttaaaaaaataaccaacaacacttcacttcagtcatctgtgtaattttcctttagtttggggcattttctaggtaaagttttagctaaacaatacagaaaaattaaaaagttcagagatcttttaatgatatgaaaaactgtttctaataataataaatgttaaaatcatttcactattcaaaagactgcgttcagagcggaggcaccctaacatactactctaggacatttctcactgccttcatcttcaaataaaagtgagaatagaaccctaacctttgagagatggaaataatgcatgtatatgtctgtttttatatctttcccatgtgtatagagcttagacactctatatgtgaagaccctccaaaaatcaagtctggctttcttctttcaggataaccattcccgaaacaccaaggacagggatacatcagaatggacccctacctgtgctatatttaaagatctccaaggatagagattttacgtatgtcagtattttttaacactatcagacaatgagaatattcctggccaggtccacttagtgatttcttcattgaaggatacaatttagaagattggaggagcaattataaaagaaagtaatacaatttagaagattgggggagcaattataaaggaaagtagctgtaggtctccaaaagttaaagtcccttaatcccagttgccttagtagttcttgcatgaaagcactaaggaaggatcaatgactgggagatgggatgaattctgaattgcaaaagagacatttaaatattacttgcaaactaaactcaaagcacaaataatttaacactgttttgttttagtttctaaaaaagtggactctaattcattctttccttgttcaggagataaaactatttgtaacctttaacatgttcttttcttcacagttgagagctcagtttgttaatactttctttcccaaactgttttctgaatgtattggaaaactgcacctgccagaatggattggtgtttgttcttcttcaatgaaaggtggctgtgatcaggagctgccccttttagagagcttaagctgccaaagcctaatacaacagaggtggaacggaaaatgagaatgaaggacatattcaaaaatttaacaaattgttggtgcctcaggcatgaagcccattggtttccaaagaatttggcagaaagatttctatcttctcatcttgtaggcaattaccttaatatggcacacttttgtgatggctttcattgaaaggctctgtttaaacatctttttctgaatcaccaagataagaatggagcaaatgaagggaaaaaaaatattcacttgtacacaaagctgctaccttcaattctctgaaattgtagttaatgcctaattatactgacattcctattgtacaaaagtgttgagaatgcaaatataatttcccagctaattatttcattacatggaagtgacatgagtgaagtaataaattagcatcgtctttataagaaccagcaattctggactttataatattgaaattttcaagtggagtgaagtgcttttttcttatgactactctgattaggtgaaaaatgccttttaaatttatgtgtataatacacctccttccttcagcagatattttaccattaatataggacagtgatatttatgtgagtacattattactgagaaggagacccaaaggatgtcaaagggcagagctgccagctgcgacagtctggcttgtactgcttttcttaaatgtggttcaaagcaatcagattatgaattgcagtgaaataaacttacttttatttttaaaatacaaccaccattaacagctccccagttagaacaactgaatgtcaaataattgcattctcaaatttaaactagaaaatagtagagcttgaggaaggggagtggaaactcaatagtgacacattgagatgggttagaaggtattcagttctccatttctttgatttaaggatcgtcaattgttagtggtgcgattaaaattaatacaaattttcaggaaaaataaaactacattaaatgcacaggggtttttaaactgacaatatcatacagtgcccaacacttttgtttttagaatcaatccatgtctaaaataccttcaatccagagtctgcagatgtctctgaaccctttggtcattagcagtgaagcattggcattaaggtgccaggccactttgtgtcacccatgctccttgttttgacaaggtgctaaaggtgtacccttgtggttggcagcctattacaaggcatattgaacacgtttttcctctgtactttcaatttggccaagttttttacacttaatttttaattttaatatttctgtaagccatatagcttctcctgaaactctaagggagcttttggcaaattgcttagtacctgagtgggaggcctccatgattcatggctggctacaccagtctttgctcaccttgaacactctagagtctattctgaagatttggcgatttctattgtttttcattgttttgcctcacacatgaaaatcaatcttctgtgtacatcaaaatataatgaagaattttaatcaataattatggactgtaatttaaaatttaatgatctgtgttgataccagtgtaaataagtgaagtgtaaaatacattatccagggccctttctgtgtgatgaagtttgcatgtggacaaacaatgacaatgaatatatgaatacaatacaatgaatatgtttgtttatttgcctagaatttggtaactttcttatggaatgcatcaataacaagatacattccaatttccaaaatgctaaaaaaggagaatactgtgattcttacatttagggaaatatggtattttatcttttgaattttatactggcagaaacaggagatgcaaaaaatcagaaaaacaagccagacgtggtggtgcacatctgtaatcccagctacttgggaggctgaggcagaaggattgcgtgagcccagggtttgtgatcagcctgagcaacgtagcaagaccccatttcaaaaaaattagaaaaattgtgcttaagtagccttttggtcctgatttgcttgagagtccagcttgtacccattgtcctgacataatcattaatagaatcccttttcactctcaaaagtttcctggcctacatagcaacttaagtaatggttactctacttattagtcacttttgttggtaataacaatgcctcgagagaacagaatagcttggtatattatagcccttcaaataaatatattaaatttatataatcctcagaacaaccctattaaatagccctttctttttgatgaggatatgaagctcagtgagattaatggttgccagggtcatttagctattatgtgacagaaccagtactccaacccacaggtccagggcaaattaattccattgagtttaataataataacactatgaatgatcatcataatcaccattactaccttactaataaagctaccatttgcccaacagaggttcttgaccattgctgtgccacaggccactttggtaatctggtgaaacctatggacctcttttcaaataatatttttgaatgcataaaataaaatgcatagtattacaaggatatgaattttattaaaatatagttaccaaaaattttaagctaaatttgcaatatagttatatatgtggttttccaaatgaattaaacaagatcttgaaggattatttaattatgactatgatatcaaagtaatgatgaacataaagaatacttagagatttctgcaacaagtctaatgtgatatgaaaagatctatgatttctaccagcaacaaagtgacaggttttgctaatactactgaagtttgttgcttacattcataagtaaagaaaattctaaattttacatagaggttagtaaaaataaagatgtaattttttcccattcaagttcacagagctcatccaagtgtatcaacccccaagggaccccgattaggacttgctgccttggaataaacctgcaaaacaactattattcccattttacaaatgagtaaactgaggctcagagtaattaagtaacttgcctaatattatttaccttatggctgagaagtgcatcaaatggcattggcacttgtacatcacctccttttgctccccagtggcaagcactatagaggtgggtattgtagtgtccacccctctctgagactgacaaccttttcagcatggttgccctagtcacttgcacatcctttaaacaccaatgatgcccttgatggagaacacagatatccaaagagaaactggaggagaggtctgagtgtctgactaatgctttttattcaaccctccttgaggatttctagtgttcagtatcccgtcagtggtcctcacatggctccccagaatgatcattattcccgacatatttgctgctattttctaccatagctattttcctcttctacctttaggtgattattgctgctacttattactattctcagatgaaggaaattgtttttcttcacctcccttagttcaatacaggtacctatttggattttttcagtaattgctataattccttagcctctctttatctaaactatacccattaaattatgttaactcttctcaaagctaaattgcctcatctgtttattattttcctcatcttgcctgaatattttaaaacttacaaaatatgtgaagcgattgttaaaaatctaagtagtcccaggacacatttattagttactgtaattgagtcttactgattacacatgcattataagcctcatgatgtgctaactttagcacaacaaagatacagttttaaaatattatatatttaatattttttaaattctatgttgtcagttcagttactgttgctcatctccttctcctcctgagtaatggccaagttattttggtgagtctaacatatgggagtctcatctttgatagcaaaatgatgatgacatatagtctactgagaatatattcagccctgttttcacctgagaaggaggagattttgccacctagcctccaaaataagagcatcttattccattattgaagggacctttgaagtttcacttgtattttgataatttatggccacttcttaaaaaatcactatcactctatatatcctcctggaaagcatttgttttagcacttataatggatgttgtaaacatttgtatattattaagtgctttataacatacacagtaaagattcagctaataactttaattgtggaactgtaggttttcttgagaacatttttttaaaaaggaaaacagattctgaaaaactgatgttattttatcaccaacatgagtaaccacatcatcatcatcaacataatcattatcttcaccaccaccaccatcatccaaaatggcatctagttacatgctcgcatgggttcacatatacaaatatacacacatatgtgtttaaacacacacatacatgcatatatttattcattcagtcagcacatgtttactgagagcctactaagtgccaggcagtgttttgaggtctgccctcatcttgcttccattctagtgaatcaagactgataataaattggataaataagtaaaattgtatgttagatgaaaataactgctaaggagaaaaataaaacagggagcagagatagagtacatgaggagggggctgttttaatttttgatagaggggaacaaggcagactttatggaggtggtaatatttggttaagacctgaaaggatgaagaggagagccacgtggatacctggaggagagcattctagcgaagatggagagttgttccaaaggtgctgctggaggccatgcttgacattcaggggatagggaggaagccaatgtgcttgaaatggagcagtgaaaggaaagcagtaggacaagaagtcaatataaagaagcccaggcagagtcaagccccatgggccattttctctgagtgaggttggaactatgggaggcttttgagcataggagaaacatgatctgaatcaactttctaaaataatcattctggctgcttggttgagaacagactaaaggggaaccagaatggaagaaagataatagcctaggcaagacaagagtgtagtttggaacaagatgatagctgtggaaggcatagcaagttgtcaggctgcagataatattttaaggaaggagcgaacagaatctgatggtggattgcatatggagtatgagagaaatagaggagtcaagcataaactgacagtttggggcccaaacaactgaaatgaggggagttaggcagggggaaaagggggagataaggagtatgggtttgaacctgttaagtttgagatatcagactttcatgtggagaggtcaagtaggcagtttggtaaaaagtatagagttcaatgaattgacatttctcaaaagaagatatacaaatggccaacaaacatatgaaaaaatgttcaacatcactaatcatcagggaaatgcaaataaaaaccacaatgagataccaccttacccctgggagaatggccattattaaaaaatcagaaaacaatagatgttgtcgtggatgtggtgaaaagggaactcatacactgctggtgggaacgtaaattagtatagcctctatggaaaacagtatggagattcctcaaagaactaaaagtatatctaccattctatccagcaatcccactactaggtatctgcccaaaggaaaagaagtcattatatcaaaaagacacctgcacatgtacatttatcacagcatggttcacaattgcaaagatatggaataaacctaactgtccatcaatagataagtggataaagaaaatgtgttacatacataccacggaataccactcagccataaaagagtgaaataatatcttctgcagcaacttggatggaactggaggccattattctaagtgaagtaattcaggaatggaaaaccaaataccacatgtcctcacttataagttggagctaagccatgggtatgcaaagacaaacagggtggtataatggacactggagacttagaaagggggagaatggcaggtgaatgaaggatgaaaaactacctattgggtataatgtatactattcgggttacgggtgcactaaaatcccaggcttcactgctatacagtgcatccatgtgaccaaaaaaccactgtacccctaaagttattgaaataacaaaatgttttaagtatagagttcaggggggaagtctacagatagccataggcatggagttttcttcatataaatgctccatctgaatggaaaataatagttaccctctcacaacacccctgtccccctgtccaatggaagctcagcttctatgttttcaatgctgtgattgttggttttgctctccagggaatatagtgcccttagaggctctgtctcttcatcttgaagatcccctggtcctagggtctggattctccacaagcctcctttatcacatcatcatgatcctcactggaatcagtctctctgaactgttttcttcctcctcctgatgtctcactcccctctctcctttctccagggctattgttgccaccagttcctaaagccattggttgcaccacctttccttcaataagtcagctgatgtaattggatagagatggttttgtggctaactttttcagccttttgaggttcaagtccatattctgtagacaacttgaggcttctttagtcataaagccaaataaataataactcaactctcaccttcagattctccctgaccaagatcatttctcccattttctaaataggctgaaggaaggcaagggctgaaacggagacaggatgctactgcagtactccacgtgaaggctggtggtcgcttggactgagtcagaacagggaaactgatgggaagttgtcggagagtaagtctatgttgaaaatagagccaacaagatttgttgatagattgcattttgggtgtacaagcaagagaggagttccagaagaaaccaactctaccagcaccttgattttagccctgtaaggcttatttcagacttacaacctccagaactgttagagaataaatttttaggccgggcacagtggctcatgcctataatcctagcactttaggaggccaaagtgggtggatcacctgagcccaaaagttcaagaccagcctgggcaacctggcgagacttttcctctataaaaacacaaaaaaattagctgggcgtggtggtgcacctgtagtcccagctactcaggagactgaggtgggaggattgcttgagcctgggaagccaaagctgcagtgagccaagatcatgccactgcactccaggcttggtgacagagtgagaccctatctcaaaacacacacacacacacacacacacacacacaaattgtgttgttcaagtcagtgactttgtggtaatttgtgacagcagcaataggaaactaatacacaattagacatctaagtggaggtactgagtagctgtgggatatgagtgtagaattcaggagatgcatgaaaatatgaatttggaactcatcaccatacagatttatttaaaaccatgagcctaaataagggttccaacacagtaagtgtgatagagaaaagaagaggcctttagtctgtttctgagcaccccaatttctattggtcaggaggatgagaaaaccagccaagaaaaatgagaaggatcatccagtaaagcataaaaagagccaagagtctgaggttccagaagccaaggcaagaatgcatttccaggagtaaacaaatgtcaagtgcagctccatcacaggtttgaaatttggtgctcactaatggtttccactttaaattttttgctaatgcctacaaaaattctaggagggacaaccaatgtttgagagtgagatactctacagaacatgcttatatttatccttttagagattgcctaagctctgatcctctcttggaaagctacattctggacattagttggatgcttagaataaagtcatctgttcatttgacaagtattttcaagtgcccgttagctaggttctgagaatatgctgatgaactaacaagatccctgctctcatgggaacactttcagtctagggtatttgctgaggccaaacatcacctcttttatcaagcttttgccaacatttttcagtagttgctttcccttctttgtacatattcatagaactcatcacatttaatgtattagccagttattgcctctgctggtaaactctcccctcctttaggaaagcaaccctatcttagtcatcttcatatatagataccctcatatgtaggttggaaatatgatttattattaaaaccaggaaatgtctgcaagagaaaggaggctctgttaattaacaccaagacaggggatgtaaactgggacttcctagggcaaacaaaaatgtatagtcaccctatcactcaagtttacgtcaaaataactgttgaataaatacattttgcttcctgaaaaaacacatttactgaaatgtgacttaatattttgcttttggctttaattgaggatcaatatgtaagaaatagtgttaggaaaagtgtttctgcatcttttgtaaaactgttattggagactgtgtccattattttgtccagcgttcctcatataaagagccatgtaattactccccttagaactgagcgctagaaaaaaatattgcttttttcaaggagatggtggtgcactttctcttcctagataatgagagctcagtaatacatcaatcacgctctcacattggcagccacaagctagagctaaattatatcctcaagttgcttttaaggctgtgtcaaaatgttccaaattgtgacttttcctttgccttaaacatttattgttcacctactatgtgcttagttctgttatttaatctagagatatggcagagatccacacacgtgattcctgtgttcatggcattttcttggttctagcacatttacctactcttttagtacagtatttggacattttcttgtagagagccttaaatttttgcaggagcaaggcaggcatttaaaaaaaattgaatgaagtgcaataggccaacaaattagggaggggtatggacggtagtcacagaaggcttgggcagaagtagggcatgaagtcacttgagcagaccaaggagccctgaagttcatattttggtacttttgtttttcataaggtttcaaacctgctaattttcttttgaaaaagaagaaggaaaggcccgcctaagaaaatataattatttctaaagttgtggttagcatctttactaatatttgtaaagagtacttgatcaaataaggcatatggggatactgtcacaatccagaaatgctgaaagtgcttgtctgtaggctagagaaagaaaaacccacaaattgggttttaatatgatacaccctatacaccctaggattgagtaaatatttgggttctagagtatagcgtagtctatttttgcaggacaagaaaatgatgagtactatttttttaaaaaataacctgtctacttatgggtagatgaacttagcggtccattataaccttagaaagggacttgaagaagctgctgcagtcttcccaaccaagagaaggacattagaggtcaaccagaaagcactatcttggctggaacaacaatgccatcaaaaacaagaaacacatctttatgtgttggtttatttagcatgtcacagtgttaagggaaaatggtcaaatgaaggaaaggttcttcaggcaggcaatttagttgttaccttttgaacctggagaagaatagtagtgtggtgggtataacaggaaagactgacagataacctgttagaagaggggactgagagggatagagaatgaaaaaggcagggaagtctgctcctacaaacccagctatgttggcactttctcttctacaactgcatactgaaatgaacgtgaaaccagtagcatgaaacacttgaccaatacatagcattaaaggaatcaaaatttaattgtgagctcttgagtcccactacttctattattattatattgcttccacatgaaagaataaaattagaagctgaaatagatatcaatttgctatgtaagcctttttttaagtcatatctaccgaatatcctggatattgcattttttaaaaaagcatatcaaatgcagtcagatttgctatataatacaaataaaattactctttttagctaatgtttatgccacatttttagccttctggctcactgttatgaccgtagtgtcatttatgcagggttcgtgtgtttttggtaagcttaagagttatccacggaccttaacaagcacaagaggagaattcactaagatctagagtgcttcaaatgacattgcaaacattggactgcctgaaaacataggtttgtctcagaacagaatacctctgtgcacacacacagaatgataggtctggaaagggatctccagtggctactcattctgttcctgtctccaggtacgatggtggctaaaccatagtaggagtgcagtgacaagatggttagatccacagaggctcctgcatgtgttaggtttcccgctctgtctgcaattttggtactaatgtaacttacccaagactgcccatttccccaagctgcagccagttgagctatcaaataaaataatttatgttatcatccctttcctggctctcccttgggtgcccaaagctgttcaaaactgagtgctggagactgaaagtaaaggtcaaaaggaaaagtctgaacttcagggtagatctgaccagaaaataaaggctgtctttctaccttgcacagcagaggaaccttctttacctatcatccaatcatgttagttgtttgagctgaagctctgtaaagaaatcaccttcatccacagaaactgggaattccagggtcactggcagaactgcaaaacaggattgcagcaactcagcacacacattgtaagatgatttgcttttgagaacttgttttgagcctaccacctgaccaaacagcatcaccaccattatctgtaaaatatttacatttacagggcaagaaagagttactaaaattgattgccctgtgtcagtgtggagtttacttctttgaagaataaattgaggaggctacatgattaattcaaatagttaggagtctcttttctttccacttgatcttgagacttcaatgtcactttaagtcaaattcaaagacatgttgagaaacatgagaaaatacgtttatttcatttatttttccatggtggtctcataagttattttttctaggttatgagaagataaaaaacttttaaacaaagaagccaaatttggagagaaaggagctattattgaacttgggtctatgtttctgaaaagtagcctagaattttataaaagcaaaaaacaaaaacatcatccttgtgtttatattaggaagtattttaaaacatgcaatatgtattttaaacacttttcttttgaatcttgcgttgcacccaaagaatgctaatggtaaccaaattgttctttggcagagtagcctgacccttaaaaaaaggaacagaagtgttacagcatgtgattgtagcacaagacaattatgaatcctcaaccctgagcagatattaactaatcctatgatctgaccataagaggttaccttggagcattcctctacattgcattatgtatattacatggtaatgaatgacagttttcatggctcctaataatgagcagcttctctttatttagagaacaaaatagggggtttacagataatatctgagtttatcattgagctgctcagcctcctcttctatgtgcctcagcttgtctcaatcagtgctggttatctcagcaataaagcattcagcctctagaagttggtttcttcctacaccctataaacaagaggatgaatatcttgttacatgtgctaaaatgagttgggtgaaatgagcattactctgctccctgtcactagctataatcagcttttcaaatctatactgagtgtgtccccacacatagcacactaaggaataaggatgttcgtgacaatatattcctgagaagcagcagttctaacatcccagtgacagctattcattccagtttctttgtgcagagacattgtcccaactccttcaccatgtgctaacaattagataatgactccataaatgtagagaaaaagcagtgtcatggacggtgggtagtttgttttcttagttctttattgaaaacatatggagatgtttatatataaatagaaaacaataaaacgctgccatcatgtaagcagcaacttaaaaagttctacacgaatagaaatcaaacatttctatacctatgccagaattctggtttactgatatctacacatcctgtcttatttggcttgaaaagatgttttattattttaggctttttatttatagttggaagcaaattgtggagcaagagatttttgtttttgttttcatttctttcttggcttaaacaaattacttttttagcaggaacaacaacttctgtccaagtataccttgtgttatgatcatgaaaaaaagtttttaatgtatacatttaactacggtctttgtatttctgaattaaaagtgaggacttgtggcctgacagaagtgactttcaggagacccagcagtggagaggttgagagcactgcttaggaggtagaagcaattcctctgggttggaattctggctgcaccacttaactagctaggtaaccgtgggaaagttagtcaacctgactaaacctcagttacttcatctgtcagatgagaaatataagagcacttaaagaatgatcatgcacactcatgggatgagctgtaagacgttacacatagtgtctggctcgtaggaaacatcacagaaatgctgcctagcatcgttgtaatcagctaacagaagggcttatattgagaccatccttgaaaatctgagaagtgttgatgctcagtgccaagaacagtaacaacagtaatgctactgtttaccaagtgctagttatgccctagcctttacaatgtactgtttttgacaattccatgagctgggtaccattatcatccccattacagctaaagattggttgatgtgagggtcaaacccagtctggatcattcagaagcccacactcttgatctctctgctaaaatggctgccacatatatagcctagggcacctttgaaaccttctttatttacactattctctatgttcctgtcaacatcctgtgacattgcacaatggcattcacaaactgtgaagtcccctgtccctaggacatctgttcatttgtagttaaagaggaccaggaaacacttaatgaacacattattagaagccctggttttcaattcatgcaaccatttttgctttggtttaaaggccttttctttaaaggtgcttgaagcttcatatggacaggctcattattcaagcttttgtcccaacctacagatgcagaagccaaggaccaaagtaacatgacttggggacagagggagaggccattcacctgccttggtagcccagtgtatcagttgctgaatcaggaatacaacagactgagcccagggcagtgtccaactcatcaggctgctcattaatgttgggtctaacagccaaactgctaactagctccactttttaaaaacttctattttaagttcaggggtacatgtgcaggtttgttacatagggaaacttgcctcctgagagtttgttgtacagattattttctctcccaggtgttaagcctagtacccattagttatttttcctgatcttctccctccttccaccatccaccctctggtaggttccagtgtgtgttgttcctctctatctgtccatgtgttctcaccatttaactcccacttataagtgagaacatgtggtatttggttttccatttctgacttagtttgctaaggataatggcctccagctccatccatgtccctgcaaaggacatgatctcattatttttgtggttgcatagtatttcctggtatatatgtaccacatttcctttatccagtctatcactgatgagcatttaggttgattccatgtctctgttattgtgaatagtgctgcagtaaacatacacatgcatgtgtctttataatatagaatgatttctatttccccttaactggtatatacccagtaatgggcttgctgggttgaatggtaattctgtctctaggtctttgaggagtcgccacactgctttccacaatggttgaactaatttacactcccatcaacattgtataagtgttcccttttctcctcaacctcaccagcatgtactttttttagtttttaatagttgccattctgactggtgtgagatggtatctcattgtggttttgatttgcatttctctaatggtcagtaatattgagctttttttcatatgcttgttggccacacgtatgtcttcttttgagaagcctctgttcatgtcctttgcccactttttaatggggttgtttttctcttgtaaatttgtttaagttccttatagatgctgtatattagacctttgtcagatgcatagcttgcaaaacttttctcctgttctgcaggttgtctgtttactctgttgatagtttcttttgctgtacagaaactcttaattaggttccatctgtcaacttttgcttttgttgcgattgcttttggcatctttgtcatgaaaactttgctagttcctatgtccagaatggtatgcctaggttgtcttctgggtttttatagttttgggcttcacatttaagtctttaatcaatctttagttgatttttgtatggtgtaaagaaggggtcaagtttcaacttctgcatgtggctagtcagttatcccatcatcctttattaaatggggaaccgtttccccattgctttttttttgtcagctttgtcaaagatcagatatttgtaggtgttcagccttatttctgggctccctactctgttccattggtcttgtgtctatttttgtaccaataccatgctgttttgattaccgtaatcctgtagtataatttgaagttgggtaacgtgatgcctccagctttgttcttcttgcttaggattgccttggctatttgggctattttggggttccatatgaatttaaaatagtttttctagttctgtgaagaatgtcattggtagtttaataggaagagcattgaatctgtaaattgctttgggcagtatgaccattttaatgatattgattcttcctatcatgtagctccaattttaacctacacagtacatgactagaagcactttgcctgattttcttgttggaagaatgggatctgcctgcaatatggaaaccctcacaaacaagatgactcaattctgttttcatttgcaagatatattgtgaatgttcttttctcctttttgcaggagagggaaagggtttagggttgtgggtgtggcagggcatagaagggaagaggcttaggactgccaaattacatgtcaacctgctgacttagcatcagtgtactagttaaatgagccctgaatgtaagacattaatgcaaatattttgcatattattaactctaatgatgctaccataatgcagtatcctcagctgaaagctgaggtggcattttttattataaatgccctgggtctttcactgaaaatcaccatgaagacaagtcccttagaagtgagagcagaaatatgaacagagttctgcatcgttaaccttctcatcattaacaataacaaaaaatattggtgtcccagggccctgcattcagtaaatgccggcaacatctttctttagaaactatcactgctcttgcccttataactacaatatacttccaaagcaaaaggttaggcaatcattgtaaaatggaatctgttttagaaaaaaatactatgcaatccccaaattgttatgtaggtggaaaatcattctaaatgcagaacaagtattgcttaccctccagtgccatgctagtgatggtagtgtggagtcttggaaagcagagggtttcagagccagcgctaccatttgccagctgtatgacattgagcaaatcgcttgacctccctgattgtcagatcctttcctataaaacagcaacattaataatactgctttgtctattttatgagttgccaaagaacaccaaaggagattgcaaatgtgaaagctctctggacgcaatgtacaaatgttattattgattttttactaggtgagtaatgaggaatgagtagcagtgtttgtccaaggatagcttgggaataagtcaaccaaggtggcagttggtaggtcttgaagatgtggttggctcctgggaaacagatgagctggccagtttgaaggatcttaaagttgcaagttttcgggctgggtagcaatttaactgtgcaacctgtcaagagcctattatattctaaatttgtgccgtgacaatattggctacatgaaataactgtgtgctttcttaccagactttatttggaaagagtttatgaactagtggcctggcagcgttgcctggaattaacagtgctgtggttttacaccagggagagaagtgtttcatgccttgttctattacctccctccctggagattcaacagatggaacaacaacaaaatcagaaccccaagacaaacctgtcagcttgatgcctttaagcttcggcagaactcacaattaagataagatagaatatccatttagaggaaagaggtgcaaagaaataagttcacagagcataccttcttttgtctgagcatggctaatactatctggagatccctgccacataggaggaattgtatactggaacacagtgaacacttaagaaaattagttgaaagaatattattgctagtagaaataactgaacatctttaatatggggctttatatttcccttcattatatttttttaatcctttcaagccaactcttgagtttggcaaatcctaggctgagtaattgtgcatctcagaatggttagataatatgcagagcagaccttaagtcaggcacagcaacatgtgttttggcacagccgtaaggaggtaaagtatttggtaattgttgtttgatagttcccaaggagaaagcactgaagcaacagataagaaccaaacaattttctcttgtgtttaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggtaagaccaaaagatgaagttgtgttccttatatattgccaacaatttaaaataaaatttctgttttaatagagcacaatgaatactagtaggccaggttgtccacggaaaccttaagcttttgttcaaggtataatctgatgatttctaaaactgggataatagtcctcaccttgtatttgtttacccatctgtatccctccactctttctaaattataagctcctcactcccagagattctgatttagtcattctggaattgggcctaaaaatccattgttttgttttgttttttaaggaggtatctttggtgattatagcacaaatgatctcataaccaaaatttgagaaatagagtagaaggcaaatattactactaatatccttctagttctagtcctgtgctagaaaaacttccttgatccaaataattccctattaaaacactgtggtatctgaaattttaccattagagatagattccttgagggtggggtactttcttttaatcatgttttaccttaatgcaaagactcctgtgcaagaggttgagcataaactaatttaccctgggcagtgatttatcatgtgaatatcctgaagagaagtcctaagtccctggggttcagggatgaaattatgaaatgggagcggacatgaggaggttacttacagaaatacaagctggaacagctggaacagtctttttttttttttttttttttttttttttagacagggtctcactctgtcacctgggctggagtgcagtgacatgatcacagctcactgtaacctccacctcctggccttaagcaatcttcctgtctcagcctcccgagtagctgggattatgagtgtgcaccaccatgcctggctaacttttgtattttttacagagacagagtttcgccatgttgcccaggctggtctccaactcctgggctcaagtgatctgcctgccttggcttcccaaaatgctgggattataggcatgagcgaccatgcctggcctctagaacagtcttaaagaagacaaatgtatactacttcacaaagttacctaagcctggccattgaaaaagtttactgatattgtttgtgacccgaggttgcttcctcaacaccattatatccataatccaaaaaagttaaaggatccatctgcaaattgttctgtatttgtactatacacataggatgcctaacatttgaacagttttaacattgctgtattcagaaatatttctgtggctacaaacatttcagaggtactaaaacagtgtctctggacctactccactccagatttttttttccaggctgcaaagtagattttaccaatagtaacatactacatagatttaagatttttaaaaagcttattcttgcaatactgcagatttttaaggcatattttaagttttaaggtttataataatctttcataactaaaaataaaaggagcttttctgtactctaatagaaagaccaaaattattttcctttgttctttgttctgtgtatgttaacatattttgaaatctcttaaagcaacatttccatttacaatgctgtacttctctggacagatccaatactatctacatatgtgtcattgataaacatgatctaagtgtaggggagagagtctgccctttaaattatatagaatcatttgtatgaaattctagattttttctgagcctgaaatatttcaacaagaacttcttaaaaattgagaaaccctgaataagctgctgtgtggtagctgtgaggaaaagactggtagactgtgggtgaatgagagtgcagacggggggtggttcaaggtgaggtaaggagctgaaacctaagacagaattgggaacaaaaacttgtccctccccatcccaggtatttcttttttgttgtgtttgatcattgagacttggctctagcttttttccttcacatgtacgtgttgtataagaatggttctgtttggagtgatcaggttaatttgattcttttcacctaaaataagaaagcattttctgtctttgccatggtttaagatgaggtcagatttgatttctacctaatagaatggagtggggagactgagcccattatggttgtataagaattaataagaggccgggtgcagtggctcatgcctgtaatcccagcattttgggaggccgaggtgggtaaatcacttgaagtcaggggttcgagaccagcctgaccaacatggtgaaaccccagctctactaaaaaaatacaaagttagccggatgtggtggtgcaagcctgtaatcccagctaactgggaggctgaggcaggagaattgcttgaacccaggaggcggcagttgcagtgagctgagatcatgccactgcactccagcctgagctacaagagtgaaactccatctgaaaacaaacaaacaaacaaaaaagaattaataagagttaaaatgtgttgaactcctaatgtgtaggaagtacctaggctttttgcagacactgttttatccatacaaccatcctatgaaggaggtacaattatcatgatccctattttgcagatgaagaaacagactcataagggttaaatgacttgcccaagactatactgcccttagggcaggagtcaccctgagaacaggccattttggcttcaaggctggtggcccttttctcacaatatgcaacaacactgaggggtctggaatgctgagaagcctccaaatctccggcagtgtctaaaatgtttatcttactcagctcttgcttatgcaaaggatttcagtccattcctgctccacagtgatttacccctgggagaaaggagtttgttattgtaaataactacttatatcttctcacattctttgttctactcccttctttaactctgaaagatcagaaaggtttacataaagtcagtagctcatttagatgactctaaatgtttccttgaatgctgttttatttcctttagagcattagaagacagaaccaaattactgctgtcttccttttattacttttgagttatcctttgatatttcaaatttgggctattcctggaagaaacaatggtactggttataactcttgtcacctattgaaaatttcaggtacctcactgtgtgcagtggcttacccctgtaatcccagcactttgggaggctgcaaggtgggagaattgcttgaggccaggagtttaagatcagcctgggcaacacagcaagacccccatctgtctctaaaaaaaaaaaaaaaagaaaaggatgaagaaccatatttgggttcttcatcttttttctaaaagatgaaaatgaatttgtctgaaaaagaaaaaagtaaaaatatatcagttgtgtaccctatatttgtgaaggcctgacaaattatagcttaaagctaagggtaggattctaaatactaattaagttatcatttaaataactgctcacctaacttctaaaaaattaatgctaaataatatttctaaactccatccttttttctttctttttttctttcacggattcaataaacatttattgagtccctaccatgttctaggcctattaaatttctataatttgaggtgactgtatgatgactagaccccaatattccatgtatactatttaccaaaatactgatagaactgtatatctatcacacagatagaattaaaattcaacattgctttcattaattatagaagacaaaaggatcaatttataatacggccatctttgggagagaaaagatgatatcctttacccatctagatgatatctataatggacagaataactgtcaacattaatataaggctttggggaaaaaagattttctttaaaagtatcttggatgtactttccgcataaactctttgttctagatcttcagattccagccttctcccatgtccacctccttccatattcctattctttctctctaaatcctcagtgctctttaaggctcattctgtattcactggtgttcatgaatccttcctgagtccgtagtgctctattgcttttccaaatttctaacgcgcttcaagtctttgtcccacaacctggcatgtgaattacaaactatgatattgttcttggaacactaggggcttatgtgcatcctgctgcctatatgcagtgatcagttctttgaggttaaggtcaataatttctcattctttgcctgttccagagctgtcggtttaattttaggagacatttaaattcttataaatctgacttagcagaaacaaaaacattgaaataattattgtctagacaagcttttagatacttcagtttaagaatatgaagaaaataaaggatactaagagccaaaaatgtataaaaaatattgggagaatgatataaattgggaagcctagagcaataaggattatttctcttaaaggagcaaagactgagagaagatgtatctttcaatactttagtgattctcacacataaaatggtgaattgctcttccctgacaatttgaaagacaatacatgacttaaagtgacctaagagggatttaagctagtctctagtcactccagataatagagaggctttaaatctcaagtttttgcctgattctcctatatgagctccaggttaggatgaaaggagtctatttcattctgagtatgtcaccaatgaggtataatccatggttcttagatgtccctaagtgcatccttcttgaatatatttcttctttagaaactctttcacaaaatatacattaatgaaagaaaattaaataccctcttactgtgacctgagagaatgagcccactcttactctatatctgccaagaagagtttactcctctgcttcagaatctgaaattcaactttttgttgttgttgtttttagtgtggtggcttgtggtagacggtgtattgcaaggagttagaggacttgagtgtatattctgacttcaaaacttctaactatgtaggcaaacagtgtaatttttctaagcctcatttatttgttattaagcatccttattaatcaactattgtatggtactggagaatcagtagtaagaaaagacagataagatccatgctctcacagacaacacagactagtaatgagacctggttatttcatctgcaaaataagtctggtaacctatgagtcattatttctaccaggcctccacttgtgttctcctcctcctctgtcccctatctcattagcaggcactataattcagaaacctcaaaagcacccaggacataaagccaaatgtttacaagtcctgtttactccaaatccctgctatttcttaaacccattccctcctctccaccccacagaccttgtctcaccaaaactcactgattcctacagcagcctcctagtaatatcccaacctgtgtttttaatcttctttcacctaattggctcactgcttctagaatgaactttctaaagtgaaaatcagtatatcaacctggatgcttttggctgcaaaatgaaacagaagacccagtcagaatggcagtaaggggatgatgtttttaaattcgcttaaaaagaactttgcagcaggtgttacagagtgcataatttggccatttgaccacttcagggacgttggttctttacatctttccatgttgccattctcagcatgtagacttttgtcaggcctgtctctttgtggtcccaggatggctgcagttgctctaagcagcacattctcatacattgtgcagtagtggaagagagaatgtctgtaacagatatcccttttgaagagtgaggaaatgttttctagaagccctaaaacaagtttcttaaactccatattattggccaaaattgtgacatatgtctgtggctaaatcatgcagaggcgatagagtggaattacctagattggcttatactgatcaaattttacttcctaggcatagggtggggcccagtattcactgaaaaacaacttcttgagaagctgtttgagaaaaattgggattctttagggaaaagatgatgatatctattgggtaaataattaaaagtagctgcaatatctgatcatccctgctccttgcttccaatcctccagcatctccctgctgtctccagagtatgtatgaataaagtgttcaccaagtatggcattcaaggccccaaatctcagaaatcaccgctaaataacttactcatgtaaccaaacaccacctgttcctcaataacgtatggaaacaaacaaatgaaaacggtaatttaaaaaaaagaaatcggggcatccaaatcggtaaagaggaagtcaaactgtcgctgtttgctgatgatatgaccgtatacctagaaaaccctaaagactcctccactcctttctatccatctctcagtcatacaagtctaattgaagttccaggcacaccctgctgctctcatacttccttgccactggacctgccctattctgtctttttcaccagttaatttctactcactcatgatgcagctccttgttctcctccttctcaaaccttctgcaatctgctacagtctgagtaaatgtcccctgggtacactcgtacaatgccctgtgttcacctctcctcttagtacttatcttgttctcctaattgtgatcaattgtgaattcctcagaattctcagtgcctacaagtgcctggccctcgacaaaatgtccatgactcaaatgctgaataagcaggatccatgtctgtaggaagagtaagataatgccaatgaggtttattaactataatgcaagacacaactgtaagttatgattaatttagtaacgacatcactcattgagctgtcctctttcattgcatattgtgttgttttaaaaatcatattttagtttatgtcatcttttctataatagttcagactccacgttgaagtaccaaatacacagattactcagaatttcacgtattttccatcttgcttatttctgcccaatacctcatatggcattaagaagaactaaattaaaactttccatttctacatttgcaaaggcctttcctctaaaatgttctaagaaaggagacctcaggacacaagtagaaatggtactgtaaagtaaattgaaggttcagcctctggacccaggactcctgcgttttccaatcaccagatggaatagcgcagcccagcggctctatatcccctgttgtccctaatttaatggtgcctcccttatggtgaaaacactgtacagtgatgtttgaagggattgatgctccatggtaagcagacttcgccctactgggaacatgaaaaggaacctctctgatttgtggctgtaatcctcaagccctcgtttaaatagccagggcagtttcatttaatcaacaagcatgtgttgagtgcctgctgtaaaccaaacgctgagacactgaggagagaggatgaaaaagactcaacaggtctctgatcttgtggagtttacattgtgatggaggggtgggacactgggaagatacagactataactaagaaatagattaagaatagagaaaaacagtagacattgataaaggctatacagagaattatagtaggtggttacctcttacctctttaattcagatgagtcaaagctcttgctattcactgactgctatttgcttgacagcagtgtatgacatcctcatcaatattgcattcctggaaattgttcatcagaacatcttataagcttcttctgctcttccctcttgcagtagatctgcttcagctcaaacagaaaccactgggtatcttgcccaaagcagacctggctcatgccttctaggataattaccaagtaggagaagagcaaattgttataccattgggcagttagtcatgcactgctttatgaagtctcttctattgttgccttgaactgttttttaaagcacacactttaactttaaagttaatatactttgtactttatctccttaactggattgaggatgaagagactattttcttcttgttcatatacccacgacacccattattacttggcatataaaatgtatccagtaaatgtttactgattagatgtattgatttaaagatgaaaataagctaaggaacaataaaaggaagtttttggtatagtaccaagataaataacacatgcagaataactgcaggggcacataggtcagaagacaagaaagacgtggaagagaggagcttgagctggacattgaaagatatgtagtataagaatggacaggccaggcacggtggcccacgcctgtaatcccaggactttgggaggctaaggcaggcagatcacctgaggtcaggagttcaagaccagcctgaccaacatggtgaaaccccctctctactaaaaatacaaaattagccagatgtagtagcgggtgcctgtaatcctagctacccgggaggctgaggcaggagaatcgcttgaatccgggaggcagaggttgcagtgagccaagattgtgccactgcactacagcctgggtgacaagagtgagactctgtctcaaaaaaaagaatggacagaagagggtagagaaggacattcctgatgagataataatatgaaaaaggcaggtgtccctgtggggccggaaaggaaagtgacaccactttcctaattcatcttgcagggcagtgggcaatgagaataggtgagtacctctaggccagatgaaaaagagtcataaatgtcaggtgaaaactctcatagctgatgcgaagataccggaacgctttacaaggagagggattaatcaaagcagtgttttagaatgtaaatccctaaagcttgtgcatgcctagagcatccaggtcacactcaagtagaaggctcaaagtaagaacacttaaagggaacgaggagcttgaggaagtagcaaagggttgaaaacaattgctttagaaaatcagataatgacattatgatgttgctccattgtatgtactataatgacccataaaacactattacttaagtctctgtaccattttccgtgccttctaatgacatagcctagaaaagttttccttttctatcttccccttttagggtctcaagattagctcttctgagttccccttcttatccataggactttccatccatttcactttacaagttctctaatttatttcttatgttacactttaatcaatgggtagctacagtgtatataaattatggaggatacaaaaatgagatatggacccttctctcctggagctcacaattgaaaactgattttggttagcttaataatcgtgaagataagaataaagacttcatcacagaaaactaaataaagctacattaaaatttctaagaaaaatatctaaaattacttgaaaagccagtggagtataaagaagaaggatttcaaaatatgttttctccttgtcagccatgtgagatttttctctctctgctttaaataattaggaaatgtagaatttattttgacttgttttaatatatgaagtgattttaaagtgtgattttttaaaaatgctattaccaaaactttcaaatgtatacaaaactaaaataatatcatgaacccccatgcacccaccactcagcttaaggagtttttcactcatggtcagtcctatttcagccacacagcagctactctcctacacccagtttattttgaagcagatctccaaaatcacatcatttcatttataaatattttaatttgtatttctaaaaggtaaggacttggttttatttgtttttgtttttgttgtttgtttgtttgttttttgttttttgagatggaatcttgctctgttgctcaggctggagtgcagtagcacgatctcagctcactgcaacctccgcctcccgggttcaagtgatcctcctgcctcagcctcctgagtacgtgggattacaggcacacaccaccatgccaggctaatttttgtatttttagtagagatggggttttaccatgttggtcaggctggtctcgaacacctgacgtcgtgatcctcctgcctcagcctcccaaagtgctgggattacagtcatgagccactgagccctgccaaggactcatttttatttatataactacaatactattattctacctaaaatattttacagtgatttcttaatatcatatccaatatatggccagttttcaaatattcccaattgtcttcatacttctttaaaaatagttttctaatgtaaaccaggattccaataaggttcaaacaatgcagttggctgatatatcccaagtttcttgtaatctgtaggttctacttccatcttttttcttcttaccacttatgtgttacagatgccaagtatttgtcctaactccatttccacggcatcatttgtcatgttcccctatcccttgtatttcctgtggattgagttaaatctagaggcttgccctaagtttgattttttttagcgggggagagggagtgggctaaaatgctttctagatgttgctgcttgttttcataggcataatgtctaattatctccctttttatgacattagcagcctagatacatttgaagttgacccttgaacaacagggagtttaggggtgctgagccctgcacacaaaaatctgcatataacttttgactccccaaaaacttaactactaatgagctactgttgatcagaagtctttatgataacatagtcaattaacacatattttgtaaatgtattatatactgtattcttataataaagtaagctagagaagagaaaactgttaagaaaagcataaggaagagatacatttatagtaccgtactctatttatcaataccatctgtttacaagatgaattttctgaaatggcaaccacggtggcacacctcaatctgtggtacatatcaagcaattcaactttttcttgtaaagtcacgacttttccctgcttcttgggagcacttccaacatcactagttgcacattgtatgagtcctatggtgttagtcaaggtctacagtattacactaaatgtgatgaaaagtatgtgagagccatcacttcttcctgtgatatgcaatttactggagagatgaactgctcacatagaggtgattagcatccgcagcattttaccagatactggcaacacttgagctcaccacaatagcaacaggaggtagctatgaaattactacagtagtacagtatgtactacagataatgttctgcagttatgatttaatactacatctttacatttgtttacatttctctcatctgcaaagggagccatgtacaatctgtgtttatgtgcatatgttttgacaaattttaactttttataatagatctgtgtatactttgtggtagtaaatgctaaaataaactagcatccacatatatttatgcattcataacatacctttttcttaattattttgatatttccagactatgtggttcattgtagaatttttttaaattgtcacaaatctccaaaaaatttgtggaaaaaaatatttgaaaaagtggatccacacacttcaaactcatgttgttcaaaggccaactagatttaatttcagtatattctgaatggtacagtctaatcatgtaattccttctttattaatttaaataaatctatgcaaacagaactttccccttatcagctattcagttactctgagatacttttgtataagaaggtaggataaatgcctcattctttctctttatttacctatttttaaaccatcagtttgtttactagtatcacccaaagatgatttatttattttttgtgtcattattaactgatggatttaaaaatatttgatgtgtttcattccattgtagtagctattttattgatgctcaaattgtcccatctttggccaattgaaacatctttaaactggttctgagtccttttgacatgaccctcatagttgttgatatcatcctggctttctgataggacaaattgtttcaggctatcttgtacatgtcctgccctagatctgaaatcagctatctcttcaaagaatccaatttattttcctaggtcatagtatttagaggccacagtctgaacagtaagtgtgtgtgttgctactggattgttcattgtttctaggtcttttcagcagacaggactaggaaacactttttttctccaacatgaaattatattactaattatatgatatttccaatttaagttgaggactataaaattgcactttacctcactgatgttacatctgcattttctttttcccctgcctacaatcctggctctcagtggaacaacataatcactcatttgctttatcccacaatacacacccagtagtctcagaaaaacagtatcaacacgatcaccaacagtataactattgaaaagagttttctgtagttctttttgtttttagtatgtatattctactagagatgtacaaatttctgttaacctatgatgcatattactctaaatatgatatcatttccatttctctctctctctctctctctctctctctctctctctctctctccctctctccttttttagagatgggatctcacccaggctggagtgcaaaagtacattcatagctcactgcaacctcaaactcctgtgctcaagcaatcttcccacctcagcctcccgagtagctaggactacaggctggcgccattgtgcccagctaatttttttaaaatttttatttttagagatgaggtctcactatgttgcttaggctggtcttgaattcctgggctcaagcagtcctcccacctcggctgcccaaagtgctgagattataggcaggagccactgcacctggccatttttattatttttgttttaaaacctccactattgatttctaaaatgtttaaatgcttattttctaatttttctttataatgtggggaagagaatatgagtaggaatcattatatgatttatgaattaccttggagtgtcatagttagatcctcaggatactattgcctgttctttcttcttagacctgactcaatttcacaatttcattcactcattcatttaagaaacccaagtaaatgctatgaagcaattggaaaagaggcttaaggagagaatttaacatatatttgttgtttactatgtgtcaaaattatgatagatgctttacttatctcataatttcataagaacattttgaagtataaattattattatgtgaccaattttcaaatgaggcagttgggaatcagggagtttcctttgcccaaagtcataaagatattaagtagagaagctagaattaacatatacagtctgttttactcccgtgtcacatataagatgcagtccctgtccttaaggagttaatggagggttgagacccaagaagaacagagtacaataggagttcaggccaaaagaaaggtattaaactgccggggcctcacaaagaggtggcatttcacctgattatcaggaaataataaaatgtgctggatgtagagggaatgcatcccatgtcaaaaattggagatgagcaacattctgtaggtaagaaaatgtgaggggtatttaaaatgataaccagtcgggttggaccaaagtttagttaatatagggaaatagaaaactaaaagcgttgcctggaatctcagttgggatctgaaggtcattctgaggattcaggacagctagaaacttttgaaggtttgagcaggagtgaaatatgctagggcacaatcctagccactgggcaggctccggctaacccagatccttctccttggaaggactccagacaaaacccaccctcatagatccacaagtcttgctgattgactgcatgtcttctagcaatttcctagaaaagttgcattttcttcgatgttttgctactggaagttttgccaaattaagtcttccagttgaagagagatggagtagccccacatagcattgcattgcgattggcagtggttttctgaagtctcagatgtgagcaaataaagtctgactctaattagacatacttaatctgctcgttgaaacttggagtcaaataagtcttagagtgacatttcagtcttagagtaacatttcactgatttcttataagagctttgctaaaaaatatgcttatcaatttaatcaattataggattctagaaatcacaggaaaaacatcacaattaaagagattttggtaaaactgagttaaaattgggtaggactttttactataaaaataagttatatctaatgttatacaataaactgcctagtttggataatttcattagcttaaactcttccctttgctcagtattaaagttcagaagtggccacctaacctaacattcttacatatccccctcatggggacttttaacacagtgaattaagtgtcccctttattccatttttttataagaatgtatgagattgcataattcatgataactaaacttacttttaaaatatgacatttgctgtcttaattctttccagttcataatctataaatcaaatatggtcgagctctgtgaaatctattagttatgcatcttttgagacctgagtgatccgttgcctatcataggacgagatatgaagtgtgtcctcagtattcttagtacccacccttctttccttccttccttccttctttccttccttccttccttctatacatgtattttttgtaatagcttgaatagtttactgtcatgtaagagaatagtatcttatgtagaaacatagcgtggacttcaccaatactcatttttggaagtttaaacctaagagaaaaatgtttgctggatacatctttataaaatctacatttttacagaaatagttcattgattattataaatatcatgtttgaaaaacttttaaaaatgaagttacacacagatattgtttaatacctttagcactatactgcgaagtgcactgcagaaataaagccattgtttatttagatgggtcagtgattccagactcactactcctcacacaagattttatctgagataccctgatcattgtagtcatttggcttgtgagcttcagttgcccccccatacgcttaaatttttcattttgtgctagtgtagaccaagtcaaagcccacataaacccaatatatgtgttaaggttagagttgtgcttcacactcttgactgtactttaaaatcacctggggagcttttaaaattatctcagtgctggggccccactcccagagagtcagagctaattggtcaggctgcaaggccacaacagttgcacaaatgcaggtggcacctcttaccaagaacctcttcatctccctggccttccaacttcctggagcacaactccactgttttccatgtgaatagcacccctgtacttgtgcaaacttggaagccctagcgatagtggctgagcacccatgttttcagaaggcccccaggtgttctaatatgcagccagaattgagaaccactgacatataactttgacattaggtgtatggattaaggagctgtgtagaaatagattcaagatctagctctactactttttagctgtgtgaccttaggaaagtcatttcactccttggaacctcaatttcttcctaaataaaatagtaatactaatacctacctcatgagattatataaaagaaaaataagatggtcaaagtgaaatgcttggcacaaagttaacacttaataagccacttttattattttagctattaaagcaagatttctatattagtctagattcctacagtactaagttacagaggtctatctcagatgatctgaaacaaaaatggggaaattaagcaagccacggaaggatagagtttgatttggcctcagattttggcatttgaatgctgttaggacacatattctctctctctttctctctctggggcttattccagcttctcttttcatggtgcttgcattctctcagcccaacttccccccttggggtaaaccatgaccatgggcagctcaagacatatcttttcagcctctttagcacagaacaggcaaaaaattcatcctatctgacccggttggaaaagttacagtgacccagcctggctccatccctgtggtcaagagctgtagtcattaaaacggggagaaggagtgctgtgcaggtaaatacaataaccagctttgtttcattgttgagacctgattcaaaataaataaaatacataaaactcctgccattctaggatctattggcagacaaggaaagtcagcagtaagatcccaagagcaagaacttccctgaaattaaaacacctagtctctccactctccatgatctatgcacaataatcaccccttaaggtgaatttaagatcacagaagtgtgccttatcccctctggtccagtttatttgagacgctcaaactcacaggcaaatgaggagttgaatcacttcataccaagctcccagcaatctgcattattgaatacctgaagtgttctgtcctcccactcccaccccatggtatttccttacccatacaagtgagaagactaggcagagttatttatttatgtaagtgttatttataggaacactctctacagctactctaacgtgtatgttatccaagaataaggcaatgaggtaaaacaaccacaaaaggcccagaaacatcctttaacatttggattgttctaaccacttacctgacacttgtggtggagaggcaacaagtgtcatgaaagagcaacaagattcatcacttatagcagtgtgcttttgacaagttacttaacttcctggagcttcagtttcctgatctgtaaaatgagggcaataatatttcaaaggactattgtgagaattgaatgtatttgataagtgataatgtatttgaatgtcaattacactctgtacagttgacattaaataagtggttttccaaggggggtgaataattttatatttaaagcattattgaaaaagctttgctatgaacatgttctcatgtatttggacccagtagagaggatgactgggcatgtactcgactatcctaagaaacattgcaaaagaggcacaagtactattggtactcaccagccattgggttcttagcatacttactttgtggttacaaaaaagagtgatggagctactagcatacactataaccaccctgctactatactggttcagtgtccttgtttaggaaagcagcctgactcatttcactgtaacatggtacaacactgcagagaataatgccaagaagaaaaatgtcaaatattaataacattactagctcttctatttcaaagaatgcctctagggattttgaggtctctttatagttcctattcagccaaagtaaattgattgattataggtgataagagtcggtggaggattatatgagtgaatgtataaaagcacctggccaaaggcacagaatagcacttggactgactctcacaggcgacatcaagttctagtttgtctgctatggactgactgggtattcttcactgtaaaggagcctcatccctaatggtgatgtgaagatagtatgtatcccaaaatatacatagggtatgcattttctgtgacctggaaatgggacaagtacctctgtaagcctcacttattttattttttttcacactgccatgagaaagtaaatgtaagcctcttttagcattaaaactctataacccaaaccccacatttttccagaagtgaaaattgcttacaatgtaaaagatgaacattttgaatgaaggagcagtctactcataaacttttaggagcaagagatgaaatagcacaaaactgcctatatcaaagaaacacgaataaagttcagacgtggattttaagttgttcaaaagattggtacttcaacctactaaaatactggggacaaactgatgagaatatcttggaagtgaaggaacatatttccttaattttcaacatgtagtcttggaaccagttttatttcaaattttttctaatataaatatataaatatctgatttatacagtttatgtatcccgtggcaatgtgatcttttgcttcttttattttcttcctacccctcccccatctttttcttgagggaatcaggaaaaggtgtcctatttctcaactgttgaatctatttatgaaaattagaactaaacagtttagcacaattaagcagaatgccacattcatcaaatcttcatttttctaagacttcaattctgtcagtcactagaaagcatgtgctaagtggaagctgtgtttccggtcttttggcatcccacatctgttgacaattacagaggcacatacagtgccattcatagaatggcatgtgtctccctatgccttggttcacaggccctcggggacatttacaaagtgtgtactttttaactgtcctagaactaaggagtttaattttgcctgagaatgtgtttatgtgccttgtaaaggagctagtcattcccttttgctttcctttattatgatgtgtgtatactctgtgtgtgtgtgtgtgtgtgtgtgtctctctgtgtgtatgtacaccaaagaagaaccacaccaggaattgagcataaaggctttctcttacccatctacacacctttcttgtaagttgctgcttttattttttatttattcttttgttaatagtgtatttcttggcttctgctggattttttttctgtttctaaacactatttagttctgatttcatatccttatgttcttcagtcaagactggggtcagacttctttatattatatatgtaattattacaataaaagtcaccatgtgtggtggcccacacctgtaataccagcaatttgagaggctgatgagggaagattgcctgagcctaggagttcaagaccagcctgggcaacatagcaagaccctgtctctacataaaatttaaaaattagccaggcgcagtggtgcattcctgtagttctaactacttgggaggctgagggaggaggatcacttgatcccagaaggtggaggctacagtgagccatgatcatgccactgcactccagcctggatgacaaagtgaaaccctggctctaaaaaaaaaaaaccaaaaacaagtccctggaccctctctggagctatgccctctttcttttggatctcttcctgacccataagcaaaccatattcttcaggaagtatctagtacctagaaaactgaagctgaatctacatgtcatctatccaggaacttcatctcgctagtcttaacacctcagatatttggcaatacccagaatattgaccatttttcctattttcatccaaatatttaatattgggtatgcatgaccatagtaacattaatttttttcatttaaaagataggtactgcctttggacattgtaagcatctcttgttaataccatgaatagttaaataaattctagtataggagccacctagaggagttgtttaacggctgaaagaagaattaggtgaaaaagaagttgagactgaggctaaagccaattgtggtttcatccacagtggttaatggtgtttcttaatctttaaatatcaaatgtgttgtaatgcttaattatccttaatacataaaggaagtgacctacaaattctttactgtttattgaaaagtagcatatttggaggctttgacaattctacagaagagaggaagctgttaaattctaggctaccatgtccttcaaatgggaaaaaacaaaatgcctgagcatgtctcttctccagcattaaatttttcatcagtttcctattaaactcaaggatatgggaagggagcaattttaattgcttggcacttaaaaagcctcctccactgttcaatgagttagaaatattttgaaaatttgattgcatttagaaccacacaaatttacctgtaataaaatttttgctgcacgcttaaataatgtcttctagaaatgaacatttaaatgaactatagaatgctcagggggtaaagggaagctaatatttattgaagaccataaggtgccaaatacagtatattcattattttatttgctcttcttaacatccatgtgaatgggtattgctgtttctgttttacgaataagaattggggctaaaaccagctgagggggttacctaaatggtacaaggtgcagggcagatctgaaatctgctctgtttgattgcagagtctgttttccttctctgttgtctttacattctcaggattatgttgaaaacagcaaagagtgccatcttattagctcatataggctttacagtcagtgcagcctgattcaccaaagctacacacccaccctcacacacagaaaaccacttgggggctgacttacctggatttgtgtctaaattatcccatatatcaaataatactagatctcctcttcagtttctgctttgtagttagcttaaaatatctcaaaactcacattgtcccagaggaataccaagaatgtcatcttacgttaagtaagtatgtactgtactgtctcatattaattaaatttatggtacctaaatcaagaatccttcagattggcttttgaagtgcactctatctctgccatgggaagagcccattttgaggttttcctacacaaaagaaaagaaagccacctccaggtatccttagggtcctttcaactgatccccaaacagaggaatctagtttcaatggaagtttttaataaacctcattatttgacaattagtcaagtgtctggcattccttctttctttatttttccacttctgcttatgctttcaggctcctttgatgttgtttgcccctccggtggtggtaaatgaccacaatggctaataggctggcttccacaggtgcctgttaacaaccacttcataaatattcaacaggagcattctgtgcgaaagactggggaattaggtgacctgccaaatctttccacatccaatatctatgataatggatacacaaattacgcgggacagaaggaatggccttgcactgtgaaaaaccgaaggggaatcaatacagcctgtggctcccagctcaggcaggcagcctcgcccagtatacttctcccaggtgccgacttggggggtcaagggctttcccctctgcctaatgagcagttcttccatagcaagtcatcaccaccccagagtggtgggctcttatctgtattttaattttttgttataatggtaattagcattacatcttgaatagtaaattaagaaacccaaaacagaattttaaatttaaaaagcttttccattaggaatccagttgcattaattttgtggatggaaggtgagctaaattagccaagtttgtgcattcattacctcgttctaatcctcaacatcacaaatgcaaaagactgtcattagatttgagaactgacaagaactgggatttcacagtatgaatgttgaaagattaatttgaaaagatctcactaaaaaacacaaaaggttattgctaacatggaatattttatattcatagtctgtacctagttttaaaatgcctatttacagttatctggcttaaaaataaatggtacatttacagtacttgatcaaattggaatatttctaggtatcttgttttgatgatagagaagtgtaggtatccaatattatatgataatattggaaatgctttttttatcaagagatatttgactttcaattattatatccaaagagaggttaaaaataaagagaaacaagaaagagaatgggctttttcacccttttacttcatagtatgttgtcaaaaaagaaagttattcttttgcaatatttcaccctttgtgtttgccctgaaaatattaatggtgaagtagaaatcacagtgatgaaagcagtgtcatacatttcatgaaagtacagttaattttcaccaaatgagttgccaagctggtagtgggtaaaaatgtaaatgttcatctttgatcaattgaattttaatgttgtgaatagctgtatgccttgatttatacatctgtagcacattttaaacatctgtgttcaagatgaccatttgggaaaagattcattggcttcacttagttcatgttgtttggttctatatactatattcaagtcccaaatgagacttttctaaaaagaaattttacacaaattgcttactttattatagactgcgcaacctagaatggcattttaaaaaccagcatgggtgatttcaccatgagttttcaaaggttatacaattgttgaagaatgaaaatgtatccgtttcaacagtgaaaatgagaataattgatatttaaatgctacagtagctgaggctaatgtttctcttaggagctctgttaccacaggaccctcactctctgtgttgtctttattagtttctaggagatttttgcatttagaacctatagcctagcttttaaaaaatgctactttaaggtcatagactggagtgtagcattatttttcatcaaacttgattaattttaaccataggtagctcaaaagaacagctcaattaaaactaccacatatacaggaagaaaagaaatagattgcctgtagcttagctctaaaataggaagtccaagctatactcgaaataacttttacaggtgacccttctatttttaagacaattataagctgggcatggtggctcatacctgtaatcccagcactttggaaggccaaggcgggtggatcacctgaggttgggagtttgagacgaacctgaccaacatggagaaaccccatctctaccaaaaatacaaaattagccaggtgtggtggcacacgcctgtagtcccagctactcaggaggctgagacaagagaatcacctgaacccgggaggcggaggttgtggtgagccgagatcgtgccattacactccagcctgggcaacaagagcaaagctcagtctcaaaaaaaaaaaaaaaagagaaaagaaaagaaaagaaaattatagtattaccatttctaaaatgtctaggcagccattgctattaagaaagttgcattgcttctatttaccttacaatgtgtttgcatctttcctaaaagcacaggcctagaagtaattccaatgatccagggggtagtccatagtctccccttcgagaccagagctacagctgcagattttgctaacatcagaatagtccgctagttcttcttcattttctattagtacaggaatccccccatgggcttaaaagcagcagctttgttataagaggatcttttaaaaaaaattactcttgagatccctttctgctggagatatatttattttgtagtcaataaaaacttacaggaccccttctgaaagttttgcttggtaactcataatttaaacatctgtcattttttcctttttaacactaccctttatgtgtattgaactcaacctaggatggggtagggagtactgatcctttctttaattttgagtggccttttggaaacacttacccctggaccagtagtattcaatgtggttaacaatctcctgtacagcttattacaagcgcaaagactcctgagcccaataccccaaaatactaatgtagtaagtgtggggtgagactcagaattttcatttttcttaagttcccctgcgggctaagaagggcatctgggaaccatcctttgaggagtaagatggtctctgagtccttgtttatctgtttacacagaaactacctattgtaaccacctaagaattatgtgatctaggcagtgttttcccaggtatactaatgttaacagttgcagaagcaaaaggataacactgaggttacttcacacgaatggatgtttgatggattctgagagttccctggagtagggagacctgggtgagttccagggccctgatgctgatgctctggcattgtgcaacttaaatgactcagttttctagtgtgtgagtggagataatcatctttccctcctacccacataattccaatgctctgacaaatgtcgaggcactacctgtaaaaataatctaatttctacatgatggtgtagttatataagtaaaagttttccagaacaaaataccaattgaaaacctagcattttttaatgttttataatttccccccattttagatgatagcttgtaaaactacttcctcacagactttccccataactttctactttacctttaacctgtgctaattcatttctataaagacattgagataccagattacatgtcatgtttctaaaccactctctaactggtgtccttggaaatttcacatttcccacactcagaacctaggagatcaaccatatttgactcaccgaaaataataaccagtctgggatatggtatgggaaaaaaattaggttaaaccacaaaactcttcccaataatgagtcagtgtgtgagtgcctctgtgtaagacctcatttaagagcagcaggagctgagtgggggacagttctcaagcggttctttggaattagcatttttgcaaggaagctttcttacccaccccaactagagaaacctctcattgttttacccacctcatcctctccaaacattatgatgcaacttcacatcataacaggatgctgcaagagtccatgcccctttaacttctgctttgtctaagaccaagaacacatctatggctggacaaattgggtttatcattcattgcagtgagggagaactcatgtcatggggacccacgatgcatctcaataaaagggtgttagaagggcttggaggaggattgagattttgtgtagaggagagtttggtaagagtccaagaaagtggcgttcgctctagactgggcgctgttgggaagtggggaccatcctatgactgtgtatcttaataaactgtgtctacagggacagaagcccagaaggagactaaagctttaattagtaaagatgcagccatcacttatatttctcagaagaggggatgtctgatattttgtggtttgccagtgactttgttttttctgggcttaaatgaaattatgaactggctagttttgactgacttcagtacagtcacagagtgaccttgtctgttgctggcgttccatgagattagttatttgttcatgaggagaacagatggcatggtttctttaacagcactgatacctacttgtaattgtcaggccagttcccagatgtcagaggctacttcttttttagatcagatacctttgtagcataaaatcagttttagggcagtatgatttttcatggtgaacattttaggttctctttgtaggtgctggtttttaaattaatctttagttttgccattgtccatttatgatcagttgatctgatttcaaaatgcaaatccctagcatttaggaacttatacattgggaacatttagggatttaggaaaagtgggaagagtgaagaaaggtttctcccatgaagcagtgggtcagtagggaaattataaggaagaccaaagagaatgaaatggttaccaaagtgtactaatgtgagagatacaaagatggatggatagatggatggatggatggatggatggatggcagagagagagagagagaggatgaaaatgtcatgctcatctgaacctcattcttatcaccccagggaaactgcagttatcctaaatgcctctggtaccaataactgacaaaacacatgattcctaccatttagttattcgtctgtttgtatgtatgtacatacgtacatatgcattgcatctgtttgacacataatactgaaaccgtatactgctaaaattatgataaagagcagctaatgttccaataggcttttcttgcttcatagctaaggggaaaatgtatgggatgaaaactccagtagaaaactgtgtgcggcatttagttttaacacccactacctttgaaatctgtcaaaaatccattgtccgctgtggttagcctcagaatcataaggtttaaaggctataaaatgttcagtttcatataaacatagaatggattcaggatttgaggtgatgcattccttttccaataggtacttctgcataactacccagtagagaaggatcctttcacaaaaggtgtgggaaaactatactacaagcctgcagtaaccaaaatggcatgttacgggtacaaaaacagacacataggccaatggaacaggttagagaagccagaaataaagccacacacctacaaccatctgatctttggcaaagccaacagtaaaaaacaatggggaaaggactcccaattcaataaatgctgctgggataactgactagccatatgcagaagattgaaactggactccttcctctcaccatacataaaaatcaacccaagattgattaaagacttaagtgtaaaacctaaaattataaaaatcctacaagaaaaccttggaaataacattctggacattggccctggcaaagacttcatgatgaagactccaaaagcaattgtaacaaaaacaaaaatcgacaagtgggacctaattaaagagtttctgcacagtaaaagaaactgtcaacagagtaaatagacaacctacagaatggaagaaaatatttgcaaactacgtatctgacaaaggtctaatatctagaatctataaggaacttaagcaattcaacaaactaaaaacaaacaatcccattaaaaagtgggcaaaagacatgaacagacacttctcaaacgaagacagacaagcagccaacaaacatatgaaaaaatgctcaacatcattaatcatcagagaaatgcaaatcaaaaccacaatgagataccgtctcacaccagtcagagtggctattactacaatgtcaaaaaataacagatgctggcaaagttgcagagaaaaaagaatacttacacactgctggtgggaatgtaaattagttcagccactgtggaaagtacttttggagatttttcaaagaacttaaaacaggacctaccacttgacccagcaaatgctgtgtgtatactcagaggaacataaattgttctaccataaagacacatgctcacatattttcatcgcagcactattcacaatagcaaaacatggaattaacccaaatgcctttcaatggtagagtggataaagaaaatacattcattacctgggtgacaaaataatttataaaccaaaccccaatgacacacaatttacccatgtaacaaacctgcatatataccccctaaaccaaaaataaaagttggatagaaaaaagaaagaggtgtgagaaaagaccccactgtgacacataagtggcatagataacagtggagattcactcacatttgttgagtattacctagacagtggagattcactcacatttgatgcgtattacctagacaaggaggacaatggcccctcttcctttctgtattctttgtaaagggtaggccttctgagaggttaaaccaccaatcagaatttgaaatctttaaagtaatcaatttatccgctattcatttgccttctactttaaatctaaagttttgtcacagccaatatttatagtctctgacatcactgggatcagaatggaaatactaaaatctgttttgtggtatcctaaattcactgaattagtatttattgtaggactcccatagggtgtgagtctttacaaataaaggtagggaatgccctttatttgtaagggcaaataagttcctccttctcttgtcaaggggatgtgaaaacctccttgcacattttttcttttctttttttctctttgcagaatgagtgttctgagaagaacaaaactcttttctgacaactcttataaaacacttttgtgtttgattctccaacgactaagatttggacacacaattctccattcatttctcaagtgtcaagaaagaattgagtttaaaggctccaattcccttgcaggttacactgtctatctagatgaattagtattcagcacagctttgggaaaatctcaaatgatttgcaggtttgcaaattgttcaaactcataatgaaatttcaggctgaggaaatcactaaacagttcatggcatgagtttttccctctgagatctggacatcttagatcaattcactcctctaccttcgctgccccatccatgccagacagcccagggctgcttgagaaagtcacacacacctgtcaccactgaggttattctcctatccccatgtcctcccctgctcagcaaaccagcccactctccatccattttcattctttattttctgttcctatagcatgtgttcctcttcttatccagggctatgttctgagtccggtccccctctatgccctcaagcaactcaaactggcaattatttatatcctattgcttcaattctctctcttctctaaacttttcccatcagaatataaatatttcaagtattcgccattaaaatatatatatatatacagctttacccaactttatgaacctccagctctttcttttctttgcagccaagctttttgtcctctcactcattcctccttccagtgcatcctgaattccacttggaactgtccaccaggattaccttcccaaggacacaaaggtcctccttttggccaaattgaactggtgcattctagtccttttcttgtttgatttttctgaagcattgacatagttgaccaccacttacatcttgaaactctgtatgtccttagcttctcttaactcctcttttcattcctttttcgcttcccttccttgtgccagtcccttacgtgttagtatatgctaggatctcatccttggactctatttattcaggtcactgttcctggaagataactctatagattctcaaatctatatctacagattttggaagccatgtggccaatgttaccacttgggtatcctgtaggtatttaaattcaacatgtctgaagccaaacttctatctcacccttaccacaacccatctctaggaatagaaattatcgtccaagtcgctcaaacctgaaaacttggcattgacttagacttattttcctcattcactctcccttattcagtcaatccttaagataatgccatttctaccctttaaatgtagcctctcctttattcattgtactgctgccttagttaaggcactcaaaattcctcattactgcattgctcccagttgtcttcccaaaatgtggcttcccattctttcaaggccaactcttgagcatgacatattggtatataaaggcctacatgacttgacacttgccaaactctccagcctggtctctcatgggtttttcatgtggacttaactctggccatagcatcctgctggaaattatttaaaaacaccaaattatttcacaattccttatttcatatgctattattccctttgctacttatcttttaaggcttagcacagagagcgtcttaacacatattactcaagagatgttagcaatcactattgttgtttttgttgtcatgtctccctttagtatctaaggctgtttggtactcctcctctgttttcatagtaaacttaaaacatagccttaatcatactatatcatagttggctacttgtttttcttgtcaccaaattctgaattttacttttctcacttacattgccttcctggaacctaaaagcatttgggcttgttatttctgtttaaaataacaaagaccatcaacaaatttccagtgaaattatagttgtggtggggatgatgatgatgatgatgatgatgatagctacatttattgaactctatgtcctaggcacttgctaaatgtttttaaatgttttccattataatcttattaatgatttcatttaatgggtaaggaaactaacactgagagaggtaagtaccttggccaattcatataagttatgagtggtagagccaggatttaagcacatagagtagtattccagagaccaaaaaataaagaaatcattatctatgtcctgatactaaccttatccttattactttatgagaaagagagcctggaaagtcaattcaaaatatttgttacatgtctactttatgttggattgaattaggtctttgaataaaacagctcttctttgaactttatctcctagaaagggaaataagatatgaacctccctaaataactaggcaaaatattataaatgctaaaacgtacaactactataaaaatggaaagagagaaagtttaaactggttgaggaaaactcaggaaagtcatcttggagaaggcggcatttgatatgtgcctgaacagttgagtcctaatgcgtgaagatggcagaggattgaagagtgcatgagatttgaagggtacttgtaaggaatggaacaaccacctcttattactctgctttatggcaaaggagtaagatgaaggcaagaggccttcatagagctttctccctgcagagaggggaagagtatagtccctcatgactcagaatctcttggttgctgccatgcaggcatctatggaatcacaaaagcaaggcccaggaaactttaaactaacctatgcttcccgcccagaattcagtctatttccatattagtgggtgccttctgtccgtacctatttctgtgtgcaatgtgttgagtcttttgagtggtggcttaacagcccaggagagaattgagctatactgaggcttcatatatgaacacagtatggttctattcttgaaaaggtttccagcgtccttttccaaaactatagagttgtgctgctcctgtctagaaagcagctcagtgaacttgaccttgacccttctgctgtatgaacttctcagaagattgcagatacttttattcaataagtctattccccctttttttgtttagtcaagtaggtaactattttgtgggtatattttctaaggtcaaattcctaatgataatagacaacctgaagttgatagtggccaactccgtgacattgctacttgataaatataccaatcttaggatctcttcttttttttgagtacacaaaaatcattttgaaatgcctgacttgctagttttttgatgccttacatatggaatatgcttaataaattacatttgttatttactatatgtgactcaatatatacatatgcaagtacgtatgtgattgtaacccccattctttagtcctactctctgtcaagaataagaagcttaaaggtccctataaccaacacagaattcaatggcctctgtcgtgtaagtaatgctggcagctacaacaagcaatcccatctcagtggcttaacaaaacaaacatttagttcttgctcatgttataggccagtggggaacagtttgtgggaggggtttggggaggaatattgtgcgccatgcaggtattcaggtatccagacttctatctactgacctggctgtgccctaaggtctcagagccttgaagttctccactggaacctctgcaactggttgcccagacaaggagagagagagagagagaaagaaagaacatgtaaatttacaagagaggtttctggaagtaccacacatgacttctgcccaaattccattggctagaacaagttacatgttacatggccctaactaagtgcaaggggagccaggaaatgttgccttcctatgtatccagaagaaaaataaaatgatttgttgaacatacagcattgtctctatcacagcctttatccccttcattattccactcatttctagtattttgaaagtttcaaggtctcccccaaccctcagatgtcaagagggcctcctagtagattgatggagagagttggggatacataaagaatgcagtcttcccaactttacactactctctttttcctggatcatggctttctgcagctgcttctcatttagttcagtccaaaaacattaattgaaatcccaccatgaaccaagcactgttgtaggatctggggagtcaatgatgcacaagacagtctctgccctcaagatgctgagtctagtggggtcctctactactgtggcatgttctttcatcaactccaaagggctttctccagtgcttttccccctcccaaacttctgggttcttcagagagaggtcatactccccttccaactctagacagcaactctcagcagaagccctgctggtccttacaggaatagtctgtgtttccaaaaaccttctttgaacaccctagaattaattttgagggataagtctagaaaacataacccagagccatattcctgcttattattaaggtcctctttagattatgtcctcaagcatggcacacattcactgatgttctctggcacaaggaaaactctcatcctctctgagtggattggttgtcttaatggtcacagtacaggtcatcatacacctctggaggaagtctgttctccagtattgagaaaaattagcagtagaatcaaattccccttcacaggggaatttattcaattgggtcctggaaacagccattgatatcccatgattcccaaacagagacatgcaaatagaattctacaatagcctgaggttgtatgtgtgtgtgttcactcacacccccacacacacatacataaacacacagatatgtgtataaaattaaatttagaaagccattttgtagaagagactgacttaggcctgttaaataaaagtttaatttaacaaagcaacccggtatttttttcaccaagtttttaaagcattcaagatgctaaattttccaagatgagttttctggaagaagtcccaaaactcccttctctctctttttttttttttttttttttttttttgtgatgaagtctcactccgttgcccactaccaggctggagtgcagtggcacgatctcagctcactgcaacatccacctcccagattcaagggatcctcctgcctctgcctcctgagtaactgggactacaggctcacaccaccaaacctggctaatttttgtatttttagtagaaacagggtttcaccatgttggccaggctggtctcgaactcctgacctcaggcgatccatccaccttggcctcccaaaatgctgggattacaggcgtgagccaccatgcctggccccaaaactccctttctgatcacatcctatcaggcttagaaggggcaggtattttcttttggtgggttcaactccacctttgttcattttgattataggaaaaattcttaagatatgtgtgttttttttttttctgactacgtggtttctcctagtgctaaattctcaccatgcttgaaatattgtagagcaaagcagctctagttatcctcaagaaaaggatcaaagaagggaaaatatattaatgagcacaataattcaaaacctcttaaaatgctgttcccaagtgtgctgggactttctggtcatgtctctgcgaaatggatattttggatcttgctttagcatacacaggaaaccaatctccaggcagttcttccttataatttctttacaagtttccccttaaagaattcctaatgtactttcctcaatagtaacatagatttttctagagttagaaaattatgagaaaatagagtgagcggctatctcaagtgtgtttacttgtctagtcccctgatattaactagctatgtacctctaacaccaaggcaaccacattattgatttaatgataagctgtacagcagtgaaatcacattgtttcttcatagacacagagaaagcagaagcatagctactgttgtcaaggaggttaaaatttagatgtgaacactaaaagtgggaaccccaactggaacataagttccacgagaggcagccttattcactgctgaatctctagtgtcttgagtagtatctggaatatgatacagttctccagaattatttgttgaacgaatggagatccaacagcatagagcaatatatcaccaagtattaaaactgtaagaatggcaggagttcactgagaaaagtgaagactttatgaagacagtggagttgagcagagccatagagctatagacttccaataggtggaggagagaggagcgggcaaaccaggcaaagagagatgagagaagtaacacaggaggtaatgagcatgttgcagtgggaaagtgggcttggctctggtcagaggaatcatgcaatggattaatagaatccaggcaggtcagggatagggataaggacttagacatctatctggttttgtgtcctagcttcgtcatttattcaatagctgaataaatcaccccttttagtctcatttaatatctaaatttgagaataatacatagaacatatatttttaaaattcaagaagaatttataggttaaaaatggtaaacttgaagagcttttttaaaacatggtattatcattgttattatttatgacaacagtgttctggttgaccttttgattgtggttttcttagtgggaaaatagctcatataatggcccccgaatgtatgcctgggaagaaatatgttaaaaaatgaaatctagtgattgattgtttattggataatttcaaaatagtacaagggaaaaaattattttagtactcctaagtattagaaataattttacagttcaatttgtgtgattaaattattgtatattatatacagtcatttcacaaaattgttatgcgggaagtaaagatccgttcagtcactgagttagcaaaggaacttgattagaataatactcaaccacgtttgtattgtcaggaaatgttagagaaagctttagtgttgttaatgactcttggcatatataatactcctcgtccttaaagaacttgacaaacattgatttaagcctcttttcaaatatattccaaaactaaagtcattgtttctgagtatgccataaaagataaagtacgatttggtggttctcacattaaaaaaactgttgaagaagcagaagtgaaaactgcatattcatagagtaatgatagtttgggagatgatagtgttggcttaaaacaaattgggtggtatgttctgcccacaattgatcaaattgtggtcaattatatagacagattcagcaaatatatagtatttctgccgtactatatatatatatatgatatactatatatgtagaagatatactatctctctctctctctgtttctctccttagagactctgagtctaaagcagacatcactaatcaatcacagattctttccaactgagtctttttttcttttttctttttttttttttttttttgccttttgaccaggaaaaggaatccaactgagttttgatttggccattatgtctctttgagatatagggctctaagtagccaataccagagatcagagttggcacaggcaaaatggaacctacttactatcctagaatcaaggatagttctacgaaagtttcaaagagcctcccttatcattaatggctgcaaatatataagggcatataattaataatacataaatgcaggacttaaatgacagtaatatctcaatctcccttcccacgtgttgctttcttcattcatttggcccttcatttttattcattagattggtggctctctctctctctctctctctctctctccctccctccctctctctctctctctctctctctctcctgatagctcaccttatgttaagtgctaaagagaaaagatataagacctgcttgctgctctgaaagagcatgcaatatggtacagttagggagataagatctagctgtgagaagcagtcacacatcctgcttctttttaaaatgaatgtgattacttgagttgtttgtttgttttgaaaataaaaatgcactcaaactgaaaaaaaggaaaacggatgtatttcttcctgggtttgcaaagccacttctgatttcaaagaaagctgctcgataatttcttacgggctcaactctgaaagaagctcttagaaaccaaagtacctaattactaagtcacccccatccaaccatcactactgtttgagttaaactgcctttttccagaagtagagagaggaataggggagaggttctgtgatgggaaaagaatgaggaccagagtgattgtatatgttgctgtttctcgctattcaacaggcaattgaaggcggctgctttacaacattggcaatagtgccttttcacttaccttcttttactcgcagtttcaaggattcagatttggtgttttgattaggaacatggtccaaaaggcctgagttcaggtatcagctgtgcgatttcagccaagttcttaacctatctacatgtcagtaaaatgacattactgacatttttcatctgtaaaatgagattaaaaacagtgtcactgagggaattatggtgcactaaaccacccagcactacacccagactttgcatgggctgaaaaaatcttgtctagtattatcactggtgatgcttagttgactatattagtttccttttgccactgtaagaaatcaccacaaagttaagatgacttaaaacaacaacaacaaaaaagtgtctttttttacgttctagaggtcaaaagtcagaaatctgcttcactgggctaaagttagggtgttagtagagatggttctttacagagtgtctgaggggagaatctatttccttgccttctagtgccttggggccccttcttccatcttcaaagtatatcactccaatcatctctgcttccaccattgcgttgtcctcttctccaactacctcctggtttcctcttgtagggatcattatggttacattggacccacccagataactcaggataatcaaccatcttaaaatccttaatttaagcacacctgcaaagttcctttttgccatataaggaaaaggtgacactcacgggccctaggaattaggatgtggccagccatctttggggatcattattcaacttaaccacattgactaatcagattattcaacatcattgagacagtctgcttcatagtgctataacgcagagtggtgactgtgaaccttgaggccatgagggtttgagatgctaatcaaacaaatcactttagaaaactagtattttttaaactctagtgttatttctgtaacacccatctatccttccactcctgtcttatctctacttgctcagaaagaaagatgaaatctgataaagcagaacagaagagcataatcctaaaactcagatagacctgagttcatgttccaactgcaacctgatggctagctgggttaccttgggaaaattacatgattgcattgggtgcattcctcaaaagcattccctgagacaaagatttgaggtaggactttatctgaaagatgatcccaggaaagatggatggaaagtgaggaaatgagtcagagaatggaaagaagctaataaacagtatattatcaagcaggttactcctgtgggccactgggtgacctgtgggaagtcacaggcagacagtgtagaacatcagaggtatcctagctgtggaaaagaagctttcatcattggctgaggactgatccctggcacattatcttccgcacttccaggctgctcctgaagcaggctgagaaagccctggggagactgcataggatggcctacctctagtgagaaacactgagtgccacactggttgtaaatggggtactagaaaggcctctctgaacttcaaggatgatagtactcagcttgcagggattttctgagaattagggattttctgagaatcacatgctaaagcacctactagtatgcatggcacataataatcgctcaacaagtggtagcttctaaataatgatcatatcaaaggtttgcctttggtttctgcttatgaaattagtttgcacatgagaagatcactcgacatttttgtgcccagtcgttttttaatctctaaaatcagggaggagagtaaactaaaccatcccaaagtgtattcttaggactaataatctaagtcgtcatggcttagtttctcatgtcctttggcactataatttcgctctggcttctatgctgatgattgtaaactgacctcagctgatttggtcatgtatgactcttaggatctttttggtaaatcatagtagcctctgatgaagttttgaggtaagagttgcctgctcaactggcaacttcactactaggttataatgaacagaaattccagacaaatactgtcacaataaaacatccatcaagtaaacatttattagcaagtaaacacacagttacacacacacaatttatatgacctgttttgtaaacttgagcatgtgtcagctgttatttttagctcctctgacccccatcttgcacaaaatattccctgaaggccatcacaaagattccacagtcaggaatttgtcactctttggctagcatcagggatctagaatccctcagtgttcctggctgggcataggactatttagagatttagtctaggtcatcatccctgagggtgaagtctacaggactaattggattcttgtgcccttgtgaagcaggtgtgggaagtgtttctaaaatatttctgccgatccacatgtaaggaatacttttaatttcactgagagtcttttcctaacattcactggcctacataacaaactaccaatttcatcaacagaaaatctgtttctgactttcagtatgttaattagcaaagcattgcttgtgggttgagatacaggtaacaaaaacttgtggtagctaattgaaaagaccaccccggcattgtgccttcttgattagcatgcagacagctctcgggttatagcttaacctaagtaatggtcacgtggtatcacacagcacatgctgaagtttggggatttttttagattatagtaaaatagacataaaattccactcagcccttgacaaccaacattctaccttctgcctctgaatttgacaactctggatacctcatctaagtggaataatacaatatttgtccttttgtgactggcttatttcacttagcataatgtcttcaaggtttatccaggttgtagcatgtgtcagaatttcatctctttttaaggctaaataatattccattgtatgtgtataccatgttttgtctggttttttattcagcagtggacatttgagtcgtttctaccttttggttattgtgaataatgttgctataaacattggtatacaaataaatgccaaaagcattttgacataaattacagatataacaatctgctccttttactaggaacctaaggaacatgcaaactattgcttaatccttagtattgttgcagtttagtaaaacacttgtagcttcttagtaccttagtatatctaaaagcattggtcacgtggatcttcaaaataagattttagaaggaaacagttttaaactctttatttgttatcataagcctgatttcatatttcattccccaaacagcttttaaaaatatcatttaccctatagtcatttaatttcctatacagtactttcattctgcaaaaatcagttacatttctacagctatttggtaattctgctttgtttctaggatgcagttgcataaaacattatattctgtgacctcaacctcttcatctgtgaatgctgaaatgtgccttcatcttcctttccattgggaggtcccgatactttacagaattttaataacttccctctgtaagaccatgaatgtggatagtatctgctctgaattctgatgatggccacgaatgaatcaagtggattacataccagcagagattggagggcttggattctgtgcaggatggattgtttgtttccttaatttatatgtgagaatgaatgtgtttgtaaaatcaggaaaacccaggaccaggcactgttcttacctacaggtatgctgtcagaaagcccctgcccagacttctggatatttccttaacatgcttggaaagaagtgtgtttcctgagtgatgagttcccgggttctgaccctatctttgcaagtgatagactgcaagttcttagaaaagttgaccttggactttgatcacacatctgttaacacatttttattgagcacctactatgtgtcaggcactctgccaggtgcttaggatacctcagtgaggaaacagtgctccctgctcttgcggcacggcgtctagagctgctccttgggagccactggccacatgtggctaataaaatatgtttaagtttaggaaaattaggtaaaatttaaaattaaattcttcagttgcactagccacatttcaagtactagacatccaaatggagatgtcaggtagagagtatgatgctaagaaagaggtgaaggctacagaaatcatttgagaatcaatagcaggagagccttgggccagatggatcgcaagtgagtgagcatagagaagagaagagccctggcagttccatcattaagagcttggggataaagagagagaatcagcaaagagccgagaaagagaggccagtataggaagaaaacgaaagagagtggaatactagaagccagtgaaaaagcgtattgggatagagggagtgattctcgtgtcacatgctgcaggaatataaagtaaaatgaggatagaaaacaaatcattggatttaatatattggtgaccttgacaagaacaattctattagaaggtgaagagcaaaagccaaacaggaaagaacagaagggaaggaatgggagctactgactctaatagcagaaatttgctacaaaggatctttttttcaaaaaggcttaataggtagtgcactaacatttatgggatccaggccaaaatggaggcctatatacaatatttgtaaataggtaaaagttatttatcaagctaacaaactattaaacaaatatgtgctttgcattatattgacaaatataacttcataagaatctggaaaagcagattccaatttagaattattggactttggagttctgttctataacttggtggcacagggaaagggcctgaggcccacatgccttggcttccaaaccccagcaccatcccatactctgaagggtgtgcttgtgaggggcctgcatgccctggcctgcatatcccagccctgtccacacttcttcaaacaacgatcccctgaatatctcttgagtccaggagtgtgtaaatcagcaagtccaccctaaggaagatggacccagagaagaggactatgaacaccctgtaaggggctaaggaccatgtgggcagagaattctgaggtgcagagtacccatgatctagatggcaggaagcatcagctctgactaagcacttctccttggcctagcaaatgctcacccagagagagatgtatggctggagaagggccagaatacagaccttaaggcacagagccaagggcagctctctgaggtggtggggaaatggggcaaagaaaaagatttttaagataagagaaataacatgtttgctcatgagaacaatccagtagagtgggaaatagatgatgtggaaaagaaaaggatagccaaagccattatctgagtaggcaaaagggaagaggctgtggtgtgcaagtgtagaaatgggctttggatataagcttgaacagttcctctacagcagcaaataagaaggcagagcatgtggatgctgatgcaggtgaggaagtggatgtggtggtgggacgatgtggaagttcccttctgattaatcagcacatgtttctggaagatttctgattaagaatgccttgccagtgctgtttcaggtcaaagttgattatttttgttaatttaatttctatgtaagtctcactaataatgcactgtttttaagtatataaagtactaatattccatgttgtatagctctttcactggcatagtttctccatgaggaaactgaggcacagagagacaatcatttgtcaagggacacataacaactctgctgccattttctcctgacttatgatataacaggcagctcctactggccttttgaatgtttttcttgatttaggagtctgggggttcccaaataagagattttatttttaaagacttgatgggattatgtcaattttaaaaatcaataaaagaactagaaagatgaataagaagaatataactcctttcttctcataaattttatttttaagtgtcaaaacacgcaatttcttttcagatactgaaacctgtgatattatgtgccctttgcctactgcaatcgctttctgaatagtcaagtgattcagcgattacctctgtgcacccaaatcctacctgattggaaggaagtcaccggggaggggatggtgagatgacgcactaaagtaaaactccttgtttgtaaaaggtgaataaaaaccacttttgtgttactcatagagactgaattgagatcaactttaaaacatattttgaagaatttccagcttcatagaattaaagtggttaattatagacaataacataagagaaagagaagcttgttgagtgaggattctccaccacattttctcaaggacttcaacctttggctcactcttcctccatacccatattctgccatgatccttagtgactccaacgtccaacacaaaatgtcaccaccgttcagctcatccctcagcatagcttgtaactcatcagcattcagagatgctctccttcaaatatcttgagcattaaatttaccttagttgatccacattgcctcatacttaccaactttcttgtacatcctgaacctacttctcttcttcctgacttccagacccttgacccttccccacccttcactggccctgctccatcccattcctgcttctagccataatccatttcaagggtgttcttaatagctacggtgcactttcattctccatgctctgctagtttcccacattggcaatgatctccactgttggtctatgccatacaactcagaattgcttcattcatctcaggcaaaccccctttcagattctctatagtgctgtgttctgaacccttaacatgctcttgagaccacagttctacctttcactgaaggtcttttctccactatgttgagacattggaggatgtctgtcaggggttctcattcttttcttcccctcacccttcacagctttacccagccctccatcttccttcctgacccagaaggttcccctcctttctaagggtgagccatcaaggtctaccagaaccttgctctgtgaacgatctcctctcttcaatgtctcttcctcagtgattccccctttggcctgcaaacatgctacacacaaatgatttttttttcagttatctagacttttcagactccttgaatgattattccccttctctttcttggtgaatcctatggaatatgtactcagcgcttttggctcctactgccttacccgctgttttatgacctccgcctccctttctggctttacctccattccccacatgactcgtcctcaggccaatgcacatccccagctccctaccttctatctccatttcttcctccttctttgccttccccccaaaaaattctttaagggttattctccatggagccttcttgaggcagcacttctacaaatccatgctatctttctacccaactcttatttttttctatttttactgagatacaattgacatatggtaaaatgcacccagcttgatgagtttggataattatgtaacctgggtgaccaccacccaaataaagacagaacatttccagcaccccagacattttcccagttctacttttcagtcaactgccaacttcaccaagagacaacactattctgatttctattaccagatattagtttttcctgtgcttgaacttcatataaatggactcacacacgggtatgtatcatatttagcactgcatactgtttctgagattcatccacgctgttgcatttatcaataattcattctttttgattgctgagtactattccattatataaatacaccacagtttgtttatccattttcctgttaaatgcatatttaactttttttcagtttttggcatttatgagtagagctactatgtacgtacttatacaagtgtgcaagttttattttctttcttggaaaaatatctaggagtgggattgccaggtcacaggttaaatatatgtttaactttctaagaagctgtcaaactattttccaaagtggtttttaccccttttcattcttcacatcccaccagcagtgtgcatggagtctggttgctccacatccatcccctacttctgtgtcctccttcttggctttttttggcatcactgcctatattcttagagcatcttatctcatctcccctccacttgagcttctgagggactgcagttgtgccttcatcatctctgcacccccacactctagccttccttaaagctctaaatttgtacagaataggataatatggaatccagcgaaggagccagggattcgggagttctgtacaaacaaccaagtggcccaaccaaatcaatatgatccgactcacccagcagtgtattacagtattgcagcttgaatgtggggctcctgcggccatttgtcacagtcttcaggaaaggctttttatcagattcatagtggcaagtgatacaaattattggatttcttttccaacataaaaaatagctatttgcagccttttgaagctgggtaaatgagccattgatcttacctgtggaacaccgcagggtatttttgtccatcctaactttcaatattctatgatgggagcccacccctccagccaagctggtctaatcattattccttgggtgtgcctgatctgtatcctcctccataccttttcccacaatgtagagaaaatttttagtggaaatgtcctcccttttcctcctcctagaagctgtcttcaaggcctggcacaaatgccagtacgtctatgaaggcttcccagctgcatcatcctgtagtaactcttctctcccatgaattattacaaccttcccaggatgagatgacggcctccctcatagcttcctggacttctaaatagaaagaggaatctgagaacagaagagagctccctaaatgacaagtgtaccccagatgtctgtggccatgtcccagagggccagctgcaatgcagggcctctcttttgatgtcccttgttcacaacgagccatttcacttctagtcaggactatctgcctcctaccatcatcttgaagcaataaattgcttcagactgtgtttcatcacttaccagtcagtcaagagcttgggttgcattcaagagcacatgttagagcattctgtctgctgagtgtgtgggaaggcacagagtaacatggccctgcctcatgtcgtcagtgcaggatgctcatttccaagggggacaagaaacattcagcttaaatttggtaaatatcttgaacaaaacaagaggagtctaaaaaccctccaggtttcttttctcttattctgtctcactctctgtcaaagcaaaccagcacctggtctgtttcttcatatgctctgggatatcttcctgaagaacagcctgaaaagcagagtcttctcttgccattgtccacactgatctccaggaaatccttcatctttaaccctggaaaatggcagctggagaaccaaggaataccaccctcccatgcttccttattttccctttccagctttggtactccactctgtcctcacctcccatttcctataaaatatgtttattcattaaaaagtatttaatgccttattttttattatttttattttttttttatttttttttttgctaagacactgtggtaagaattagaagtccaacaacagacaagatgaaaacagtgtctacttctggggcttatattttactaggagatatagacactcaacgagtcatctacaaaagagtatcctgactgccatcttagtaaaagtacaaggactgtgggcatatgagaggggcaaagaggccaagctcaggacatctgggaaggcctcagagaagaactgacccataagctgatgagagttacccagaagtcagctggaagccatgagggtggcatggcacagaggacatgggtgggggcacccagcaactgagagcatggcacaataaggaagcagtggcaggtatgagagggagtggtgaagacaaagctgaaaagggcagcaaggatattcccatcacaggcctttcttgtacgttctaagaaagagtagggacttatagcaaaggggagccatttataagctcacacaggggaatgagggcatcccttttgtgtttgcaaaggccgtgctgcagcagcactgacagcatggatcagagggcaacactggacaggcgggaagacagaggagacatgacaatggcttccatgaggggaggggcagtgctgatggcgtacatggaggcactagtgatgtcacggagaggaaggagtaaaggatggggctctggtttcaggcttgcgcctctgggataatcgtagcacacccacagaagttgggaagactagaagctgcagatctagggacagagggaagccatttcggggatagtttgctgtgtatctgggcctcaggagaggcctggaccattggggtcacaaatcatcaaaactttgctagtcatgctgccctgggagtgggttagacagcccaggagaagaggagggatgctaaggagcaggcaggtaaagagaagcccatggagaagactgcggggccatcagcgagtgggggcaaccaggagagaggctaccatgacagggcttggggaagagttttgcaaggaaggcagatgatcaagcaggtccagtgtcccagaaagacctttttttgtttttgagacaagtcctgtgctgtcgcccaggctggaacctcaagaggcttggctctgaagggaggagacagagagagcagcagcaggagaagggtgtggggtaaaagaatgggttggtttaagacaggaggaacataaacaggactttaatgtgttttagaatgaagaggatgagtgaatgaatgtttggtgagaagcaattacaggatataaagcaaataattagaatataggcacagtgtttactgacttaaacacttaacaacaaaattatatgatagtggactgaatcctcagtttgcaaaacagagaattcagttccatgtggtggaggcagcatagtgagcaggttctggagcaaacctctgtggtgcattcccagttgagggtggctaagggcaagtgacctaatctctctaccagaaatggagataatcacacccatctctcaggcaacaacaactgagctcagttagagcgcaacaaatgtcagctctaatcagctactgaaacctaacattaagggaataaaacgtatctggtggatactcacccagtctgctaaaggtacagaaaaatgtgttcatgtgctgttgatttctaaactgctgaaactcagaccagtcctcaagagctgggcctgttccaactgtggaaacacttagggtttgtattgtttggctacaacgtgggcagcagagtgtccatcacgaaggccatgtgtgcacagccaagaaaactcttttaggttcctacctgtctctttccagagccatccctctggatttcagatgagatttccctattaaggagggatgccaaatgctggggatttcataatactcccaaccccaggcaccagatttgtgtaattgcagtggtggagatttaattgtcctttgaagaggccccatactgtttgtctgtcaaattgtctgcatgttggtgcagttgaaattataggagaagaggaaaccaggggtatgtttcaaagtagttggcacgtggttggtgatccatagtgcaggtttcctttctggaaggtaacaggactgtgttctcataaggcagcatggcagggtggaagccatatgggatttgccctcgaatttcagcgctgccgttgagcagctgtatgaacttgagctatttgcatatcttcttgaacttttttgctcctctgtgaatgaagccattgcaccagcatgttttcaggattaagtgagacaatatgtggaagtgcctggcacacagtaggtgttcagtatttttttattttccattctctgtgtccttgttttgactaccaggtaactatgtttaccctcagagatctgatgtatttcttcatatcaagtatatatcaagaatttcatccctcatcctaatgcattaaactcactgcatggaagttataccattacctagactcaccacggtcttgtcagacaccagcagagttttgtgtggctgcaatagagatgttattgccagttgtcagtattgaaatgaggcactccttcatccttcagtgaaatctgtgcaggcattttcctttctctggttaaacattttatagtctcctttaaaaacaatgccctcatttcatttcctctctctggctggactcttctcctccctcctgctttcctaaaatccatcttgtttccctgtattgtttgctgaatgggcagtttaatgaatacagcatttccattttgaaatgtacagagcacaaggcagaaactgaatttcctcctggacagtttccatccacagtcctcatttccagttttctcccttcttttcttttctacaacacaactgaaatttgctgaaccagaaaggggaggaaggaggtgtgacaggagaggcaatatgccttctcattgtttcagcaaaagcttattagcatcctgctccctagaagagaccaagtgccctaaagatgccctgggtgcctcttctattgcacaaagctcaaggtccagagtatacagtgcatgacagaatctaattaccaagataattactgttacctgcactacctaactgttgtgttttgtaatcaaaagctatattggcaggggtgagtgtgagcctgctgaaaactcagggaaactgttgaaggtttatcaacccgaagcaattttactctagttagtgggcctgtgttgctcagttagcagaatgtttggggatcagaagaataccccagagcacttcagccattgcatagacattagttaccgggtaggaatatcctcagctgactcaggtattcatgttgttgaaaccagacttcatggcaatttgaaaacgtctgtgccatttttaaatttgttctcgaaatagttgatcagtacctgacttagccttcatttggcattcggtgaaggagaaattgatttcctttgggcatggctgtatgtacctgatgggtacagcgtgtgctaagctggatgtaggtatgtattcatactatcaccacctgcttcatattcattatggcacaaggttacaaattggctttctgtttcccatctcagccagctctagttaatttatgtctttacctctgtgcttcacacactaaagaaatggagtttctactttaaaaatcaggtgtattgaaaaaatggttataattgtttttttaaatttttaaagaaattccaagtggaaaacaaggaataagttgcaaaagagtatgaaaagtttggtaataaaggcaaggacacttaaaaggagggagtaaaataacaaagcaaaatgggtgaggctgacaggctataaattgaaaagggagaaggggtcaaggaaaatgcagacaggaagaaaagagacagaaaaagaaatgatagggccttgagtaatggactcagaaaaggaaataggaaaagttaagaccaaagtaagaattatggagacaaaagtcaaagacatccaggtctcaagaattacaggttattggtggcctgggaggtagtgaagaggggctaggcatatccctcatgaagttagatgtctgaattcctcaggacagtgtgacagtcagggagaatgtcccctgaatatgctaattcagactctaaaataagagccagccagattcattaccatggttggccagcctgtaatggcaacagaattcactgatgcatattaaactgaatttttctaaccaaggtcttaaataaacagacaccagctataactgaaaattagaataaggccttcagtggtgactatttctgtagggaaagtctgaaaacccttaacatggtttttttccaaatttttagaaatttgtggttcttaaggctgcttagtatgttagcaattgctccagtgcaggactgtgtggatccctctggtattttcttttaactttctgcaaggcagagagtgtggctgacctgtgatataaatgaaaccccgtggcaggaacattaactccatctacaacaaaggaacatgtagagatttggattctaatgaaaataatagaagctccttctcccaaagttgggaaatacagaggaggtcttctcagccagtccaaatttgcaaaaccagaatcatcacagaaaggtagataataggaggcctaagagaaagctcagttgtcctttggcctatggcctttgggcttgctgtagatcctctgttggcaactggatgctctgttgggtccaggaattgatgataaccagtagtttgtgggtagatttccatgttgagcactgccttcagctaagtgctttcagttgcctcttgttatggttggagctgaatgacctttgtttacgtgtgtttcaggctaactgatgaattacaagattttcaccaatgagtgggaaatgtagcgataattattcagactgatttatatttgtctttgggctggtttttcatgtatatttttagacattttaatatatttggatctgattttttataaaatcatgaggttctctttatgctcaagtgctgccaagaagttggacagccctcctgttcttctcccagttccccagtccctattccagatgaggggatgcagagttagttgtcaattcattcaacaaacatttattcagcagttagagtgactatctcatctcagtttccctgagacttttctggtttgagcactgaaaagttctatattctaggaaactcctcaacctcaggccagccaagacagttggttaccttatcatctaccatgttccaatagagctaggagagaccctagaaatcatgacaatttctttattattattaattactttttaatattcttcttttttttgagacaggatcttgccctgtacccaggcttgagtacagtggtgcaaccacatctcattacagtctccacctcccaggctcaagcaatccccctgcctcagcctcccaagtagcttggactacaggcatgtgccatcacacctggctaattttttatttttatttttttgtagagacgaggtctcatcatgttgcccaggctggtctcaaacttccagtctcaagcaattatcctgtcttgatgatttaaattcaaagaaacctagcttcccaaagtgccaggattacaggcacgagccacagtgcccagcccattctgatttctacacacccattttaaagtgccagttaaagccaaggagacctctttatcaatttgttttccttctgattcacacattccctggattggaagagataattaagttctatggttgaagatgttatcttcaggctgcattaaagaataaaattaaataaaaggtcatgcagtgtgccaataagagttttacaagccagttggaatttgaaaattagagagtcaaaaagataaagtgaatcaaaaatcatttatttagtattgaggtaccttttggtacatcaaagagatcatttataaaatagtataatgtaaggaagttgaaagaatgaactacagtggaatactattattatatctacttatgcctttttttctggaaaatgttcacaatgatgtgaaaggatctaagaccagcctggcagccaccagatggtgattctagtcctggctcagtcagtaataggtcactgaccccagagaaatcaattcagcctccccaggtccttggatttctttctgtgaaaatgaaagcataggtaggaatttcccatggaacagctagcagaggagaaatattaaaagtcaggagactcatgctatagttttcatacttcattacaacaatgttgtttaggacaagtgagttaacctgttagcttcctctatataaaatggaaagtcattaaaaacctacatagcagggttcttgtgaagatcaagtgataatgtaggaagcatgtacaaatgtcacattctgccgtcacgtaatggtcctcacagcttgaggtagcatttagcatgtgtcatgatttagtacaagggttggcaaactgttgctcttggattaagtctggctcattgcctgtttttcaaagaaaaaaattgtatatgtgtgtatatatgttatatataggtacacacacatatgtgctatatatagcatatatacacacataatatataaacatgtacatatatagcattatatatatacgtgtataatatctccagtcctcatgaccagccatgcttgttcatttacatttgcatactctatgattgctttcatgcaacaatggcagagttgagtgattgttttgcaacagagactgtatggcccactaaacctaaaatatttagtctctgaccctgaaatgtaagattgatagcccaggaccaggcgtggtggctcacacttgtaatcctagcactttggcaggccaaggagggtggatcacctgaggtcaggagttaaagaccagcctggccaacatggtgaaaccctgactctactaaaaatacagaaattagctgggcgtggtaatgggtgcctgcaatccaagctactctggaggctgaggcaggagaatcacttgaacccaggaggcagaagttacagtgagctgagatggtgccactgcactccagcctggacgacagagtgagactccatctcaaaaaaaaaaaaaaaaaaaaaagatagtccaagatccaggattcttttaggttctgtgtcactatgtgatctcaggttaatgatttattgtttctgattctgtttcttacactgtaaaaaaaaaaaaaatggtgggggggaatacaaatccagccccttctttcctcacagaaatgttgttaagatagataagaaaacaaaatcattgatctcttctggaggaaagatgatttaaattcaaagtattactcataaggtggatgctgttagatgactcagaaatgatgactgatgtgttattattattctctgaaattagttccctcatgtacctcagtgggggattacttagaacagcgatagcatacagacccctgcatcgtgacactacatcaaaagctaagatactgcaccagaatctaatttaatcacagtacccagtcaggagtgagttttaattgtttctttatccctttatcctctgaagactgtcattaacatttacaagacatgaacttcagatcatgccaacatctctgctgaggtcacctggcagctagccattttagtccatgatcaagacagaggggccttctgggcacatgaggagggacaagacagaacagtagtggtggtagcacataagctggtttacagagcaaataccaaagataggcttgtttctgttaaaacttgaatttatattttattcttggacacatgactgatatccaggctgactaagaacatacacaagtaaataacaaaactttgtctaacacgtataaatattaggacctcctttttccccaagaatcccctcaaacctctagggaggatctccctaaaggagcagctcttcatgtggctgaaagcagccacataaggaggctaaggctggcctctgaaagttacctcggcccaggtgcagcccatttatagaccctctatacccaactccagatttatggcatagataaattagtgggcaatcatttgctctataaaatgattcttcattttacaagcttattcactgccgcattcctttactgatctattcctttactgatctattcctttactgatccctctatacacaactccagatttatggcacagataaattagtgggcaatcatttgctctataaaatgattcttcattttacaagtttattcactgccacattcctttactgatctattgccactagtgcagttccaataaaatctcattgttagaaatccagtacacaaatgctttttcactgctaacctggatggaaagatgaagaatacaatgcacttataatccccttagatcttatgatgtggctttggtcaaagtcttctgttctcagtttaggagcttaatgttccttggtacttacaattgacagggagagacaggacaaaagattctttaaaataacaatgaaacaatatgtgatttcattaactaacttgctctaattatctgcatgagatttttaataaaaggatcagtcatacagaaataagctaactggccttttgatgatgagtaataatgatactgacaatagctaccatattgagcattaccatgtgccccatagcattctaactcattaactcattgaagctaaaacctaaaaggtaagtataattattttcatttctgtattacagatgaagaaattaaggcacagagaagtaaaatatcctacctcatgtcacaagctgctatatttggagtcaatattcaaactcagtggcactgactttataattttgctactaaatagttacagtgctgtattgacaagtaaagcaactgtcaggtgctgaaatgtaggagcaagagcaatacataacatgtgttctaccttcaagaaactaataagaatttctgcctcaggccattagagaaaaactggtttgggacttgtcctttgccataaaatgaaagaaaaaaggaaaactggacaaaatatatcaaacaactaatttcataccttggacaacaggaaggttgttgttggacaacaggaagccaaagtggaaagaacttgttgggtatatagtaaattgaacagagaccctagaagggccttggtgtaatagtaaggctaaactagccctagaatcaagattattttagactcactctggtaaaacttaaaaacaagacttgaaaggatcaagtacatctagagctgccaaaacaatagccaacactttttaaaggaaaaaaagacaatctagacagacactcaacatgtaaaatttattatatctatcattcaatcaaaaattactagacatgtaaagaagcaagaaaatatgacccacaactagaacacccactgaagagaagcagacctagaaatgatagtgatgatgaaatttgtagacaggcactataagcaactattatacatatattcaaggatttaagagaaatcagaaacataatgaaaagagaaatggaaactatagaaaaggaatcaaatgtaattctataactgaaaaatacaatatatgaaataaaaaaattcaccttatgggctcaacagtagattagatactgccaaataaaagatacatgaactcgaaaagatagtgatagaagcaattcaaactgaagataaaatgaggctgaagataaaaaggctcttgtaaaaataagaacagagtctcatttttaaataaaaataaacagagtctccatgacctgtgggacaacatcaagcagactaacatatatgtaaatggagtcccagaaaatgtcagggtaatggcaaaaaaacctgaggaattaatgactacaatttttccaaatgtaataacaactataaactgacatatccaagaaactcaataaaacccaagcatgataagcgacaagaaaatcattacaatcaactagtcagaaagcagcaatacaaaaaaaacttaaaagcctccagagagttgaaacacattatataaaaaagaaaaagatgagaataatcactgatgttttttgagaaaatgcaatgtcttgtagaagacaatgggtgacatctttaaagtgcgtgaacaaaaatctgcccacctagaattctataatcagcaaaaatattcctcaaaaataagaatgaaattaagaattttttagacaaacaaaatttgatgagcaattttttcaccactctaagaaatgtcgaagggaatttatcaagtcaaaataaaataatgggaactcagatttgcacaaaagagaaaagtttctaaattaataaatatgtaagctgggtgtggtggcttatgcctgtaatcccagcactttgggaggccaaggcacgcggatcattgaggtccggagtttgagaacaggctgaccaacaagctgaaatcgcatctctactaaagatacataaattagccggacatggtggcgtgcacctgtaatcccagcttctcagcagcctgaggcaggagaatcgcttgaacccaggaggcagaggtttcagtgagccaatatcacaccactgtactccagcctgggcaacagagtgaaactctgtctcaataaaataaaataaaataaaataaaataaaataaaataaaataaataaaataaaataaaataaaataaaataaaataaaataaaataaaataaaattaaaataaaataaaataaaatataaaataaaataaaataaaataaataaaataaaataaaataaataaaataaaataaaataaaaaaaataaaataaaataaataaaataaaataaaataaataaaataaaataaaataaaataaataaaataaaataaaataaaataaataaaataaaataaaataaaataaaatataaaataaaataaaataaaataaaataaaaaataaaataaaataaaataaaataaaataaataaaataaaataaaaataaaataaaataaaatagtgagtaaatataaaaggcattttggtttttaaaatagcttgaaaagtaaatggactgttcaaataaaaaataataaagatataataatgatataataggaaaaaatatatgataatagcataaaagaaaagagaataagtggaagtatactattgtagaattcttaaatatatgaagtacatatctaatgaagactgtgatagttaaaatgcatattgtaaatgctagagcaaccatttttaaaaaatggtatagccaataagccatagaaaagatgagatggaatttgaaaagaaaaacctcatatgaaatgaaaggaagaaaggaacagtgaaagaataaagaataaggtacaaaaaaatcaagatgatataatacaaactcaatatatcagtaattacattaggcataaatagactaaccatgccccattaaaagacagaaatcgtcaaactgaataaaaaaagcaagattcagttatatgctatttacaaaaaaaatattttaaatataaaaatagctaggttagatataaatggatagaaaaagatatacagcaaattctgtatacgtgaaggctgtcataattgtactatctgaaaaagttggcttcaaaatagagaacattattagagaggaggagggacattttataatggtaaaataatctattcatcaataagacacagtgatcttaaaagtaaattcactcgccgaggtgggcagatcacaacaaggtcaggagtttgagaccagcctggccaacatggtgaaaccccatctctactaaagaaaaacaaaaattagatggacttggtggtggacacctgtaatcccagctgctctggaggctgaggcaggagaatcgtttgagctggggaggtggaggttgcagtgagccgagattgcaccattgcactccagcctgggcgacagagcaagactccgtctcaaaaaaaaaaaaaaaaaaaaaaaaaagtaaattcattcaattacaagctttgaaaactacatgaagaaaaaactgacagaattgaaagaatacacacatctatagttgtggctggaaatttcaacacttctcagcagttgttagaacaagtagctggaaagtctggatatggaagattcaaacaatactatcaatcaacttgatcaaattgatattacagaacactgcattcaacaacagcagggtgtacattctttttaagtgcacatggggtattcaccatgatagactatatgctgggttataaaagcttctcaacaaatttaaaaggattaaaattatatgaggtctgtttgttgaccaccatggaattgggtaagaagtcaaaagcattaagatatcaagaaaattcccaaatacttggaaattaaatatcacacttctaaataagccatagatcaaagaagaaatcaccaggaaattagaatttatttgaaccttattgataataaaaacacaatatatcccagtgtatgggatgaagctaaagcagtgcttagatggaaatgtgtaggttaaatgcttatgttagaaaagaagaaagttctaaaatcagtgatctagcttccacattaagaagctaacaacaacaacaaaaatactaaccttaagtacgtagaaaaaagtagaaatcaatgaaatagaaaataataaataatagagaaaatcaatgaattttaaaacggactttttgaaacaaagctataaaactgataaactatcaagctggtcaagaaaaaagagaagatgcaaactggcaatctcaggtgtgaaacaggacacatgactacacatacgtcattaaaagggcactaaaggactctaatgaacaaacatatacaaaaaattcaacaacgcagatgacatgcataaattccttaaaagacaaattgctaatactgattcaagaagaaataaaaaacctaaatactcctataaattaaatgaattgaattcataagtaaaagcctttactcaaagaaaaccccaggcccaggtagttccctaattaattctgtgaaccatttaaaggataaataataacatgactatgcaaactttaagaaaacagagaaagaggtaaatacttcccaactcattttataaggcgtgtatgacactgatatcaaaaccaaagatatggtaagaaaactatagaccaatatccttcataaatatagacacaaaaattcttaacaaaatataagcaaattaaattcagccatatgtaaactggataatatactatgttcaagtggcatttatcttagaaatttaaggttggtttaatatttttaaatcgatcaatataatttaccacattaacataataaaggaaagagtatgatcatttcaggaggtgcataaaaagcattgcacaaaattcaacacccattcataataatgacttttggaaaattaggaatagtgacagcttcctcgacctgttaaaaggcagtgatgtcaaatcttcagtttaattatgaaagagtgaatgctttcctactacgatggggaataagacaaagattcccgttctcaccacttctatttaaacatcatattgcaagtaccaactagtataattagacaagataaagaaatcaaagattacagattgcaaaggaagtagtaaaattattattatgaataaacaacagaattgtgtactgtcaacctaaataactaaaagagaggggctctgtgaaagaaagatgtttatctgggaatagagctttgcaatggaaatacctaggctgtagttaactatgtgtgtattcagggaggtaaaggaagacaaagctttttcaaggaaaaaatgaggaagattacataattgttttaaaataattatccttgactacaaagatcaataagaagggtgcgatgggtacgctaaaagcccagacctcacaactgcacaatatatacacgtcttctgcacttgtacccactaaccctataatttaaaaaaataataataaaaaatagcaagagtgacaccttctgaggttggacaggtagctgctgggcagatgtacttacagaagtaagttttatgcaaagtcttgatggtctctgtgcaaagttgtggttttagcggtcttttttgttatcaggcatgcaagcatgagaaccctctcttcgtgaccttccctagctgtatttgtttgggttttcataacatttatgccttcatttttattctgataactttcacagtacatagaaaatcctaagaaaactacaaacatatgctgctagaagcaagaagtaaacttagcaaggtcacaatatacaaaattaaagtttatgtctgtatactaaaaactagcaaataatattttaaaaaataacatcaaagaacatgaaatactcaagaataattttaataaaatacatgtaaaatttaggagatttttaagcagacttaaataaatgaaagaaaaattttgaaaaggagaaaaaaaatttgaggacttactctgatttcaaaaactttcatctacaataatcaaagtcatgtggtattggcatattggcataagaatagacagatcagtggaatagaataggtctatgcgtatatggtcacttaattttttacaaaagtacaaggttattcaacgggaaaaggatagtctttacaacaaatagtgttaaaacagatatccttaaggggaaaaaaatgaaccttagcccttatctcataccctgcacaaaaattaactcaaaatggatcataaacctaaatgtaaaatcttaaactatgataattatagaagaaaatataggagaaaaatcttttgacctcaggttaggtaaagatttcttagattactaaaggaactaaccatttaaagaaattgataagttggacatcatcgtaagtaaaatttccactctttggaagatatcattaagaaaatgaaaggcaagccacagaggagaaaatacaatacatacgtctgacaaaggacttgtaactctcacaactcaattaaaaggagactaacaagaaaaaatgagcaaaatattttaacaaacatttcacaaacaagatacaccaatccccagtaagtacatgaaaaggtgcttgagatcattagtcatcattgaaatacaaattaaggctaggtgtggtggctcccaacactttgggaggccaaggccagcagatcacttgaggtcaggagtttgagaccagcctggccaacatggtgaaacccccatctctacaaaaaatacaaaaattagccaggcgtggtggcacgcacctgtagtcccagctactcaggaggctgaggcacgggaattacttgaacctgggaagtgaaggctgcagtaagccgagatttcgccactgcactccagcgtgggtgacagagcaagactccatcccaaaaaaaatgaaaaaaagaaaaagaaatacaaattaaaaccaagacaagacattgctaacattcactaaaatgtccaaaacaaacaaactatgcaataatgtggatgaattcccaaatcattatgctgagcaaaagaagccagacacaagagatcacactgtatgattcctttcaggcaaaagtataggaaaggcaagcctaatcaatagtgacaggaatcaaaccaatggttgcccgagacgggggtgggaaggaatggactgaaaaggaccatgagtgaatttttaggagtgatggaaatgttctgtgtcttattgctgtagtagtcacacaggtgtgttcattcgccaaaacttgtcaaatatacacttagaatgagtattttctattctattcaaattttgcataaaaagaagcagctattttgttgttcatgatagaagcaatattagcacttactgttctctagctctttcccaaggttttgcagcactatgaattcctttagtcactcagagaattaggaaattagcatgggttgttttgatctgattgggcatcacaataggaactgacctttctgtcttctgagctctaactttggatctcatgttttgctcctggtgtgtaagtcctagctctcctatttgggcctccttaagggtgggtgcttggtgcaactgtcatagtcctttgcttaaaactttctccttggccaggcacagtggctcaagcctgtaatcccagcactttgggaggccaaggcaggtggatcacctgaggttaggagttcaagaccagcctggccaactcggtgaaacctcgtttctactaaaaatacaaaaattagccaggtgtggtagcaggcacctgtaatcccagctactcaggaggctgaggcaggagaatcgcttgaacctgggaggtggaggttgcagtgagccgagatggtgccgttgcactccagcctgggcaacagagcgaaactctgtctcaaaaaaacaaacaaacaaacagaaaaaactttctcctcagcttattttacgaacatagttgtaagttgaatgaatgcacgcctggagagcaattgggatgcactactgtggaaagtagaggtattcagaaaaggctcaacagccatatattagggatattatgaagtgatttaaacattagatgatggttggactagagaagttctttcccagtcctgattatgtgaaaagaaagcttccaagggcaggagacatttctccacagggggaagtgagtctaaatattaggagggtcagtagccattctgacaacctacccaccatagacagagtgggattcacccctaaaccagcagagtggttagatgtctgtcaccaggcatgtgggtctgaatcagaagaaagagaaggatatcattttggaaatttacaagtgagacatgaaatctaatagaagggatttcaaaaagcacagattcatatgagaagttccctggaaagaaaagatgggtgctgatgtgggcaggggccatctgaggatggcagcttcacagaattgccctctcactccactctggggccaggactccccactcctgtagtcttctccctaagatgagtaaatatgaattcagcaccaagtaaaacggcctacacatcctctcaccagactcttttgcttataatcatcattattaccttaaagccaaagtttactcatctgtaaaatgaggataataataattatagaatcattgtgaggctttgataagataatgcctgtaagtgtttagtacaggctcatagaaagtacttagtaaatcctggctatgattgtggttatgattttgttacttgtttcatcattaaaccatgtatcatttactccggaaacaaaaagtaggaatgctatttcccaatctctgtaccacgctcacagcgaaacagcctgtgccatccactaacatacccataaacaatctccactgcattacaatcaggaacttagggaaaatgaggcttttttcttgttaagctttatctgcagaatctcaagtagtttttagctgtgctcttttatattccagtcaacctcatttccacagatgtactcccctagattgaaagttccgtgagagcaggcatctggtaaattatgcccaccactctttccccagggcctagcaaggtacttggcacttagtgggagctcagtagatataagatgaatgaatatggtgccctttccaaaatccttctacgcaagtcctgctgcactagtcgctgccctgctatggatgcaaaaatgagtgaaaggttgatacattgtaaacgtaactgtgatcattctgagtagtcatttaacctctttacagcagctggatgattatttctcagctatacgaaattattaaataagaaataattcatgcttcatgttccatgtcctccatcatgaggcctttttaccagtttaattagttagtaaaggacagcacgctttcctctccaccttttatcaagaattctaaaggctttagagaaaaaatgactcaggaggtgaaacagcaggactcctggtgttatttataaactcgtccctggcatctgcagcagcaaatctcaagcatcgtttaccttgccccgtaattctggagtttgagtataaatgatgaaacagctaatggcatgttacccgacaaagtagcattagcttcctctatcatcgtcagctgttttttttttttttttttttttccacaaaaatgtgtaaattgcagtttatctcaccagagaagcatttgatcaaatgtactttaattatattttgtgtggctactgagaataatcactgtttcttcatcataaggattgtcctaaaaaattatattaacgtgggtcaaccataaacagcagtgggaatttagctacctttaaatgctaaatttacctctcagcttgtagatttcctacaaatgaatttctttgggtcaagattttttcatgagcattggcaattagtggatattccttgaaccaaccttttactttaagtgaaatgtatttgcattaagagcatattcatttcccaggctgcttcttaacacatttgtttccctttgttttggaattcacaaagcttttcatggtttgcctattcattccctcactgcataatgatttatagtaggttatattttagaaggttttgtgtcaaaaaaaaaaatttgcatctcttcatcaggtagtcagttaaagaggctgcgttgagctgccaaatgggacgctgccaggtgaccaagaaagaaaagcctacttgcataaataaaacgaaagcatattagaacatttagctaacattcacccaatttttcatagttggcaacttctaactttgtttcatcttcaaggattatggtttgaagcaagggtaattcgccttgtgtcttccttttagttcttccctcagaacctggtttgggaaaaacctcactaatattttgtagcatcagccaagtagttgtcatcttttttgtaaccaactgccttatacaaaagcatagacacacttattttggataaatccatactgtctgacacataagcaaatatggaaaatataaaggaatccaaaggctctcacacagatcaattttcttcattggccagagctgcctctaaagaaattcacatgacaccgtcttcatttttctgaacatgatacatattattcattagcatttaagcttatatctaatgcacatttttagataggattttttagtagtaagacttttttatatgtctacctattattatccatggtagagtttcttgtgaccttgaccctgtgatatctggaaatgaaaaaagcccattttgtttcagactcttggtccctctagctataattctacttctgacagtggcccccagaggcattttgtggagggctgctgccactttgacatcacccctaaaattgttgggcacaccctctctaaaataattttatttctcattatagcttaatcactatgaatttctactagagtcatttaaaagaacaattttagcctgccctacttgttgggaagaataggggaaattaacagcatcttgtaactggaaggacccttataggttcctaagactgattccaattccaaacaataataccagtccgtaagtggatctgcttatagagaaacacctgttgcttctgttttttgtctcatatccagttagtttcccattcacagcaaaacattcccttcaatgccaaggaaactcaacctttttgattattagtatagtttcatcaaagtttctttgaaaggtaaaatatcccctttttcttgcctataatttttaaacctttttaaaggttgtaaagaattagttagtcaaggcttcttctcataaagccagggtttcttttttcctagactctatgtgcttaagtgctctatgataaaatgtggatgttataaactcatcagcttggccatgtggaagtgaaaaccactggtcagaggtgtgtggattctcccttgtgacctatctcatattactgtgaaccagctggcccccaataccataagcattaacaatggctgacaaaattgggactccagctccattgtgtcacctgggcatctgtgcagcactcctgccaaacagtcctgctaaactattccgatttcagatgggaatttggtcagaaacagcattttcttgtaatacttcccacttttctaattcccttgtttctggttgccaaaagaatgggaggtagacaggaagaggtggggaaaaatgtttaagttcaaatgtcatctctgctaaaacctgacttccactgcactgtggctttgtaacctccttgtgtttgtagccagctatcaaaaatctgtccatttgaacatgattatactaaagcatgattattttaaagctttcattataaactctacactggaaataatctttagggtgttttcaggtttgaaaacccatatgcactgaatgttctcatggtgtgctctgtcagaaacaatttttaatgatgtttcctcagtgagcatcattccctagatgtggacagagctgcagaaaggcatttacaaggagtcatgctggctcagatgggtgaagagggaactttattgacgtcagaccatgaaaagagagtgggcaataaattctgtatagacaaaggtgaacacaataaactgagactgacatataaacacgagtacaattcaaaatacagtggtaaggaggtgtggatgtttctttatagctgtatatgtttttgacacacccgcacacacagaaaattataaagtcaaagataatgaacctagagtcatgtggaaggtgtgaggtgggtcaagggagaaatagaggttattaaggagtataggtaggtattgaagaagagcctcattttatacacatacagacacatgcacacatatatacctatatatactctctctccatatatacatatatttatatttatgcacatgtaaatacatatatgtaatttatatttattttcccccaatactcctcatacctagagaccatgaactacatacagagggaaggcacactttctacctgaaggccagcccttatattggtgatcagtttgttcagtgctcttaatcattagagtaattgtgtataaaatcatgaatggggactttgtgagtcacttaacatttgcaagaagcatatgaacgtgattgttcttttagagtttgttaggtgggtggtggtaaagtaatacaattttctaaatggtaaaatcatgaatctcatgcatgtcaaaaaatttattcaattcattaattaatgagaatatcagtaagatgttacaccattttaaagagcatttgagaaaccaagtctgtgcaacttaataaatatatattaggataaaattgctgggttagataaaaactggttaatgtcttagaagccaataaactgtaacatttgagatatctgttctatgggacaaaattcattttcatctcttttagacatctttaagttgacatgtaacttcactaaatctgggacctttaatcaacagtaagcagtgagtcaaaataagtacattctaataaataatctttgggtggacttggcccctgaatgacattgaaagaatgtactgcctacctttttgctttatttttaagtcatgaataatttttataagagtggtgaaaggtataagaacatactgagttctacataatagtgtttggatctcaacttgtatactgctatatgttcacatggttttggtaaggagaactgacttgtcattctccaaggcagaagctgagagtagaactcccagaaagtgggatttacttaccataagttgctgtagaaaaggaggatggagtcaatctttatttctgcttttgtcccactacatgttaagaattttttcatttacccattcagtgattcaacaaatatctgttaagcatccactaagtgccaggcattgaggattggggtgaaaaagcccctgctcttaaggagcttacattctagcagaaaagacagacaacaataataaaaccatgataatattgtttcaactggtagatagtgctatgaaaaagaaaaagaagcagcagcatgaaggtaagggagataatgagtgaccacatggaggggtggactttagactgaacgatcagggagtcccaggaggactggcaggcctgcagagtgtggcccggccacagcgatgggcttggtgtcaggtagggctgccattcatcttctgcccactgtatgaatgtaattcaagtctttactctatttcatggtccaggatacctccgacccaagtttccatctctttgtcataaagtagaataggggtgggagatcagagctgcaaatgaagcaagtcatgcaaatggtttcccactggagaaaaggcacattttttcccgagatagggcagtgaagaaggtacagagcatggatttcagatcagagacacctgggtttgaattctatttctaccacttactactgtatgacatcagacaagttactaaaatctattttccatctgttaaagacacatgaagatctctccctcatagggccaattcaatgaaatcatctccagaaagccctcagtacacagaaagcactcaacaagcagtgactattattcttgtaattcccctatttggggagtctgtagcatcatcttcatgtagtactgattaactagtcttagttattgctgccacacagttttaccaccttacagagatgactcattatcacacagttcagatactgtgggacctgcaagtccaccagaggtgttggtgttgacctaaactatttggtcaaaattatgcccatagccaagccaaggtttccaaagagatagaaggtacatgggcttagtggcgcacctaaaactttttagcccaagtttggagattcttgggtagcttgagagttagaaactaaaagtagaatacttttaatggatttgtgattgaggattttttttgtttttactttctggtcctgtcctgtcctttgttttcctttcattttttccccctcttatgagttgagttgctttctcttctagggagctatgtgttaggaagctgctaatgaactgcttttgagtctaattttcaataagatttaatacagtagggattaaactgcccccttgaaaagagagattaagtgtctgcaaatcccatgaattgattttctaattgttttggtaataatgtgtatgtgtttttcatttgctaatgttgctgaaaataataataattttaattaaattttaaatgtatttttagtattttaaggattctagagggactaagttttcttgcaaggaatatgttaagaccataacattcttccctcaccccataattattatgatcagggaatatctataatatattccatggcaattaaattgcataccccagactgttcaagatgtgtttataaaaggagaaatggatttcccacagctgctcgcctgtgaatgcatccttcacacagaaccacagtagccagtatatgcactaaaataacagacttgaatttaaactttcagtgctttcaaacgtctttcaaaaacttctcataacacaaattgcttaatttgtgtacatgaaaactcactgattacatatgaatgagagtcaacctataataatggtgactttgagaatctttgtgtatgtgcccacccatctcttcaggaattagcaggtattcagtcttgttccaacattctgcacaagccacagtcattagtgagagcaccctgtgaaggctgaaatctgctgtgaacagtatggggcagctcaggtattttttataatattcatcagatggtcttcacccagtcacgtagctggaaaatgttttctgtgagatgagtgtttacaaaaaaaaaagattcatagagaaggagcaagggaaggaggaagagggaaaataatccaaaccagggtcaaggcagtcatatagactagaatcacagaccaggtgttccgtctttaaaaagcgatcgtcacaactttgatttattaaattggaatttaaatcttccaagctgtaatgaattgatcatgatactgttgatatagattggctcatctttgtggctgtataacaactataataaagaattaattgagtacctattaatcctcacaagcatcttggaagttggatatcattagccctgtttgctgattgaggaaactaaagttgaatggctttacatcattctttcaaagtcacccaggttttaagcagaagaatttgaatttgaacccagccctacctgcctctaaaccccatattctctcagctgtatctccctcctaggtgcaatggctccttggctgacatgctgaaggatatgtcttcacattcttaaactccaaacctcccttggaaataatttcctaacagtgaaactgccctaataatgccgtagtttgtttccaggggagaatatttgccttcagagcaggctccttctgccagctttccatttcataaatgcattttatgactccctcttcagagctcatatacctgtcagaagatcctatgcaatttatccctggggatagttaacattccccctgacccacccaccctgcaatgtcaggtgctctcagaaatggaagtgcaggatctccctcagtgcccatcttttagatcagtagctgtcactgataaaatgtctccttggaactacagagacaaagttgcaagccagccagcgggcccaccctggtatctcctgcagttatcagcattctcactagtgattgatagaacacgttttggagttgttttagttttgtagaatgttcatgggaacttagatgatatctgaggaaatgccttcttcaagtcactagttctaaaggaaggcagccaaattccttcagtctgagaattttggagctctgaagagggcatggacaaatatttcttgcctctcttttttaaatatggaatttggaggctttgtctgtcgaccaccatgccgtgtctttaagaagctctgactgggaaggaaacagccccaagtgttccaagctctgtctgctggaattaaatgtcccttcctgtttcctgacatccacaattctaattcatcctccattcaccctcagtgacttctgttctttgaaggttttgactctgtccttgtacatgaatttgacattcacctgatactctgtggggtccagagagcatgtactccccaccagcttcaactaactctaaaatgtcacagtttctgttaaagtgctttctagctactaccagagtaaacatacagatttgtctcccctgggtgtgctgtgagttcatggcataaagtattttctggttttaaaatggacttctggcctgtaatcccagcactttgggaggccgaggcgggcggatcatgaggtcaggaaatcgagaccatcgtggttaacacggtgaaactccttctctactaaaaatacaaaaaattagctgggcgtggtggcaggcgcctgtagtcccgggaggcggagcttgcagtgagccaagttcacgccactgcactccagcctgggcgaagagcaagactccgtctcaaaaaaaaaaaaggacttctggcttttctactgggaaatgtggttatctgtgccttctggaggtcaagatgtcatcatctggccctggtccctctcacttctcctcagactggacctcttctccagctgtttactcaccttcgtagttgttcacacaatttctccttcatgttttttggagcatctccctaaggtgcatctctagtcaccccaccttctcattcatcctcccaaccaccatggctccacatttatgaactacattcagtctattttcagcctgacatttaggaccttccacaggtagttgccaactttatctgccaataattagcccaagttaccccccagtgtcaaccaaactggaacgctcacatgttctgttcatctggaatacctgtgcctatatctgtctgttgacatcctaagtactccaccccagagcaaggggtttatgggagtagataggggaaaactctggtacaaagttgtaagaacgtgggttgggcttggagaaaatctagatggcatcctggggcaatggagggctcaagaacaatggcaatgtccagtccacaagacaggaggtaggggatttgaagagggaaatcctagcaatgtggttaccagaaacacatagaaacatacctccccttccctaaaatagttattggatataataataattgccttttaataatacatgacttagcaagaggcaaaataagggaattcctcagaggtgagaaataatagaaataatgaaaatctatagaagtaagaaaaccctggggcctggcatttgtctgctaatccctgtttgcctagagcatgggttttaatgagcagtgggtgcatctaggacaagtacaaaacttggggccactagtgtactttataagatattgattaactttagacttattaagatgaatatgtaacctataatttccaaggtctccactgacagaattgaaataaagcatgtagcttccaaactatagagttggagggaaaaggaatgagagaagggaaaaaaatcaacccaaaagaaggcaagaaagaaagaaaaaaaagaaacctagaaaacataataaacagatagaagcaaaaaaattcaactctaaactattcataagagaaactcctaaaagtatgagatagagaaaggctgccagtaaaacgatgggaaaggacataccagggtaatactctgcaaaaagaactaggtgtgcctatcttaattattaggaaaaactggacttccagaacaaaaagcaacattacagatgagttttcaatttaccagggatacataattttaaatttgtatacccctaacagcataactttgaaatatattttaaaaaattactggaactacggaatattcaaaatcacaaagggacattttcacacatctcacagagggacattttcacacatctctctcaaaattgatgggtcaaatagacaataaatcagtaaggagttaaaaggtttgaagaacacaattaagaagcttgatctaatggacttacacagagcactgaaagcacattctcttcaaatacacatggaatatttacaaaaatgcatcacatactaggccatagagcaaacatcaacaaaattcaaagaatctatatcatacagccaacattctctaacagttaaattagaaatcaataatgaaaaaaataactcagaaaacttcatacttttgaaaattaaaaaaatgcattctaactcatgagtcaaggaaaaagtaaaactagaaattaataaatatttagaactgaattgtcatgaaactactaatgggaactggtgagatacagctaaagcagtattgagggaagattatagccttactgcttatgctagagacaaagtacgtctgcagagtaataaactgagtgtttaactccaaaaattagaaaaagaaaagcaaataaatccaaagaaaggaggagtaaaataatataagcataatataaacttaggagcagaaatcaatggaagaacaactactaaataatagaaagtatccaaaaaatgaaagtcatcattttttctttttcttcaaattattaataaaactgacaaactgcaagcaagatttaaaaaaaaaacagagaagacactgataatcaacatcaagaatgaaaaagagggcatcactatagatgctgcagacatcaactaaaattaaaaacaggatattactgacaacttcatgccaattattttgagcatttagacaaaactcacaaattcctagacaaatgtaatttccatagttaattcaagaataagtacaaaacctgaataagccaataaccatgaaagaaattgaatcattagttaaaattgttatcataaagaaaacatcagactttgatggctttgttaaaagttctacaaaataaccaggaaataaataattctaatcttacacaaactatcccagaatgtataaaaaaaagaaggaaaaccatgttatgcatcagatacatccttgatactaaaactggagagccacaaacagaaaatgtaggtttttcaaaatgaaaatttacaatagcaacaaaatatataagccatcaaagaaagaaaatgaacaaaagggatgtaaaactgttataaaactttaaagacattaagaagacaaatagaaacatatataaacacaccattttcatggataagaacacaatattctaataaaaagatgttcggttccccccaatttaaaatagatattaccacaattctgatcaaaatccaaaaatacttttggagtatatttaaatgattctaaaatttatctgaaagagcaaatggttctgaataatcaaaacactcctgaagaagaaggaagagaaagtgagggaatttgccctaacagatatcaaggattctaaagtaatagcaattaagatagtgtggcattgttgcagagatagacaaatagatcactgaaacaattagaaagccccaaaataaacatataaggaaacttaatatggcacaatccgtaccgcagatcagtggagaaagaggatgtactactaatgaataaatgtttctaggcaatggaaaactgaaaatagaatcctacctcacacccaacacaaaaatcatttcctattctggatgggtagagaacttaaaaatgaaaataaaatatttttaaaatttagaatagaatttcagagaatatctttgtaatattagggtaaggaaggacttcttaagacataaacagtatggatcttacaggaaaatattcataaatccaactacattgaaagtaaaaacacttattcatcaaaacacacactaaacagggtaaagagatgagccacaaactgggaaatgatatatacaaacttactaacagaagtgtctaaattatgccaagaactcttacaagtcaataagaaaaagacaaatccattgaaaaatgggcaaaatgcatgaacaagaacttcacaaaagagaaaacacacataaatgacaaaaaaatccacatgtaaaaacatacttaatctcacaattagtttcttttaaaactgaaaatgaaatgttagcatttcacactcaccaaatttacaaaaattagtttgacaatatcaagtgctgtagactatgtgaagcaagagaatgactcatatactaacagtgtaagtgtaaattgaaaaggaaaacattttggaattgcacggtaaaattgaacacacacatactctatagcccagcaaaccactcctacattcaaagccttgatagtgttggtagcagcacgtaatagaaaactggaaaccacctaaatgaccattgttggtaaaatggataaataaatacaaagaggtaatatactgcaataaaacatgaaaatactagagctatacacaacagcatagataaatcttatatatgtttgaatggaaaaagcaagctaaagaaatatatctggaggatatggttcaaaagtaggcaatattaaactgtatatctgtacacgtataattgttatatatagtcatatacatatatgtggtaaagtatgaagtggtaaaactgtagaaaagcaaggagtaattaagaggcaagacaggctagtgggtacctctggagggaggaaaagatctgcagtgggcaggggtgtcataaatgggtttccaagatactggtgatatcattcttgcattaaattatggacatatatgtacttattattttcaccctttataatatacatttatgttctgtacaatcttatgtgtgtatggtatatttcacaataaaacagtcaaccaaccaatcaatcaagctagctagaggctaaagaactgaaactagaatccataagatgggtctagtaggttttcaaggataaataagagacaatgaagtttccctgaggctatgatccatgactgaaactagcaaaaagcttcacacttgaatgagaagaaagctttgaagcagggcagagactcctgctggtgcccttggaggttgctggggatgttataactctaggaagtaaatggatgatttgagaaggaaaacttgaacaaaggggtattggctttcttttgtaaccaggaaggtacataatttgcaaacgtgcagatacaaagaagatactgtctttttataaatatgaggcatttgtctcagttacttatacaaataaaagtttattttcccttatatcacaggaaatccagaagaaggcagtgcagagcttgttgagagagttagcaatattttccaaatgtaggctacttccactctgccatttttagtttaggggctttttgccccatgcagctccaaagttctcatctgccttgaatgcagcattagggatattttcccaactctttgtcaacgaagttaaaggcttttctagaactcatccacagccggctactcacatcatagtcatctgaatggtgacacatggacatttcttgcagcaagagagcctggaaaagtaattattttgctattgcagactgtataataggagcaggcaaaagtgaagggggagaggtgtgtattcagcagtgtctgtcaaaatactccactaagaattcttcctcttttatccccaggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatttttggaaga

SEQ ID NO: 572 - DNA, 13559 bp, Homo sapiens
cctggctaattttttgtatttttggtagagacagggtttcacgacgttggccaggctggtctcaaactcctgatctcaagtgatccgcctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggcaggtggtactgagtctaagcactggatgaagaagatagtagaaaacagtctggatgctggtgccactaatgttggtaagtttgggagagttttaagccacaagaaatgatcagtgaatgttgttgtagtcaagaaacatttgttattgaaataagactatcaagtgttgatgtagtaataagttattatttttaagttaaagttagcacctattatgtgcctagtacttagctaggtagtaataataataacgacagcttttcttgtgttcttatggtgtgccaggcaggtgttatgctaagaattgcacagaaatatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaatgtggtaaaaccctgtctctactaaaaatacaaaaattagccagatgtgatggtgcatggttgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattataaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgataaaatatttttatccattcacttgaccccttagaaaaacctctctgaaaattaattggaatcattattatttacaattttctatctcaatatctcagcttctagcttctgaattctgttttgtctcacagccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattatagcacagatactaaatttttataaataattacatgcacacacacatatatacatatatatacatatatatacatatatatacatatatgtatacatatatatacatatatgtatacatatatatacatatatacatatatacatatatatacatatatacatatatatatacacacacacatatatatatatatatatatatttttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattataatatcttttggattctttaaaaaaatttttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcagagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacacgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcaccacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtctcgaattcctgccctcaggtgatccgcccacctcggcctctcaaagtgctgggattacaggcgtgagccaccatgcctgaccttatgtacttatatttttatgagaatatttctcttggttttctgataaatgagttactggcacccttatgaatttgaatgcaaatgaaacagctaaatgttatataattgtcgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctggggttacaggcgtgagccaccacgcctggcttttttttttaaagcttttttgtaagtcagccagcaagaacacaggaggaagtactcaaatctcccttacacagctgggggctatgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacggaacagtggccacgaggggccccaacagaggaagaaaccaggtgaggtgtggtatagtggactcgactgccttctaaatctcagtggttgtccgggtgcggtggctcacacctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtcaaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcacgaggtcaggagttcaagaccagcctggcctagatggtgaaaccctgtctcgagtaaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatacagattttcccagctgtctgtgctgaagtccctgtggggaggctcctggctggtttcctgtaggtagacagctacacgtcctgcccttcattggcttcttttcatgaagctcctgccatctacaaaacatgtctcccttcttgaatcacatctctgttattgaaactctagaagtcgaccgggcatggtggctatgcctataatcccagcattttgggatgccaaagcgggtggatcacctgaggtcaggagttcaagaccagcctggccaacatggcgaaatcccgtctctaatacaaatacaaaaattagccaagcatggtggccactgtactccagcctgggcgacagagcaagactccgtctcaaaaaaaaaaaaaaaaaaaaaaaaaaagagaaagaaagtatcatgcttttctgcattctgtgaattgttttagtgagttatcgaacttcagggcatggtgggaacctccaaatttgcagccagttggtgagaagtacatgtggtctgaggacacccaagcctgcaggtgtgtctaaagcgagggcagcctagtgggggctggtggccttaacctgtggcatttgaggtaacatcagggagttgacatcagaattgcatcacataggctgggcgcagtggctcacgcctgtaatcctagcactttgggaggccaaggcggagagatcacgaggtcaggagatcgagaccatcctggctaacacagtgaaaccccgtctctactaaaaatacaaaaaattagccaggcatggtggcgggcgcctgtagtcccagctactcgggaggctgaggcaggagaatggcgtgaacccaggaggcggagcttgcattgagccaagatcacgccaccgcactccagcctgggtgacagagcgagactccatcccccccccaaaaaaaaaaaagacaaaaaacagaattgtgtcacacaggccagatgcagtggctcatgcttataatcccagcaatttgaaaggcaaggtaagaggatcgcttgagcttgagcttgagcctgaggccgcagtgagctatgaccacaccactgcaccccagtctgggtgacagcgcaagaccccaattccaaaaagaaaaaagaaaaatcacaaagaatttcatggcagagtgcctgtctttcacagctttaactgctgcaggaactttctttttttttttttttttttttttgagagggcgtgaggagacacaatctctgctagtgattctcctgcctcagcctcccaaatagctgggattataggcatgcaccaccacgtctgcctaatttttgtatttttagtagagacagggtttcaccatgttggccaggctggtctcaaactcctgctgggatcatgggcgtgagccaccacgcccggccacctttagagttttcttaccacctggttttcctctctcaatatctttctctcatttcctgccttaaaactctagcttggcatctgggcgcagtagctcatgcctgttaatcccagcactttgggaggccgaggtgggtggatcacttgaagtcaggagttcgagaccagcctggccaacatggtgaaaccttgtctctactatttttacaaaagttggtcggacgtacagacgggtgcctgtagtcccagctgcttgggagactgaggcaggagaatttgtttgaacccagaggtgaaagttgcagggagccgaggttgtgccactgcactccagcctgggagacagagcaagactgtctccaaaacaaacaaacaaaaaaaccctgtagcttgagccttctcttctattgtttttctttaaaaaataaaaattaaaaatagatgtagatgctatgttgctgaggccggcctcaaactcctggcctcaggtgatcctcctgccaagacctccaaaactgcagggattgtaggtgtgagcactgcacccagccgtatgttttttttctacataaaaaacagcacaggattatcttccagagctaataaatatgttcaaataaccacaaccccattaaggaaaaatatcactgggcagcaaataatcaatccagaccaatatgatcacagttgctgtgaaggtgagaaaagttcatttttattatgtttccacaagagacgcactctattgttctcttgaaaacacacagctcatgtcctcctttagaacacacatcctctttaaagtaacatacaaagatgccaaaacaaggtaaaaaattacatctgaattctcacatttcaaacatatatgaaatatcaaataaaaatttatttttacaagaatttaggggaactactacatagctataaatgtaatatatatgttaactaagtatcacagataaaaaccatgctcccttcagcagcacgtgtaataatagatacaaagattgaaaggtaaaagatttaggatgaaaagaatcctctcttaaaaaggaaaacaaaattatatgtatgtgtatataatagttataacacccatcacacagctttatagaaacagcatctattcaaaaataccagtatttccaaaatatttaaaataatatttaaagtaataataatatttaaataaataaatatatttaataaatatttcaataaataaaataatacttaaataattctatacccatgtttttcaaaataaaccaataaattagatagtatgtattagacgtgttagtatatatatctgagacatgttaaaaatcacaactgaattctcacaattcagtcacaaacctaaacagcaaataaaaatttctatcaccagaattatgtttttttctggtggggaactaccaatagctataaatagaagagatttttatggaagtatcatagataaaaagagtgctcgcttcaggagcacatataataatacagaaacaaatttaaagataataaaatatttaggataaaaagaattgtctcttaaaaatgaaaagaaaattatctttatgtatatataacaactataactctcatcaaaaaactacaggaacagcatgttttcaaaagtacaacaatttccaaactatttgaaataaatctatgaataattcaatggccaacatttccaaacaaaccaataaaatgcagagtgtgcatgaagctatctgttacaatctgtggcactgatatttcacaaaagaattctgtgccaatctgagcccctgcattgtgccttcaaatgctcctggactgtggcaaccaagtctgtaagaaacaggacctccaggttccggcccagggaggttggaattcagcaatatagaaagggtggtggtgccgcaggaaagggtggaactggaaacactcctgttttcttacttttctccaaggactcctagaaggaccccacccccctccccccacccctgctcccaggaggacaacgtgatcactgtattcagctccatcaagaatggtccaggttcttctagatgatctgcacaaatggttcctctcctctttcctgttgtctgccattagcattggaataaagttcctgctgaaaatccacatctcccctgggtccggtgttctggaagtgagagagacaatgtcacacttgaaggaggcagctctctagacaggaaggttattcacgtcccatgtcaagtctagagttcagagcaattgagaaatgcaattttatctgctgcctttcattctataccctgcttctgaaccatcgtgttcaactgtgaaactcacactttggtgaccacaactccaaaactcacttaatacacccaaggtcagccccagtgatctgcttcatagcaaggactttgggtgggtctgcccagggagtagggcaccctcagagaatgtggctttggacttcatcatagctggggccttttgtgtcacttaagatctaaacttgtaaccatgctagatgtgtttctaatgtgacaacatcacgaaccacgagtccagaagcctaatccttaatcctacctcctcatgatgaagtctcatgctctgtgctcaccgtggttagctgcacaagatgtaaaccaaagcttcactgaaccctcgacccaaatcggtaactcaagtgcgtcaatcataatgaacctccccaaactcagtatttatgattatttttgaggcagggtctcactctgtcgcccagactggagtgcagtggcaggatcagggctccgtgcagccctgaccttccaggctccagcgatcctcccgcctcagcctcctgagtagttgggagtagagatgcgtcccacatcgcctggctaatttttgtatttttgtggagaggggatctcgccacgttgcccaggcttgaagccggatcaagcaattgggttcctcggatttccaaaatagaccccaatattctgcctttaccccggaggatgcagatgtaccttctctcaggccgatgacctcaggcctccacggtccctggagctctaggaaaggcgagcgcgatctcgcgcccacacccagtgctctgggtcataagcctggatctggaaaaacaaacgccctttgagaagacggggactcgccaggatacccctctctcccctcatccagcctccagcccacccgattcctccccacctcctccacctccccaggccccactcacctcctccaactcctcccgggaaacccaagccctgccgctcatggaacagaagaactggaaccgaagtttctggaacagg

SEQ ID NO: 573 - DNA, 9583 bp, Homo sapiens
ctctttcccctcttgcccctctccagcttttctggtccaaccctcttctgcgcctaacactggcacctccttttcttccggctgatgaataattgtccgcaaaccagcctctctggggcactgaggggcgggaaggttagaaggagccagggctagagtcctggaaggtggcagtcaggtcgcagggccacagcagtcactctgcgactctctcttccggtgtttctccagcgccaagcgggagaagacggagcctgggagctgggactggaggagcgggaagcgcagtatcgggaccacggctctgggaccaggaaaaacgcagactctccagagtcaatgtctacttcagccagctcaagggcgcgacaacctggcgccgagcatctcaggccgccgcggggaccccccctaagggactcgggaacacctgcctaccctagaagaggcggagaataaccccgtagggagttaagcggcctctgcctacagcgttcctcccgcctccacggcgccgagccctgattgacgttcagccaggccaatcatagcctgtgtctgaggcgcgcggagctggagcgcccagggcatgtccgccgatcccaaggaggcaatctgtcaggcgccgcccgggcggcagtatgcctgagggggtcctccgtgttcgcgcctcccgccgcctgcactgaaaggtctgtacctgagcctggatacttgaacagaggcagacactgcggctcaaaaccccaagggtaggtacctattgtgcggagtctcggaacgcctgcctggaagaagagttccggcggctccccgaacgcttggagaaagcgcttggatgcagttgcagggtgagatttgagacggtgattgtgttttccagcaggcgctcaggcggggtggtgaaggagggatacagacctctaaagattcctctctcgttggggtgaggtggggaacagcagtgacagtagttctcatccctgagcctcctccgggccggcccgtggaggagagagaaggggagggagaagggtttgcccaggccttcagacactttactttgtgggagatgtatgtgctgagtgtccctgctctggagggattgttaaagaatccaggttcttggggagtgtctcaggagaacactccaggtgatatccttattcttcctattttcaccgtgttggtttttttttggatataacttgttccctttaacccgaggtggccttggtgtctggcagctgttttctctgccaggcaccaccctctgggcctcacgtcttcatccctcaagtccgctgcctctgagctgctacttagatctggtctgtttctacctctgctggaccagaagtttgcattaacgcccccaccccatcctgcaagaccggcgcttccaaccaagggctctctcctctgaacctagaacctgcttggaaatcgagtatttcctctatgcccaggtggagattgatgtttgggtttcacatctcccaactctgttgggtactatgtcgtttctcagcttggttgtatgtgcctccattgagtggaccgtatctccagaatttctcctaaccctcccagtgtactcccctgcaatcctttctttttttctccaaatcccccaccccccaccagaaatgactttacccctgtgccacttattttggcctggagcactaaggagccatactacacccaatgccagaggtggaacagaaatgaggtttgaaatgggaaccagaagctaatctgtgggaaattcttttactcctcagacgtgtaaagatgtgttggagactctcgtaaatatgtattcagtaatgcagcatatacagtgatcaccatgtattcattttttatgggaatcaacaattcagaatgatcaaaaatccctgtgtgtagagacatgaatctataggaatatcacacatagtgagcacaactgtgagtgaaatcccatgtttcatgcatcccagcagtcccaaagggagcctccaaatgtgtacgggattcagactccatgtaacctgcatctgtctatgcactagctatgtgagctgttacctcagtcttgatgaggttactcaggaagtctgggatcttgatttttgccggtcactgatcacctggctacaggaaaggagacctaaatccagaacttaaatttatgaacaccaggtctgtaggcactagacctcagaagtaggtgagtaggtggctattggttggtcccttctggagtgaggcagagatacctatgccatatgcaacataaaaggttgcctgagcccctcagcctgaggtagagtaaggagggagaggtggagagggactttcttctcagaccagggaaatcagaagccatcagatgccttcagtagggaatccagcacaaagaggatcataagtcatctccccacttctctatagtcatcatagacgtaattgctaacctacccttccttggtgctctggttagtagagtgaagttgagataatataaatgaaaaaactgagcagaaagggagtgaggatacggggcctcttcagtttgccttatgggcttcccactctaaatagatgaggtacacaacattctggcagtatcacactagggccagagttggtagctcacagatgtacgatagaggatggaaggagtatgcctctcaggcaggcaagtttagcctggtagacagaggatgtggcttaaaagtcactgcctacaagaccagtgcatgcaagtgagtccctgctgctgcttggatcagaggaggtgaggcagaaggctgatgaaaacccaccaactgatggtcagtccgagaagcagtcaagatggagaactgcaaaattaacagcttaagttttccaggagtctcagtgcccaatgtcaggtctaccagggatgtccagcccctctggtcagagccccaggagccttgtctgaatgtggatcccctctgcttattcaaagagacctgggaagctgagccaggaacctggataatgaccagaaagtcacccagacacctgagaaatgcctcccttatatccaagagatccctgtgtgtagaacacatgaatctattggaatatcacacacagtgagcagactcttcttacacttactaaactctcttcgtagatttactaaatttttcaccagtgactcaatggagcgaaaccaggtcccagactcgatttaaaaaaaaaaaccacacacacacacacacaaaaagttctttaggtgagcatgtatgcatgtgtaaatggtactatacaatggtatgattggatagtcaaaggaatatctaacccaagtgtacataaggagtaaatttggagtcagaggaagttggtcattgtaggaaagtaactgctgcaagaaagatttcttagaatgtaactgtctaatatgaggcatttatgcctcttttcctccatgtttctagtttctgccttgggtttggcatttattgtttatcctgcttcaagtataagactagtggtttattcgagggcccacaacttccacttctaccctggcgtcacacagatcattttctcttctcaagtcattgtattttcactggtagtaaaagaggataatatcttcatcttcaaataaattagtgggagggattcaaattatgagggaaaagaaaaattggttcttctgctgtagggaagggttactgaaaattaaaggacaacctactgagctgaagagagctttggggtttggtaatttggggtgtgaggtggatcttcaggaatgccatgggcttcaagactagtgtgtctctcccttagtatgttcctcctcagtttgaaaggacttcctggtaaaggactgaaagaaatgtccactccatcatgtctctgctgacacctagcttctcttctccagttataagtccattttcctactggggtaacacaagaaggaggaagaatagctcaggggtcttcccttcacatctctcctacaaggattgtgaaatgtcatatgcctcctcccatagacttagatagacctaaaattgtcaacatgtgtccagatagttgcaaaaaatatataatttccaacatattctccatattaacactttaaaataaaactgttaatcactcatatgttcaattcaatctaaatatcataatgttttgacacccattatcattaatttaaaaaatatacaaacaacctctttcttaatggttggaaattttacattgctcttttttcccactttgaattcatatttttattctaccccccatgtagaatttttctttttctttttttttttttttttgagttctcaaccctggttacatcctaatgtaatttttttctttgttcttggaaatcttttattgagccacctattctgcttctttgcaacaaaatatgttcttacattgaatttttaatttcttgttgtaagtgtaaaagttatatgggctgggtgcagtggcccacacctgtactcccagcactttgtgaggctgaagcaggaggattacttgagcccaggagttcaagaccagcctaggcacatagggaaacctcatctctacaaaaaaaaaaaaaattactggacatggtggctcctgcctgtagtctcagctacttgggaggctgaggtaggaggatcacttgagcccaggaggtcgaggctgcagtgagccatgatcgtgccactgcatgcactctaccctggatgacagagtaagatgctgtctcaaaaaaaagttatatggattaagataggattaccaactgttagagatcaaaataatgtcagtacagattggatatgccttatttgaaatgcttgggaccaaaagtgtgttggatttcagattatcttggattttaaaatatttgtatatacataatgagatatcttgaggccgggacccaagtctaagcatgaagttcacttatgtttcttatatacattatgcacatagcctgaaggtaattttataccatatttaaaataattttatatgtgaaatgaagttgtgttaagtacagtacttacatgtggcatcatattggtgctcaaaaagtttcagattttggagcatttcagattttctgatgagggatgctcaatctgtaatacacattttggtaaataaaagtgtaagtttgtaatggtaaaatttaactagaaatgcatctcttaatgagatggatagggactttattttcccaatttcatgttgacaaatgttacttattgttaatgaatctgggctgtatattatttcaattaaaaaattttaacatgaaagaactaaggaatcttgatcatataaatgaatgagaaaataaagacttgttgaggcaacttcacccaatttttaaaatttcttcttagtcgtatgcaaaactcacataatgggctattattaaataatatttttaataatctgtcagctgacaactcaagtataaggttcttcttcaattttgttgaaagcaaagaattagaaaccaattgacttgcaaaactatttttatacatacattaggttctttcactttgtttttagaactataccaaagacttcacaaagtcttataaaataactaataattatacctgctgctctttcccttagagataccttgttcatgaatctcaaattagataaaactagggttaaagaaaaacaaccccccacacacaaaattggagatcaaaaatcaataggttcttaaaaaatatctcttcattttttatgtcatctggaagtgccttttaaaactatgacacagagatggtgctgtatagtttacagttcatgtgtgtgtgtgtttaatttcattattgtacaaaattgttaattttataatcatgcatttgatagatgtaaaacagtgtgtcagcctccaagcgggagaaattaatccaaaataaatgaagctggatttctaaagtttagagcatcacatccaagattgcatttgggaacattctgttttgtatccatacacaaatgaatttctgtttttaagaacacaatttaatctacttagtggaaatcaacagcaaaatgaagagaaggtattagataattaataaatataggtttacagaaattctattactgactgctattatgtgcattaattacagcagaatccacaaaacatttccatcaaattaaatcttactctaggaggtatatgataaaaataaataaatgaacagagaaataacagcatactataaactgttacccaaatagaaaaatatatttacactatccagaaatctttggtaaaagttaatgaaaatatttcccctattagttagaagaagttcaagaaaacatacattaaaataccttcaatatgtgtttgttttactccaagatgtgatgttgatctgtgagaaattaattttgagcgttttgcctccactgccttgaaataatgcaaaataagcaactgagctgggggcagtggctcatccctataatcccagtgctttgggaggccaaggagggaggatcgctggagcctgggtgacagaataagactctctctctctctctgtgtatatatatatatatttgcaactgaagcacagatgggacacaggtaagtgggagaactcaccaagctctttgttagtatttagagtgtttcatagaaagttaatatttcttaacttttttttttttttttttttttttttacaaatttagaatatcctagctctgagacaaaaattgggaacctcagcatgagtttgtcacctgaatgaaataaaaaaaatcacgttgaaggctggtgcagtaacatgtgcctgtagtcccagctactctggaggctgagtcaggaggatcacttgagaccagaagttcaggaattcaagactggcttgagcaacatagcaagacttcatttcaaaacaaacagaaaaaagccaccaccttcagtatttcttgccaaagcaaaggagccatttgttctttacgatggtcaggaaaggaagcatcaaggtcatcaaatgaaaaattttcagcatttcagcctctctgctcagggaaatatctgaatctagaatatcacaacatgagccaaaaccgccccatttctcatgccacatgtcactcttaacacaaggttactcaacctcgagcatggttggcatttggggctgaataattcttttttgtagggggctgtcctgggcattgtaggatgctcatgagctacctcagtctctaccacccactagatgccagtagcattgacccctgatctctctacccaagttgtgacaactaaaaccatctctggataatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaaccaataaaactgcacaaagagtgaaccctaatgtaaactatggacttaataatgtatcaatattggctcaccaattttaacaaatgtaccacactaatgcaagatgttactaatagtggaaactggagggaagagggcttgaggggacatacgggaactctctgtaattcctgttcagtttttctgtaactgttaaactgtccaaaaaaagtctgtttttataaatggaggcatggttttatatggactaaaatactatgattgcctttttattttacacatggtgaaattagagcaggacatattttaaactcaaaattcacaaaattaatttatgaaaatgtttacccagatcaagaatattaaagaaacttagattaatattgttaccttgaatttattttactgagtaatcctctaagactcctctacacattattaatctagaaggatttttaaagtctttatgacaattaattattggtctacagtcaaattgcgtatccccattaactagagttatatttttccattttctgatccaaaaactttaggaacaggaaatgtttattttagaaaacaagaacacttcttaagcatttgctgttaacagttattttcacatgtgcttgtacttattttacacttgtcagaacatagtatttacctttgaaccaaggttttataataagcaagcactttttttatttagaagtcacattttccaagtagaaaaatcattaaaaattcagtcctctgaaggctaatttctttaaatcatttaacctaattgtttaaggtatagattggaatttttctcagcactctcttgaaaacaggtgacagtggaaccctgttaggttcacaaatcctagactttgattatatagcccaggctcaaatttttctcgaatgttacgaacattcaaagcattaggagtcttggtttcatttcttaattttttttcttctgggtatatttgagactcatcttggattcaaataaattaataatagtctcatgaaaccgataaaaatgggagctccattgaacatgagagacattgattcgtagtttctaacatcctccaaatgaggagcccatccctaatttagatgcttctttcaaaggaggctcctttccttcgttatccataatatagtcacaccagtcctgaaaaaacatggaacagactccagatctttatatttcatactctaaagtcgtacaagccaatctgcatttcctctagtggaaactgtatagctggtcatctttccaggacccttttatcaagaaacaatgcagcttctacatttgtgctgcttctacaccaaaacagctggaatgtatatagtatggttctggatgctcttgtatacctcactcttcatttctcacctaacccatgtgctatgatttgaatgtttctcccctgcaaaactcatgttgaaatgtaattgccatgataacagtattaataggtggaatatttaagaggtgattagggtgggattggtgatgttataaaagggtaagttcagccccttcttgctctctctgtcacccttccaccttcctctgtgtgatgatgcaacaaaaaagcccttcccagatgccagcatcttgattttggacttctcagcctacagaactataagccaataaatttctgttatttgttattagtctgtgatattctgttacagtagcacaaaatggactatgacaccatgtgtttacacagaaagaaaaaaatatcatacggtaattgctcctaaatatgcagagaatatgttctgatatccttagtggatgcctgaaactgcagatagtaccaaaccttatatatactatgttttttttcccatacatatgcatgttaaagtttataagttaggcagagtaagatatgaacaataactaataatgaaatagaaacgtaacgatgtgctgtaataaaagttatgtgactgac

SEQ ID NO: 574 - DNA, 9583 bp, Homo sapiens; identical to SEQ ID NO: 573

SEQ ID NO: 575 - DNA, 124810 bp, Homo sapiens
ggtggtatcatttttctctgattgttcttgatcttgatttttaggcagtgcattagtgtctgcacatttgaaaaacaagaaacttattctagttcttgcataccggctttatctggaaaaaccctttcctagtcatccagcaactctttgtagggtgtctagtgtggtctgcaggtgaacttgttgccaaagtcctcaggcaggctggcctggtgcctgtgttagcagatggtaggcctgtttcctgggtctgtagagttgggcctgaagcctggatcaactggggtggatcttttcattgggtatgtggggatgaacgtaaagccaatttctataagggcaggtacagaggctgttaacagtaggtgctggactgagcatgggtccacaggggctaacatggctctgaggcgtgcattgagcctgtgtctgcaggggctggccagattttggaatgagcatagtgtctgagtctgctgggataagcctggcatctgagtccatggggactggcctggtactggtgcaggactggagccggaatctggagaaatgggcctgggatcttggtagacgggggcagacctggagcctgagtcttcagagatggtcctagagactttgtccatgatggccagcctagcaacagggtctaatgaagtcggcctgtaccctgggtctgctagagcacagctgggccctgagtttgttggatgctgggttacaaaaaccagcctggagtctgatgctggcctagggctgtggtgagatggggccagtctaaagtttgagaccataggtgctagactggtgcttgtagccacaggggtgggccaagaattgtggaatggcctggaggctggttgtgtgagatctgtcctagaaccaacatattcagaagtgggcatggacactagggccacaaagggtggcttgggtcctagggctgtaggaactggactggaacctaagtccacagaggcagtactagatactgggtctgtaggcacctgcccaatactggagtcaactgtgatgggcctggaccctgggtctgctagaggatgggaccataggaactggcctggagagtggggtggcagaaactggcttaggcctcgggaggcctggagcctgggtctgcagatgcttgccagatacctgactaaggcctagggctagggctgccaacctggaaatggggtgggcctgaatcctggattggtgtgagccaatctagttctgggccggtctggaacctagggtggacttggagtctgcgaccacaggggctagccttgtgctaggcagtcctcgagcctgtatccacaggggccagattaggggttggatatatggacactggcatggtgactagagttgcaggagctagcctggtcctggggctggcttgaaacctggagttgtcgaggccggccttgttctgggagcagtctggagcctggagtcactggggctggcctggtcccaaagactgtctgacatccaaggcactggggtagacctggcatgaggatatacccagaaaccaagtccaccaggcaagcctggagcctgggctgtgtgatctggtctggcttagtgtgcaggtactagcctggagtttcgggcaatagtcgcatacccattactggattttactgaagcaggctctgcgttggagtccaaggcaaagttcagtgctcacttcacttttcttcttcgacacagagattgcctctctctgtgccctgctgcctggtgttgtgggaggggtgacacaggaaatgaaaaattgttcttcctatgctcttcaattaatcttttcttatttctctgctacacaacatttctgtaacctttcacctggttttcttagctcttctgaaggtattttcatgcatagatagttgtttaaattgatgtttctgtgtgaggataaatgctagaaagtcccattctgacattttgctgatgtccagtttcacggcatccaatcagatttctatataacgattgtcaaagtggctcagcagcatcagagacaggtctcctgctaatttggaaagaaagattgcagatcttatgttaaatgatcttatcaaacacacacatatatacacacaataataataataaatagagctgtcaaaactttaggaggtgatgaatatgtttatggcttttgttgttgtgatagtttcatgagtatgtatgtattcacctctatattcatcaaggtttatatattaaacacatacagctttttgtatgtcaattatacctccataaagtagttctacaaaaaaataaataaacaccatagaggaaaaatacttttggcctctttctccatgaagtatgacttctatttcaggtttctggtggttactgaacttccagattttctgatgataagtataataagagaaataatatgttaggctagaaaagacaaaaatgcaggatttgaggatgaatcaatcaaattttttcataacataataggacttattgttcaacatattcaagccagtaccaggctagagtgagagaaagtttccagatcaaatatttgtgtaaactaattcaactaaagtctcaagaggaagagattcatgatgagatatctggagtcacaatgtgcaaaattcatcacaaagtggaaaccagcatcttacaatacaaagaacaatggcttgggattctgagcatctgggttctggtcttggttttgcacatgcaatcatgtgtccacttcccaggacttagtttcttgaaactagacaatctctactaaacctcctatctgattttcctccctttcaggaagttaggcaggtgctcagatcagctttttggtcacaaaggatgaaggaagaaggcaggtgtctttcttaaccacagttttgggacatggctttagagaatgcattagcagggactaagcaaataatgaaagctgaatttggggtagaaaaatggggaacaggagacgaaagaatcagaaagaaaatattaaggagcaacaaagagtcccctattgatttgtagtatagccaaagttttgtttttctcttccttagactcttagaggactagaagacatcagagagttttaaaatgttctaggatgccaaagccaagaaagcatgtcctgtggatccgacaccttctcagttccctgatctagctaaaaccaaataccacttgctgatttctccggaggcactgaaacctcatcaccaacccagaacagtttagcatgacttgttctctccatgaagtccctaaacatcccccttcttcctctctaaaagcttcaagaatccactttcatgtcaagtttttctacagaggcagattgttgtttatatcaaactccagaaaccctcatccttttctgatatttatttaagttggtgctgtcagtcttttctaccataaagaacctgtgtttacttggctcttctgtgtcttgccaccagccaccagtcagttaaaacagctttcttttgctacagagaggtgcagccacatctaaagccaccagcagtgcaaggtcctctgactgctttaacaacccctccctgagtgtccagatatgaagaatctgctcaatcaccaaagctcctgaattaagagttaggatgctcctttggaccttcaggaggaacttcattaggaattctgagatagagcaagcattgctggggaaccacaggtcccagtgtcctcctgtcatctcagaagccagtaaagaaaccttcttccctagaaagacttctggagagaaaaaaattccccaagatttgagagcatgagagtctcatggtgaggtccctggtgaacagaaatcagaaaagtactagtacacagaagagatgtacaagcatctagtcactgcctcaaagtaactttgaatttattatgacttagattgagatagagtgattctttgactgttcggtccgtgcctgaaacaaacatgattaatatccataatcttattaattttattatccctaggaggcaaagtctccaaagttttccaaatgatcttgcaaaggcaactctcctcagattccctaggaagttttcagattttatgaataggtgccaacagctatcagatgtcttccaacgatggctgctgcatcccagtttcacattgctaagggttaaagaaggacattgatatgaaagaagcatcccagagacccttgacacattgtgagagtacacagagggtggggctccatcaacctcccacagacactcagccatactattcccattccctgccatgagcaagagtttcagggcctcacaggggttcaaaggtggccaaatcattgccactctttgtagtatgaagtacaccaacacgtaaaggtaggctaaacattgataatataatagctttaaatgtgtataaatgtatgcttacaacctcaaaaatgccatgcaatattattgttctacttacaagatcagtgcaggaattataaagcattaattcagagtggactcttggcagtgtgtaatttatggtgcatgtgttctccattctgtctgtgtttctgtaccattgggtgataacactagaatctcaaatttgggaacttttttgaaagtggggccatgcctaaatggtatcctagttgtctcttccaccatgaccccatgatggacctgcaaagtcccaaagatggaagaacattcaggggtagccagctggagagacctagaatcagagatctctcacacagcctgaaaagcccaaagcagatgagcataacctcagcacctgtgaaaccagaattcattgcttccattcagagatcccatgttcatgtcagaatccaagctgccacgagtgtttcatgaagtcacttatgactaatactgagtacaatgggactgatatcagaactaagctaggcccggagagccctgaggttgtgacacataaggctaaacctttgagttttgatccacagagtagatacatcagagaagtggacttggagaatcccctgctggagtcctagagagtaaccactctgtcagatagcatgtgtttctgagaggaaagcacaggggtctagttccagccgtatccctctgcaccccatatgcacgtgctgagttctagagagactccagagctggtctgaaaggctgatgcaaaggagtctgctctggaactgaagtgttataagaaactggcaagctcagcagccctacagataggtgaggagcccagagatgggagaggaagctattctcctggccaaggtcctgattcagtttgccagaatcataggcagacttgaggccgactggagctagcactggcagtggaattgaaacctcccctgtagtcccatagagaattttttttgtataaacatagaaattgacccttctgatcttaatgcttgaaacttttatttgttttatatgaatttcatccttagtaaaggacccctacgtccctcaaaaagtatcaaagaattgaaactcaccagatgatcccatccagacaatgggacaccagacccctcataaattatgattgcttccttaggtcgcctgagttcctgtttttctacacattgttacatttcttcactgctatgaaaactcataattttagttgatcagcaagacggatttgagaccgagcttgcatctcctctgctacagcatccaactcagccttcttccttggcaattggttatattgattggctttctgtgtggtgagctgcaggacctagaccacacccctggtgtttcagtaacagcttttggtttcccgaccaggaacactttggctcagttgccatgggccaggagtctcacagaactactaagcagctgcttacccaattttggctggagagataagtaccctctggggccaccacagctggccccaaccatggtcctgattgccttggaagaactgcctttggaatttcacatcggcatccagataggtgactgtcctttgtgggcccagacagaaagatctgctcctctcagtttgggaaatttttaaaggaatttccacttgcgggttgaataagcccaactgacgaagagaggaaaataccctgactgtttcagtatggacattcttgggggcttgtttgtcattgtgtgtgtgtccaggcaagtgagtgtcttttgtgggtactagatagtgggatcagctcctctccatttgagaaattctgaaggaattttgatttgcaggttgattgagcccaaccaatggagagaggaatcaccccaactgtttcagtttgtagacttttggggcttgtttgatgctgcaacagttggattgttttagtgattgtttgcaagtgtctgatatagtcatcagaaatcagaatttaataaactgacactcttttgtaacactgtttgaccccagtatagtttggaatctggtatttgcccttgaatgggaaagtgggttggagttccatgtatccaggcttttgtgctgctgctgttgggccaagttagtatgtgatattctcctgtggtgctgtttgaccccagtgttctttggagtctggagaactttggactttaaaaattaaactgccacggaaactgttttactgaaaattttggttcacagccttcactggattacctatcaaggctaacaaagttcagccatgtgaacatgtttgcagactgatgagtttctatttcaatagctagagttccaaggtaaaagctattggatctttgggtgtatgtatgtctagatgtgtctttgggtgtatgtatgtctagatgtgttaatgtgtaggcatatgtattacgttaaatgttgtgactacccaattggattataaataaaagagtgctcatagattaagtaaacaagtccaaagtatttttcatgttcatgctacttaagtaaatctttagcaagctagcattaaaattttgtaaaataaaactagaaatgtcatcatagttgtcagcatacatttttgtctgggttttgtatttgtttctgctagatattttgaggtatgagagtttggcacagaagtttataaagttgtcaccaggagttggagataagcctgggaaacagagaccccctcccccatctctataaaataaaaattaaacaattagccaagcacagtgattcatgcttgtagttccagctactcaggagactgagattggaggattgcttgagcctgaatgatcaaggcttcagtgagtcttgattcagccactgcactccaacctaggtgaaagagcgagaccctgtcaaaaagacaaatagaggcagagaatgacaatggggcacagaagcattgcagggagactaggggaggagtagtaattttttttattattattacactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccacgtgttctcattgttcaattcccatctatgagtgagaacatgcggtgtttggttttttgtccttgtgatagtttactgagaatgatgatttctagtttcatccatgtccctacaaaggacatgaactcgtcattttttatggctgcatagtattccatggtgtatatatgtgccacattttcttaatccagtctatcatttctggacatttgggttggttccaagtctttgctattgtgaatagtgccgcaataaacatacgtgtgcatgtgtctttatagcagcatgatttatagccatcccattactgggtatatacccaaaggggaggagtagtaatttttaataggatggccaaaggaggccttattgagcaggtggcttttaggtgaagacttaaagaaggtaatagagtttttataggtctaataagaaaacagaatgcaggcagaagaaaaagaacagccaagtgcctgaagcagagaggccaaagagagtgaggtctaggacctgactggacagatgtcagggaggtgactggagtctaacttagagaactgttataaacaatttgtacctctttctctaaatgagattgggagttgctgcaggagttgcacaaagacatgacaaaatctggcttttgttttaaaaggagcatcctcatttgttattgacggaagactaaaggcattctccatccagaaaagactgctaagaactgtgaagcatataaaagtttaccctacttggggcaatgtttcatgaatgctgacagataacacaagctttctgggtcaaagacagagttttatgactcattcaacagggagaatgatttttgtgtttgtgtcagtcatccttgctccacaagtcctacagaggaaatacagaaaggcagattaatgttgcaagtgcaacagatgtgtgttgaagccaaggaaccctgaatttaggtcacctggatgttttataatgaactgcaagcaaacctgtctgaactttgctccagagggggacattatctttcttatactgatcagtaagcagacctaccctctgcttcagaagaaagcaatatctctagcttccaagctgtcctctttagaaacatccttgaaaagatagtcaggagaaaaggctgtcaatgtctctgctcataagacatacagaaatgtgagaggccatgaagaattttctcccagccagaattagcaggatgtcataatggattggatgtaaagtgggaggggaaaagatacttaagaataactccaagaatttttctttgaacaggtgaagaaatggagttgccatcaactaagttgagaaagactacaggtgaagtaggctgggtggagagggtggataagaagattgatttgagacataatgagtttgagatggctattggaaggaatccaagagatgtcaaacaggccgttagatacatatgccttgagtttggaaaaaatttgagtagtaatttaaatgtattagtcattggcaggtagattgattttaaagctatgggaccagatgggatcaccgggaactctgaagtgatccaaaattaagaaactggggaggaaagaagggtccacagatgagactgagaaaaagtagtcagtaaagttaaagaaaaaacaagagagtgtgttgtcttggaaaccaagtccattaaaggatgatctattaagatgagaagcaataattgaccactggatttaataacacagagatccctgatggttttaaaaagtgtttcagtagaatggtagcagcaaaaacccaattagatgaggttaggagggggattggagatagcatgtatagacaatcctttcaataaattttgctacaaactgttgaaacaaactaattacagcctgagaaggactctgtacttcttcatttgagtccttgtgggtaaactgtaacgtagcttaatcatcagacaaaattgaaaacctaatttagtagtgtgcacctgtaacaatactccagtgttggccaatcccagcagccatacttcaactactcatagactgctgaatgttcaaactgtgttcaaataaggcaagcgcccagttgtaaccaatctctttgtttctgtacctgatttctggttcctgtacatcactttaccttttttgtctataaattcattttgaccacgaggcacccccggagcctcggtgaatctgctgtgattttgtaggctgccggattcacaaattgtttgttgcttaatgaaactcctttaagtttaattcagctgaagtttttcttttatcagatggtgtcacaagaaggatctgaagtggagcttctagtatccccaggagcgcgaagtgaacacggaaggtacctgcaggatccaattgtgtccattgatctctcagagtggctgaggataataggtaagctccctctcgcattttggagcttcacacgttggtgttttgagctctctgagttgcttggagcaaatttctgatccaaactgggtttggagtcacaacaggaaacagactgggtctaggaacagatttgatcttggaattaactggcctggatccagttagaggcctcttacatctcactgggtcagaaaggaactggtagtaagcagtaatgttgcaggagttataaaatttggcttttgaaaattcacagggatttttgtgttctacccctttgtttcttttcttttcttttttttttttgtgcgcctaggtaggaaaaaaatcactggctaagttcatcaagagaacctaagaataaagacaatattttagataaaaatgggatccttaatttctgtaaaactgagttccttctggcttatacattaggactgtataccaagtcttacagaaatggcaaaacattactaaagatacttagagtggaacattccaaatgaacaacaatgccaatgcatttaaacaacaatgccaagtacatttataaatgagggctctcagtaaagtctctttgactaaaaacagttttggcactattggatgtcaactgctattctttttggaataatctgccttgcactctttgttgactgctgtgggtgacaggatgaggcatgtacagaattgtggtgaatggggagctttttccttctccctacaaataaagaaacttgatagctgatgggactgtggggaaaaaagaaaaaaatatatagcatttattctgttttcataattctcatatttaactatggttccattgccttccatgtttttttcaatcttgcataaaaataaaaacatctcaatggtacaaactaaaattctcaaataagaaataaatcacacatactttcaccacccaaaaacaattttcatgtttatttattcccttcaagtccttgtccacatgcaaacataatttgggtacatatgtaaaagttatatattttgatatttttacccattattcattataattgcttttctgtagtcttcacagtgaccactgactgtgtgctactcatatttacagactgtcattcacaaatttataatttctctttagtggacattaaacttattttccatatattatgaaaaattattttagttaaggaatgaaattctgatacataatacaacagatgtgaaccttgaaaacattatgctaagtgaaataagccagacccaaatggaccaatatcatcggattccatgatatatgaagtacccagaataggcaaattcctagagaaataaagtaaaagttattttatatacatatataaaatatatatattatatataggggtatatatatatatacccctagccaggggctagggagagagggaatgagtaattgtgatttcatgggtatagttgccatttaggatgacaaaaaggctctggaaatggataagcaccatgaatgtatacaataccgctgcattgtacgcttaaaaatggttaaacggttagttttgtgttatgtgtcctttacaacgatttttttaaagaaggtggggaggggtctccccaggtttttagcagcttcctgatttagaaaagaaatgttgatggtaggaatacaggtagagaacacttttatttgggtagatgttagaagctgaggccagggtggggtcacaagagcaatattaagtatgaggagaggccctcaacaaaggtcattgcaaggggatggagtagggaatgcacaggaggggtattttggacaaagattggcagctgataggtgtgggtattgttctcatgtatcagcccaggatataatgttcccagggcaaatggaacacaagtttttttgcggggagtgatatagcatggtagatcttgaattaaaacttttaaaatcttgaccaaaagctcaaaggagaagacaatagtgaaacacatgggtatgggcaattttagttaaatcaggtgagaaacagagcaaagaaagcacttggagatggggggaagaaaaagaccattttttttttgacagctacaagaacagcagagtcagacaggggataggctcatgtcagagatccagttttatttactaaaagttccttgggtattcaaacattctgaaattatgagatcttgcaaaaggatgcctttgtttaaacattgcttcatctagctacagaacatagtttaactttgaggcctttgaccccagacaagataaaatatgtttcaccttgcctattacttaacacatatttgttaactattttaacttcatggataaaaaatttcaaaaatctgtgttaactgatttgcaaatgattgtttcaaatatctgattcgtgggttccttctcttacattaattttgttgtaagttcttcacatttttaattatttttacatcattgaatataattgctaaatctctatatgacatgttgattaatatgaagtcaattaaaaaaactaacatatattaaaacttgttcttactttattccaggcataatgctatgcattttatacatattacattgtgtaatctcaatcctttggaaaacatgcattctaatttccagttccaaagttgtgagaaaacactttgaggttctgattggttaagcaacttaacaaagaagtatgagatggaactaaaatttgaaatcagcctaagctttgaacctatcagttgtgatgatcaccttctccaagttattgttaaattattggcacatttctaagaattctgaatgatatttcaacaaaagtttacagatatgtgttaaaatttttctatctgtttttaatttttgtaatgaaactgggataagttccaaaatggccgtaggtttgaaatatttggccctgagaaactaaagaaaatctatgcctactcctgctccaagttttttagtcatacctgttcttagagggctgatattttctgttgcagatgaaagaagaattctcaggcatataatgaccaaaatacaggaaaaaacttatgatggtagtggtggagtgttctgttacaggcatttgggaagctcacagaactcttaatattcacttttaattctttccacaagggaggaagggcatgggttttggagacagtcatatatggtttcaaaatctgactctggcatttatctctaagaacttgagaaatttacttagtccctctgagatttggtgtattcagaatgaatatgatactaacagtacctacatcacgagtgttacttgaatggagatgtataaagtgcattttaaattcatttgtttccttaacattttcccttcatttcttatcttttcagagtttcttcttcaaggtctcaaggtctgaagcatcccacagaatgatcctactgaataactcccataagctgctggccctatacaaatccttggccaggagcatccctgagtccctgaaggtcagggaacagtgggaggtcagggtatgggagtaggggtgttgaggatgagaaaatagcaggcttgtgattctagtccttcctgactgtttgcagagggttggagctgggaaacaggatgggactgggggcacaggctgcatatcaagagctgctgcttctctttgggaagaggcagctaggtccactctgcaggttttgccactcatttggagaggcagtggagcatggtggctacgaacatggtttggagcctgtctgaatggatatgcattccaaggctgccattttctagtcagatggctttgtggatgtttctttccctttctctgactttacgtttggtttttccatcaatgagatgggaataacgttagcacctacctcttaaagttgctatggacactgaataaatctatacaatataaatgctaagagcattgccaagtgcccagctagtacacagtagctctttggtatcacaaggacagtcctacctgtgagttctgcctgcttgctggtaacttcacgtccatcagtatggtcctctccaggaccatactgctcatctcaccatcactgacttggtctcagtaccttctcttaatctccatttttctcttcctcttcacaaccagatcctcatctctggggatctcaacctctcctggtccctttcatccctccttcaggtgtatggctctgtgtatcacatcaatcacgggaaccccttcaacatggaggtgctggtggattcctggcctgaatatcagatggttattatccggcctcaaaagcaggtaggcacacagacagggactggtggagccaggcaggtccacagggcctgaggaactgaccagttcagacaccatggctgcttttatagggtgaaaggaaacgtgagtattttaaaacactccttcagtactgggcaccttgcatgagtgccacgtgttcccacccttcgtgtaaagcataggactcttctgggaaagggggtggaggaggaaagggaggaaaaggacaaggctgacactcacagattaagggccctatgaggtggcaggggtcacctgcaggggctgaaaggaggccaatttacagggaaagttgggtgtctgagatattagaacagtggcttagaaacagaaaccaaggcataagtctaccagtaaaattacctctcagggccaggcatggtgtcttctacctgtaatcccagcattttgggaggccaaggcaggaggatcacttgagtccaggagtttgagaccagcctgtacaacatagtgagacctcatctctacagaaaataaacaaaattagcagggcatggtggtgcatgtttatactcctagctactcaggaggctgaggtgggaggatggcttgagccccagaaggtcgaggttgcattgagccaagatcacaccactgtactgaagcctgggcaacagagtgagaccctgttgtttttgttttgtttttcaaaaaaaaaagttacttcttaggaaccagggaagggactcataattactgtgtgtcaactgtgtggaagcacttctctcgttagtgaatgttatcatcagaacaatcttatgaagtgagcattaatatctccaatttacagataaggaaacaacattgagaaatattaagtcatgtagcggctggattcctgatgttaaagcattgcccagtctgaattcaagtgcagtggactctaccacttttactagctatataaccataggcacttctgtgagtttcatcatccgttaaaatggggaaaataagaggatcttcttcagaggattacacaaggtttaaatgagatactgtatgttaaacacttagtacatagcacataactgtaaatagtgtttacaataattagccattattggctgaggacacacaaggaataaatgatggagctgaaatggtaatacaaacctaggtgtatttttttcctaaatacttcccctttgtgtttgtgtgtttcatacacatctggttagtaaactgaagcctcattgccagcccaacttcatgtaggtgtaaacgctgagcccccaaataataataagccacaccaggtcaagactagtttgcaaactgggtcaggattcggatgcagaaagtgacaaagtgaccctagcttgaggaacaaaggggtaaaggggatgggaaccaggctgagcctaacaccttcctcagggatgttcttttgatctcctggcttcctgacaatttgggatcaaagattaatgtttagtttatttaatcaatggtccaatttcttcaaagtgtggtatgctagataactgtaggaagtcaaatagttccttttacttcagtaactttgtagttattatatgtattttagcaacgtaactatagcatcaagccataccttcatgtatgcattgctttgaacaaagttagtttttacagtgagtcaataaacaaaaatatgaaaatataaaagtcccacaccacacatataagaccaaaaaaaaaacaaaaaggaaagaatgaaatacgctgcaatttacttggaagtgcattcacctagtctgattccatagcataccatgtttctttcagtattgaaagtcaatctgattttgaataagagcttttcagggtgggatgcaggagaatttatctagaaaaaaattaattttttcattgttgatttttaatcacaaagataatctatgttgattatacaagtaaaaaaatccaacatgattttaaaaagttaataacctcttacctcccctcccctcctctcctcctttcctaccccttggttgtaatcagtgtccttgcccatattaatacacagaaggaatcccagcactttgggaggccgaggcaggcggatcacgaggtcaggagatcgagaccacggtgaaaccctgtctctactaaaaatacaaaaaaaaaaaaaaaaaaaaaaaaaaaattagccgggcgtggtggcgggcgcctgtagtcccaactacttgggaggctgaggccggagaatggcgtgaaaccgggaggcggagcttgcagtgagctgagatcccgccgctgcactccagccttgggcgacggagcgagactccgtctaaaaaaaaaaaaacaaaaaaataaacagagggatattcactgatgatctcttttgtcatcactcttaatttgcctttaacatatggacatcactttgggtgaatcaatacagcactaaagtattcgttttaataactgcggcatttcatagagtcaatgcaatgctatttagtcaatcattctcctgctgttgggttcaaactgttcatacttctttgccactacaaacaagcttcaataaacatcttcatatacatatctttatatcctggaaatttttctcagtacaactgatttccaaaaggaatatctgcaagttacagtttatcttattctaagcaggcaatgccaaattaccttcccaaaggattccacaattttatttttattagcaatgtatggaagaattgtttccccacattctcacgagcactgaatattatccctcttttaatttatcccaaactggtgggtgaaaaatggcatcttattgtggatttaatttgcatttccctgactagcgatattgaacatattatattttcatgtttctcggtcatttggtgtttacttttgacctgtttatattctttgaccacttttacactggggttttgtgtcattcttaaaattttgtaagtgttttggaaactagggatactaaaaaaaggtgtatgctacaaatttgttgcccaatttataattattttctattttattgatggagattttgacattaagaaattttttattttcatgtaatcaaatatattatctttttcactatgacttctgaggttttgggtttttttagttaataattaggaagatttttgctactcgaagatcatacaactgttttctcattttgtcttacagtgagttaattgttacttttgacattgcaaacttcattctatttggaatatatttttgaatagcatgaattaacattcttttatattaatcttccttatggctggctaattatgttagtaccatttcttaaataagtcattccctactgaaatataaatgtctattttgtcatataacatgttatatatttttgtatctgtttctgtattttttctagtcttttctcatgctatttcattgtttctgtggtaaattttaatatctaataaagcaaatcacccttcaccaatctttttttactttcctatttcttataaacttaatagctatatgaacataaactaattcttccagttccccaccaactatcccaaataactattggagttgtgattggtattggaggagcatttttcgacaattttggaagaattaatatttttgtgacactaaattttttcatcaagaaatatggtctttttctcactttttttcagtttgcattctatgccatctggtaaaatgttagtgttttcctgtgataaactaagtgatttttccattaagtttacccttaggtattttatactatttgttaagattattaaattattttcctgttatatttctgagcattattattttgttattgctttgtgtttgtagtcttgatttccaaatatgtcccactgttgtttaaaatcctgtttgtgtggggcattatttgttttttttttttgtcgaagtctcttggattttctaaatgtgtaatactgtaatctacaaacaaagtaatttgctgctgctttgccagtatttgtatgggtttttagtttcttgcattattgcataatatgcaacctaaggaaacaattccaactaataatagttctatacttgtctcatccctgattttaaatagctataaaagcttacatttggaattacatttgattctgtatttgcaggtttagagcattttcctgttgctcctactttcatagaacttatatttagaatggagggtaaattttatgttatttaatttttgtcttttctatttggcaatttatacactcatgtaatttttttctcctctaatttattacactaaaagaccttccaatcaaagccatcctggcctttctaaaaccaactgttcatattcacattttttgtatatgctactgaatattttattcataatttttgtatctgcatgcataagggaatgttgtcataactctctttttgttatttccttaccagatttggcattaggatcttttcatctgttaccaaagtctactattaaaatcatgtgtttgtttttggcttatgtagaatttaaatgtaaaataatctgattttggctacattttattttttaatttcaacattctttttaaatacgggggtacatgtgcagatttgttacatgggaagattgcatgatgctgattcttggagtatggacagattccatcatcctggtagtgagcatagtacccaataggtagttttctaacccagccccttttactccaccctctggtagtccacactgtctattgttcctacatttatgcccatgtgtggtcaatgcttagctcccagttatgagtgagagcatgtgatatttgattttctgttacagcagtaatttgcttaggattattgcactgtggaaagtagtctggaaatttcttacagaaattaaaacagagttgccatccgatccagcaatgtctttactaggtaaatacccaaaagaaaatgaatcattctaccaacatgacacatgcacttgtatgttcattgctacacagttcacaatagcaaagacagggaatcaacccaggtgatcatcaaaggtagactggataaaaaaaacttgatacatatatttttatggaatactacacagcaatagaaaataataaaatcatgtcctttgtagcaacatggctgaagctggaggccataactcttgtctactttttaaaaggtagatgtttaatttcatttctgatattttctattagtttgttcaggatttctatttttttgcaagtcaatattgatagtttattcttgagggataacatccatttcttttatcagtaaatatcttgccttggagtagtatgtagtcttctattagaagtcttttgttcttttctctgtttcttctgtttctgttctcatagcttacagtctgttttttttttttttttgcttttttctctttctcttgtatttcttttaataaatgccttaccagaagtttatctctctctttcttcttctctctctgtttttgccatttaaaaatgaacttttggctttatatatcctttgcactatgtcttgttctccatttcattatttatagctttcatttttacaaattgttccatttgttattttctagtttactttgatattcttttatatatttccttgactatttacttggctatttttggtcattcttttaaaatcaggtcttttaaaacatctactcttctaaattcactgacgttttgggtttgaccatattcaggaacttgcatttataaaagcaccctgaaattcttgaaggtttctttaaattaattacactattttctctttaactctttagcaatacaatttccaacataatattaatacattcactgctaaaacgctcacacttattgtttatattttcccagagaaacatcctcatcttccaatgaagtttctgtcatgccagaatgggatcacgagtctctttctttcaaacccaagagtctaacaccacataaattacccagagagctaccaaaaaattcagttacatcattctattttgtgggcttctgggtgtaaagccagtgtcacttttcaaataggctgatatcctgtaggcttgagaaaaggcaaggtctcgttagtgtttatattcactaaagtatcttgctcaagccctggacaccgtagattctaggacactattgactctaggtgtctggtgaaacagtaggcactaaaaattagagaaatcacagttaaatttattttgagccaagtttaaggacttaactcttaacaacacaaactcagtacaacccagaatgtgtcccacagtaggttacctggggcacagtatatataacaggagtatccgtttggcacaggtggtaagagaagcagggagagaagcaattgttgcatttttttattctgctgggtgcttggtgatgctatatataaaatagggtatgtgtgcagttgagtgggtagggagaaaggtgaggcatcttaaggcctggtggagggtgactgatttcatcctgtcttagttctgcatgtgataaggaggtttataaccaatacttgtcagtgttaaatatttaacaaactccagttacacaggtaagaggtcagcggtagcttataggcctaggttttattatcgatgtgcccaactgcagccatcatgggccactgttaaaattttcttttgaactttcatttttctgataattgcaaccagtgagaggtgaagaaaaagttcaagggaatgacctgatcttatatcatccaatacaggagatgactgatgacatggattcatacacaaacgtatatcgtatgttctccaaagagcctcaaaaatcagaagaagttttgaaaaattgtgagatcgtaaactggaaacagagactccaaatccaaggtaacgagtctgaagaaatgggcaagcagctgtgcttctcaaattgtgtcttcaactaacagcattagcatcacctgagggctcattagaaatgtaaattcacagaaactctggggactgggagaggtggagcaatctgtggtgtgacaaggactccatctgactgtggtgtaaactcaagtttgagaactactaagcactgaggtattaatcaggtgggagcagtgtaagtagagaactccatgtctgacaagattgctttcttggctttcttcccaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaaggtacaaaaacatgtgctgatcatttataattgcgattccttgtacatttttgtaattcacataaatcagttttggaatgaagagaggatgaattcattccttgggatgaataaaggttgtcaaagttcaagatccaaaactttgcaatggtgagtctttaaacaagaagagttcctgggatctctagattgggatggcacctagaaattacaggattggggatgaaagttgttgtctttctttttgttgtctacagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatcaaaaatgaatgtccctgctatttctggatttatgaggcaatggtacactaaagaatggaatcagttcagtgaatagaaaggtatccaaggtgaagcctgagacgaatggctttcccaggctaccttccatcactgttgtacagaaaagaaatccagagaatcaaatggactggccttgggggtctctgctatggaaatgccattttttgtgtctcctttctcctactctttctcacatcctcttcatgattgaagcatggcacaaggcaaggtgttgcctgcgagtctggttgtaagttcagcctttggtgtttgcactactgctatcataaggggtcagggacattccggggagaagtgaccactaaggtgaggattagagagtgagtagaagtgagccagacaaaaaaagcagaaaatgcagatgatggaaaggacatgtgccatgcactatcataagaacttcctaactgaacactgatactacaattctgaatccctgatcttaaaaaataattatacttcaccaacaaaacttggcctcttttggttccactctgccaccctgccattggaacttggattactgtgaacattgcagctatagcaaaataaaaaataaaaaaaataaataattggcattttcattctttctgatagtctagatttgaagcagaaaagatactttaatagaattggctttggaagtaaagtctgccagtattaagaaacacctattttcatctctccataaaaaacaaaacttccacaaaattgaatgtttatatttgatgcgattttaaagtgtgcaattccagcaattaaagaattgtgtaggtcatggagcatttttaaaaaacttcatcttagaaggctgtggtagatctgttaccgcttagtatgaatcaatccaatcagatttctaaactcctaagacctggctgatttgttacattgactgaaatgaaagcatggtctgagaaagagaggaaacatgtcatttgggatttcaaaggttggaacattcttacataaaaaataaactcgggaacttggggtaatatgaaaacagctatatttttcactcaagatgcaaaagctaataaagatgatgaaagaagacaaagcaaataaaatttgcctatttcaaaatggtgcctcgggcaggtcctgtatccagaagaggatgctcatccagggtctgtaagctcaggtcatcttagctcagcccagctggcagcttccctcctctgccccttccctgaatgcaagccagcttcccttatctagcccttcatggtcctgttacgatagtgattcccaaaccttatcatccacttggattaaaaaaacacaagaaagcatgggaaagaggaaggaggatttcttaaatatggcaaaaataagtccaaaattatcagtaaacacaatacagatgaatggggtaatttttttattaaaacatatgtttttcatattgagttaaaaacaaagtccaagaagcatgcattaatctgctctggctgccataacaaagtttcatacactgagtagcttacacaacagaaattgatttctcactcgtttggaaaccgggaagggatatgacaaggttctggcgaggtaggtttcattctcagtcctcctctctcagcttgttgatggctgctctctctctgtgccctcacatggtgtagaggagggctcagactctcttccttttcttagaaggacttagtgtcatcatgggggctccaccctcatgacgtcatctaaactcaattacgtctgaaaggcccacctccaaatacatttggagttgggacttcaacatatgaatttggggatcacagtcagtacataagaaagcacatctgaaataaaaacacaaaggctaaaagaaaggaaaaagatatactaaatgattttgaaactgaaaaagcaaagtaataacatcaatactaagcaaaacagaacttaagacgaaaatctgctaaatacagaattctcccacaagataagtcatgaatcttcctcacaacacaactacaaaatacatatggcaaaagctgacatacaaaaagaaataggcaaatccacagtctcagtaggagaactcaaaatacttccctcagaaagcaacagatgatgccgataacaaagacaacttgacaaaatgccatcacaagttgatatttctggtgatgttggggttatctgcttactgtgtatttgagaacttctgttcatctgtttgtcaaactgaccagcagggggtgctggggagggaaacactccacagggagggtggggaaagttctctaagtctagaggctcctggtccccccatgatcatcatctatcaggggcaagcactgctgatacaggagctaaaaaaatcaattatttaggcagttagtgtgggtaagggagtcgttggtaaggttttccttttaataaaaaagcagcccccatctaattttgttttctaacaacaatcagcctgaaaaatcagctgcaagcatagataagcaagctaaaacttgcaaaggggaatgccggcacctatgccaatagaaaagggatacttggaagccaggcatactcgcatgttcaacatggaggtgtcctcttctttttttttttttttttttttttgacggagtctcgctctgttgcccatgctggagtggagtggggcgatgtcggctcactgcaccctctgcctcccgggttcaagcagctctctacctcagcctcctgagtggctgggatttcaggagcccaccaacaggcccggctaaatttttttttttttgtattttttttagtggagacgaggtttcaccatcttggccaagctggtcttgaactcctgacctcgtgatccaccctcctcgccctcagaaagtgcggtgattacaggcgtgagctacggcgccctgcctcttcttcccttttctttgtcttcaagtgttcaggcaacatggcgctggccagatagagaccccatctgcataataaaagattaggatgggatggccagcctcttcgtgcattcacacctggtccaaccaaccctctgagccctgtgtaaatcagacactggctcctcaagctcatctataaaaccagccgcaacttgccccaaacccagaaacccgctcaggcacccttccaatgcacagggaactctctcttctttcttttgcctattaaccttccactcttaaatccactccttctgtgtctacatcttcaatttccttattgtgagacaaaaagcctctggcatttacccaaatgattctgcttcactgccatctctagcccaagtgccaaaaatgaccactttagcctgatgaatgccacggctgctaccatgctgcttaggacaagcaaggatacaaagatggactggggaatggtttatcagagaggccgcaatgaaagcatatcccatgcaactttccacttcttaacttctgtcattttcaaacttaaaggtttttttttttatttttatgttttgttgttgttgttttgtttttaacagtttctatttctggcccaaagacttctctttgttttcctcctatgacatatttattgtttgttctaaagtcctttccaacatttcctatagtaatttagaagacatgtgtttggttcacatcttgatctcctctccacctagaattctttttactttctcccaggaagattccacccctcctattctgccagttccctctacctcaaacagttgccctttcaggcagataagcctgggccagttctactttactatggacaccaactcttctgaaataacatctgagtcttgggatttgcatatgaatcttcccttgacacagaaaacagtctttccttttaccttcactaaaggcatacacttgggagaatggacagcactaaaattccacaggtttcaaaaccaaacgtgctgtgccattctagagttcttggaatgaagacgacaaagtaggttagaagggatgatttcctccttcctttgtcaccatgaaggagctcctgtttttaaagggaaaaattaacgacagtccaaaagaaactcttgcaaatcaagccttgccatgccaccacgagaagggtaatctgtgtgcctaggggtgaaatttttaaatttttgtaacggtgtccagggtcaccctgtggataacaaaaatatttaaaaacctacaccggtgccaacctttcagaactgtgtgtctttgcaaggacttaccaaggcctagagatgatagcagtctacaggcaaactccaaagcctcccacctgccccaaccaacacacacacacacacacacacacaaacaccaccctgctattctttggccctagatctcacttaaatttattctaaatcttaatctccctgtgccttcaaactcatgtgttgtacagccttggtaattgctttttaaggatattccctgactttataaaaactatttatgagacatatatctaaggtaaaacttttcatttcagcccagatcagcactctttttattagaattacaaatcctgaatttcttagttgctagaaaaatatattgaaaaggaattatgcttgtatagcaacggattatctctggaaaagtactgggtgtctagaggatgagtgaaaattgtttcccctatatatatttttttatttcgaaaagtatatcctgtgtatattcaaaagataacattttataaacagggaaattgcctccactgtggactcttattaattcacttatccaccaagttctcttattaactgacttatccatcatattcccttattaactttttattcaaccactagtatatgcttctattgctcataattgagcacaaatttctttactattatataaaataaagtgccagctattccactttttctcccatacctcaatgagatgacatcttccaatagattcatttccctgttttgctccctcctcccatccagatgagtgtgctaagtgatacaaaatgcttttatttctttacccctcatccccctgagcccaatccctggatgttttatttccaggtgtcatagaattttccttgtggtgtgtcgcttctatttaaagaattcttctttaaaacttttatacacattcctgtagagtctatcattgtccattcagagttaactgtctacataaaatttgtcagattttttttggctcaccactgtttcttctcctttttatctgctcctatttgagatctctgttcccatttgatttgttaaaattctttctccaatattttctgtgtgtaattatgctacttatatgatagctgaagactctcaaattcacaaatacctttctttgatcctcacaagaatataacttctgaagtcttatatatccacaaatatttttcttttaccctcaggggattgatgccctatgaccccacattttaggcttaacaaatttaatttttttctcttaatacataaggaaactgaggtgcaaagaaagaagggaaacttgaaccttcattcaaggtcacaaagctagtaagaagtggatgactagcgatgagggtttcaggttgagattaacaacaaatgtcacagaagacaatagtgtttaacccaacttcaagttcataaaatgaatggacgtttcctgatccctcaacttcctcccccacctcaggggatttcaggatgtaccaggcaaagctgtctccctcgatccccaactgtttctcagtcagtgaggggtgttaagaactcttcactgcccctcttgaagcttacattctggagcagggagagagaaactgaaaaaaaatttgaaaaaaaaaacccagtaaacatatttcctacatactgagatgtagtatatgaaaaaacaacacaggattcaggaagagaagatgatggagggagaaagaacaacaaataaataggaaaagagcctccagataggagaagataaaagggagaggaaacaggaaggggtcagaacaggcctccctaaaagcctggcatttgacagagtgctgcagaatgaagagagccaagcacataccaggggggtagggttgcagtctgaggaagcactccaggaagcacccaagatggtccactagggtgaacaaagaacatacttgaaccaccagttagattcaccttcatctaaaaaataagaaattaaatgtgcctgatatttatttaatatgttaatttcaaaactatatatatatatatagttgatgctcaaatcgttaaaaattaggtatgtaaaattaaagctcatagattactcttgcctatggcaaggagctcctgataggcaaggatacatctcacccatctctgtatcttcagaatccatcatattatgtggaacataataagtatcagtagtatgttggggggaaagatcgaaaccatgctgagcaccggaattctgtgtaaatctttcaaaaaaaaatctcttctactttatagcagagtcccttttcttttttatttttagtagcaactagccccacaccttgcagatgagctcctaagaaatgaatgggtgaatgaatgcgtggacagcgagatggatcagtgagtgaggaacagcgattcgcaggacctgcatgcattgaaatcctgacaaagcagcctctgcaagataaaagaccttaggctttgccgtttgacagaagttaaaattattcaagggctgtccttgggcaatttacttgaagtttcataatctgtgaaacagaaaatgaattaaataaaaagataattgagacaaacctataaaaagtgccaaagcaggatgcctggcattaagggacgcttcacacctgttatctctcaccctattctctcttcacccctactcccgcccggcagctccccgctgttagcaccagaaatagttatctgctaagaaaacgaaaagtgtaatgctggctttaccccgcgacgctttaaaaaactccaaaaacccagcgtgatggggggtaggtttgcctagacacagctgaggcagccttaataaactgagaggaaggttaattgtcaaagagggttgagccactaggagcagcagcaaccttggactaacaggtgtatcttcagcgagcacatgtcccagcacatgtccccacgcccatccttccatttagcgccacaaacgcagcctcttaagagaatgggaagtttgggagtcacagaacggaagctaccattggccttaatggatgtcaaccattaaggtaagcttgggagtcggagaacggaagctaccattggttttagtgaatgtcaatcttcacccgccacttttcttcctggcctccttgccccttcctattctgctggctagttctctctcgtcatctgctggccgcactcgggaacataccaaacgcggaaacgcgccttagcttgccctgaatacctgcaaaccgagggctcggcgtggtttttaaaggcttggctagcgtgcccccggcggtactaaaagagggctgcttgcgccaatctcattcccacaggatgcaagtacagaagcagagcggacgcccggaaggggtcacagagagacaggcggggcggttgaccagctgactggactcactttggagaaatgcaaattaccgagccacagtccaaccaatggtatcaaaacagaatctctacagatgtagctcagcgaagatgaatctcggcctcaccccagagaaattaaatatattgggggtacccagaatccccattttaaaaaacctatccaagtgataagtttgaacattaaagtacagagaatcacaaactggcagaactctttaacttacaaaaaggtaatgaagaccccccaagaggaaaaggaatttgcccaaggtctccctgcaagatcctaagaaaacatgaggctctaaggttaaaaacctaactgacaaccattccctcccgcaactcgtcctctgacctctagcaaactatcctgtcctaatctgtgaaataggagcaacagttacacctatcccagcaggtggctgcaaatatcaaatgggaccaaaatgagtcaactaccaagcaccacccgactggaactacaggttgaactaaatcttgatcgccctacccctgttcatctcccagtaccactgtatgaaggtggaggtgaagcctgtcttgaagagagagagaggctccttggagcctctggagtccgaaggtagatgttaccttcctcttgagtgcattgtcttcctaagataggatggacaacagggtctatatggaaagtgttggctgtcagggcttcaagtctggctcctaagctgttgctggagggttagagaccccactccagctctctctaaaatgagggcagcttgttagcaagagtgagtgaggtgagccctctatgaacccatgggaggagagaaaacgagcatcccatataagcttttacataccccattgcaagctccataatgtggtgcccaggcccttatctctaacccatccccagaagccaattctccttagcccttcctgccacttcttccattgtacatccagatggttcccttcttctcttctatcaaactcctactcatctctcatccatcaagcccaaatataaatctttctctgtgatatactcgcaagttagaggcagtggtgccttcctctgtattcccagaacatgttgtttgcaactctaaatacagacatcagcctactgttagggttcaggagcatcttttaggagttcatggggaaatcactttccataaatgctggccttattccctaacttcaccagacctgaccttagtgcttcatccattcccacctctcctgaccatgtaagaggccttttcttcttattggtttgaaaaacacaaaatgacccaaccaccagttatgtggccaaaagaattcttgtcacattataatcaaatccagccaacaagatgctttgtggcaagtgaacgttccttttcagggcaaacactgtccccaggaatgtgagacaacttccacagccccatataagtattagctggaagtgaggcttcgttggtggctcaaaagattccctgagcacccctacgctgtcgctgatgtcaaattgcagtgggattgcatcaaatctctcagagcacagctgcaaagagaaacgcaaagctagagctctactctggacccatagctctaggcagttagtttctctgtgaggttcaattttatacataaggaagaaatggaagattgctaccaaaaatgacatcatgttacttattctaatcgtgtggttcagttgctactccagtgatgagcaagtaaagaggaattagaagcatgactattcctaggctcaaggagcagggaagttctggaattgggtgtgtggcagtgctgcttggagtgccattacaaaggggcaagactggttcactgggaggtaaaatatagggcacctaagagacaaggggtctgggaaacaaggcagacttttgtagttatcatttgctctgatatctctccacgaactttcttctcccttttaattttctctgtactttaattacatttctttttagggacaggcccccaaatctggccataatctggccccaaaactggccataaacaaaatctctgcagcaccgtgacatgttcgtgatggccatgaagtccacgctgagggttgtgggtttactggaatgagggcaaggaacacctggcccacccagggaggaaaactgcttaaaggcgttcctaagccacaagcaatagcataagccatctgtgccttaaggaaatgttcctactgcagataactagccagagcccatccctctgttttggcacattcctttgttttctgcaaggaatacttttagttaatctataatctataatctatagaaacaatgtttatcactggcttgctgtcaataaatatatgggtaagtctctgtttgaggctctcagctctgaaggctgtgagacccctgattcccactccacacactgtatttctgtgtgtgtgtctttaattcctctagtgcgactgggttagggtatccacgactgagctggtcttggcaatttctcaggcctggcatggtggctcacatctgtaatcccagcactttgggaggctgaggcgggcagagcacctgaagtcaggagtttgaccctagcctggccaacatggtgaaatcccatccctaccaaaaacacaaaaattagccaggcatggtggcaagcacctgtaataccagctgctcaggaggctgaggcatgagaatcgcttgaacccaggaggtggaggttgcagtgaactgagatcatgccactgcactccagcctgggcaatagagcaagaccctgtctcaaaaaaaaaaaaaaaaaagacttctcagttaatgaacaacattgttaccatcataagtcctagcttccctctctttctccctccatgtgtcttttatttttatctatgttcttctctcccagattcaccctctggccccttcttaaggctccgtgggcattcaccctcacgtgttgaatgtccacttccctccttattttttaactggcatggattagcatctcaaagtcaacaggtcaaaagtagaattactgatacacacacacatacacacacacacacagcccaatcctggcatacacagcgtctccttcctcagtcttccccatatcagttaatggagactttatccttctagttgcttaagtcaaaagcccaggaatcatcactgagccctctttttctcttatttatggaacatccataagcaaattccatgtgctggcctttcaaaatatatgtggaatccagccatttctaacacctccaccattaccacctgaggccgggctccgaaatctttgcaatcctgggacagactcttagccgccttctcccttccacatctcctcttgtcctcccagagtttgtcccccacgcagctgccagagtgattttttaaaatatgtcaggttatattactcccttgtttcaaatcctccatttaaaataaatttcacatttaaaacaaaatccagacttcttcatatggctgaccaggtgctttatgctaatggaatgtgcagatgctcctccctaaggagtgcttctttccagggcaaattatctccagtgatgtcaggcaatttcaacaacaccattctctaccacctcttgctcttcatagctttttttctccagattctataatgaaaagaaaatcaagtttccttgtgcaatgatttactctccgatgtatattggtgccagtcacttatactgctttcagatgattcaagaataacagcgatttgagaaagctgtccttaagttttctcttctgtttttctgtataatattatttttacaattatacttccaaagttttctctttccaagcaccacaacacccgtgtaatttaagcagtgatttcaggggtctctctatattttacattaatttcagaaacatgctcttgattattccaccaaaaccatcaacttttacatcaacatctgtccttctatgagttacaaaataattgtcaccatcccccccttaatcaaccatcgtctccccttctttgaccaacttttcaaacacccaatactgaaagcatctccttctattcaggttcttagatagtaagacgttctgttcttaaacagtaagatgttttctcaagccccatgcaaagcacttctttgatcatcactttggggatacccaactctggcgtcttcatcaggagggtaaagttccacactcagtaatgcgcgtcctgagaacaatgcctaagcagtgctggccgcttccttatccaggctggcattgtctgtgttcaccagcccgtccgggaagttggatcatttgcggagcaggccaagtccctctagccctcacgcaggcgtgggtacagcctgctctggaacttgcagtaggctggagtctgggcttctgcatcatcaggattgagctctctctgctgctgccaacggatcccgcctgggtgctagtcccgccaccgccgctcaccccacagcggcagaatggcagcaagtgccacacaccaaagcaccggggcgggatatttgccctgcagctcccgccagcgcgctgctctgacgcaaacaaaacgcggggaaagcgcgaaaccgccaggtgcctcccactcagggatgtcagggaggtgactggggtctaagtcatggagaacttagaggggctgttacaaggaatttgtgtctctctgaatgagactgggtgttacccctgcagtagcaggggttgcacaaaggaataacaaaatctggcttttgttttaaaaggagcattctgtttttccattgagaaaagactaaagacattctccatccagaaaagactgccaggaactctgaagtatctaaaagcttaccctacttggagcacagtttcataaatgctggcagatgacacaagcctcctggatcaaagacagtattttatgattcattcaacaggcagaatgatttttgtgtttgtgtcagtcatccttgctccataagtcctgcagaggtaatacagaacagcagattaatgttgcaaatgcaatagttgtgtgttgcagccaaggaaccctgaatttagggaacacgtatgttttataatgaactgcaagcaaacctatctgaactttgctccagaggaagacattatcttttttatacttaacagtaagcaaacctgccctctgcttcagaagaaaacagtatctctagcttccaagctgtcctctttacaaacatccttgaaaagctagtcaggagcaaagactgtcaaagtctctgctcataagatatgcagaaatgtgagaggtcatgaagaattttcctccaaccagaattatcaggatgtcataatggattggatgtaaagtgggaggggaaaagatacttaagaataactccaaatgttttcatttgaacaagggaaaagatggagttgccatcaactaagttgagaaagactacaggtaaagcaggctgggtggagagggtggataaggagttcgatctgagacataatgagtttgagatggctactggagggaatccaggagatgtcaaacaggccattagataaatatgttttgagtttggaaatgagtttgagtaataatataaatgtattagtcattggcaggtagattgatattaaaggcatgggatcagatgggataaccagggagtaagtgtggataaaaatgagggccaattattgaactcagaggtgatccaaaatgaagaaattggggagaaaagaagggtccacagaggagactgagaagaagtaacaagtgaagctaaaagaagaccaagagagtgtgttttcttggaaagaagtgaagaaagttctttaaaggatgagctattaagatgagaaataataattgactcttggatttaataacataggctttaaaaagtgtttcagtagaatggtagcagcaaaatcccaattagataagtttaggagggggattggagatagcatgtatagacaatcctttcagtgaattttgccacaaagtgttaaagcaaactaaatatggcctcagaaggactctgtacttctgcatttgagtcctcatgggggaactgtaacctaccttaatagtcagacaaaattgaaaacctaatttagtagtgtgcacttgtgacaatgcttgagtgttagccaatcccagcagccatacttcagccactcatagactactgaatgttcaaactgtgttcaaataaagcaaatgcccagttgttaccaatctcactgtgtctgtacctcacttcctgtttctgtacgtcactttaccttttttggtctataaattcgttttgaccatgaggcaccccgggaggctctgtgaatctgctgtgattctgaaggctgccggattcacaaattgttcattgctcaattatattcctttaaatttaattcagctgaagtttttattttatcagattatgtcagaagcaaatccgaagtggagtttctagtatacccaggagcacttagtaaacatggaaggtacctgcaggatccacttgtgtccattgatctctcagagtggctgagaatcacaggtaagcttaatctcacattttggagcttcacacatttgtgtttggagctgagtttctttgagcaaatttctgatccaaactgggtttggagttgcaacagaaaatggactgggtctaggaacggatttgatctgggaattaactggcttggatccagttagatgccatttatgtctcactcagtcagaaagaaactggtagtaagcagcaatttacaggagttataaaatttaacttttgacaattcgctgggatttttgtattctaccccctttgttttgtgtgtgtgtgtgtgtgtgtgtgtgtgtgcacctagggaggaaaaaaatcattggctaagttaatcaagagagcctgagagtaaagccagtatttagaggtaaaaattgaatccttaatttcaggaaaactgagttccttctggcttatacattaggcctcggaggcagcaaagtcttacagaaatggcaaaatcttactaaagataacttagagtggaacattccagttgaacaacaatgcattgaagtacatttaaaaatgagggctctcagtaaagtcttttttgtctaaacacaggtttggcactatgggatgtcaactgctattctctttcgaataatctgccttgcattctttgttgatggctgtgggtgacaggattaggcatgtaaagaatcatgatacatagggagcttttttcttccccttaaaagaggggaaacttgatagctgatgggactactgggaaaaaagaaaaatacagaaaaatagcatttattctgttttcataattctcatctttatggttctagtgccttccatgtttttttcaatcttgcataaaaataaaaacatgtcaatggtacaaaagaaaattctgaaataagaaggaaatcacacataattttgccacccaaaaacaactttcatgtttacttattcccttcaagaccttgtccacatgcatacatactttgggtagacatggacaagttatatattttgcttttttacacattatttattataactgcttttctatagtcttcccagtgaccactgactgtgtgctactgatatttactaactgtcattcacaaatttattatttctcttcagtggactttaaacttatttcccatatataatggaaaattattttagttatgaaatgtaattctgacacatgatacaacataggcaaacctcaaaaacattatgctaagtgaaataagccaggcctaaagggacaaatatcatagaattccatttatatgaagtacctagtattggcaaactcctaaagacataaagtaaaataaaagttattttgtgtatatatccctagccacgggctagggacagagggaatgagtaattgtggtttaatagatatagtttctgtttagtatgacaaaaacgttctggaaatgggtagtggtgatgcttatacagcattgtgaatgatcacaaaccactgcgttgtacgcttaaatatggttaaacagtaagttttgtgttatgagtaatttacaattttttaaaagagtatggggaggggtctacccaggattttaccagctaattgattcagaaaagaaatgttggggggcagttccaagatgggcgaataggaactgctccattctatagctcacagcgtgagtgacgcagaagatgggtgatttctgaattttctaactgaggtactaactgagggcttcatctcactggggcttgtcagacagtgggtgcaggacagtgggtgcagcccaccgagcatgagccaaagcagggcgagatatcacctcacccaggaagtgcaatgggtcagggaattccctttcctagccaagggaagctgttagagacagcacctggaaaatcgggtcactcccaccctaatactgcacttttccaatggtcttagcaaatggcacaccaggagattatatcctgtgcctggctcagagggacccacacccagggagactcactcattgctagcacagcagtctgagattgcactgcaaggcagcagcgaggctgggggaagggcatctgccattgctgaggcttgagtaggtaaacaaagcaccctggagcccaccgcagctcaaggaggcctgcctgcctctgtagactccacctctgggggcatggcatagccaagaaaaaggcagcagaaacatcagcagactgaaatgtccctgtctgacagctttgaagagagtggtggttctcccagcacagagtatgagatctgagaacggacagactacctcctcaagtgggtccctgacccccaagtagcctaactgggaggaatcccccagtaggggtagactgacacctcacatggccaggtacccctctgagacaaagcttccagaggaacgatcaggcagcacatttgctgttcagcaatatttgctgttctgcagcctccactgctgatacccaggcaaacagggtctggagtggacctccagcaaactccaacagacctgcagctgagagtcttgactgttagaaagaaaactaacaaacagaaagaacatccacaccaaaaccctatctgtacgtcaccattatcaaagaccaaaggtagataaaaccacaaagatggggaaaaatcagagcagaaaagctgaaaattctaaaaatcagagtgcctctcccactccaaaggaatgcagctcctcaacagcaacagaagaaagctggacatagaatgactttgcctagttgagagaagaaggcttcagatgatcaaacttatccgagctaaaggaggaagttccaacccatggcaaagaagctaaaaaccctgaaagaagattagacgaatggctaactagaataaccaatgtagagaagtccttaaatgacctgatggagcagaaaaacatggcaagagaactacgtgacgaatgcaaaagcttcagtagctgattcgatcaactggaagaaagggtatcagtgattgaagatcaaatgaatgaaatgaagtgagaagagaagtttagagaaaaaacagtaaaaagcaatgaacaaagcctccaagaaatatggtactaggtgaaaagaccaaatctccgtctgatgggtgtacctgaaagtgacagggagaatggaaccaagttggaaaacactctgcaggatattatccaggagaacttccccaacctagcaaggcaggccaacattcaaattcaggaaatacagagagtgtcacaaagatactcctcgagaagagcaagtccaggacacataattatcagattcaccaaagttgaaatgaaggaaaaaatgttaatggcagccagagagaaaggtcaggttccccacaaagggaagcatatgagactaacagtggatatctcaacagaaactctataagccataagagagtgggggctaatattgaacaatcttaaagaaaagaattttcaacccacaatttcatatccagccaaactaagcttcataagtgaaagagaactaaaatcctttacagaaaggcaaatgctgagatattttgtcaccaccaagcctgccctacaacagctcctgaaggaagcactaaacatggaaaggaacaaccagtaccagctactgcaaaaacatggcaaattgtaaagaccatcaatgctaggaagaaacgaatcaactaatgagcaaaatacccagctaacatcataatgacaggattaaattcacacataacaatcttagccgtaaatgtaaatgggctaaatgctccaattaaaagacacagactggcaaattagataaagaatcaagatccatcaatgtcctgtattcaggagacccatctcacatagacacatataggctcaaaataactcattttatgaggtcagcatcatcctgataccaaagccttccagaggcacaacaaaaaaagagaattttagaccaatatccctaatgaacatcgatgcaaatatccttaataaactactggcaaactgaatccagcagcacatcaaaacactaactcatcacaatcaagtgggcttcatccctgggatgcaaggctggttcaacatacacaaatcaataaacgtaatccagcatataaacagaaacaaagacaaaaaccacatgattatctcaatagatggacaaaagtccttcaacaaaattcaacgcccttcaagctaaaaactctcaataaattaggtattgatgggaagtatctcaaaataataagagctatttatgacaaacccacagccaatatcatactgaatgggcaaaaactggaagcattccctttgaaaactggcacaagacagggatgccctctctcaccactcctattcaacatagtgttagaagttctggccagggcaatcaggcaggagaaggaaataaagggtattcaattaggaaaagaggaagtcaaattgtccctgtttgcacattacatgattgtatatttagaaaaccccatcgtctcagccccaaatctccttaatctgataagcaacttcagcaaagtctcaggatagaaaatcaatgtgcaaaaatcacaagcattcttatgcaccaataacagacaaacggagagccaaatcatgagtgaaatcacattcacaattgcttcaaagagaataaaatacctaggaatccaacttacaagggatgtgaaggacctcttcaaggagaactatgaaccactgctcaacaaaataaaagaggacaccaacaaatggaagaacattctatgctcatggataggaagaattaatatcatgaaaatgcccatactgcccatggtaatttatagattcaatgccatccccgtcaagctaccaatgactttcttcacagaattggaaaaaactactttaaagttcatatggaacaaaaaaaaaaaagcccgcattgccaagtcaatcctaagccaaaagaacaaagctggagccatcatgctacctgacttcaaactatactacaaggctacagtaaccaaacagcatggtactggtaccaaaacagagatatagaccaatggaacagaacagagccctcagagataataccacacttctacaaccattggatctttgacaaacctgacaaaaacaagaaatggggaaaggattccctttttaataaatgatgctgggaaaactggctaatcatatgtagaaagctgaaactggatcccttccttacaccttatacaaaaattaattcaagatggatcaaacatttaaatgttagacctaaaaccataaaaaccctagaagaaaacctagcaataccattcaggacataggcacaggcaaggacttcatgtctaaaacaccaaaagcaatggccacaaaagccaaaactgacaaatgggatctaattaaactaaagagcttctgcacagcagaagaaactatcatcagagtgaacagacaacctagagaatgggagaaaatttttgcaacctattcatctgacaaagggctactatccagaatctacaaagaactcaaacaaatttacaagaaaaaaacaaacaaccccatcaaaatgtgggcaaaggatgtgaacagacctttctcaaaagaagacatttatgcagccaacagacacatgaaaaaatgctcatcatcatgggccatcagagaaatgcaaatcaaaaccacaatgagataccatctcacaccagttagaatggtgatcattaaaaattcaagaaacaacaggtgctggagaggatgtggagaaataggaacacttttacactgttggtggggctgtaaactagttgaaccattgtggaagacagtgtggcgattccttaaggatctagaactagaaataccatttgatccagccatcccattactgggtatatacccaaaggattataaatcatgctgctataaagacacatgcacacgtatgtttattgaggcactattcacaatagcaaagacttggaaccaacccaaatgtccatcaatgatagactggattaagaaaatgtggcacatatacaccatggtatactatgtagccataaaaaatgataagttcatgtcctttgtagggacatggatgaagctggaaaccatcattctcagcaaactatcacaaggacaaaaaaccaaacaccacatgttctcactcataggtggaaattgaacaatgagaacacttggacacaggaaggggaacatcactcaccggggcctgtcgtggggtgggggtagaggagagggatagcattaggagatatacctaatgtaaatgacaagttaataggtgcagcacaccaacatggcacatgtatacatatgtaacaaacctgcacgatgtgcacatgtaccctagaacttaaagtataatagtaataaatgaaatgttgatggtaagaatatgggtagagaaaacttttatttgggtagatgttagaagctgaggcctgggtgcggttataaaagcaatattaagtatgaggagaaggaggccctgaactaaggtcattgcaagtgaatggagtagggaatagataggagaggtattttggacaaagatgtggcagctgataggtgtgggagttgttctcatgtaccagcccagtctacaaagttctcagggcaaatggaacacaagttttttctgcaggaagtgatacagcatggtagatcttgaattgagacttctaaaatctttactaaaactttaaaggagaatacaatagtaaaacacagggtatggacaattttagttggcaggtgataaacagaaaagacatatcttggaggtggggggaaaaaaaagaccagttttttttgacaactgcaagaacagcagagttaaacaggggataggctcatgtcagagatccagttctatttactaaaatttccttgagtattcaagcattctgaaattctgagatcttgcaaaaggatgcctttgtttaaactttccttcatctagctacagaacatagttgaactttgaggcctttgaccccagacaagacaaaacatctttcaccttgcctattgcttaacacatatttgttaactatttaaccttcatggataaaaaatttcaaacatctgtattaactaatttgctaatgattgtttcaaatatctgatccatgggtttcttcttacattagttaaatttgttgtaagttctttacatttttaattatcttatatcattggatataattgctaaatctctatatgacatgttgattaatataaagtcaattaaaaaaactaacatgttaaatattgttcttacataatgccaggtataacgctatgcatttttatatatattgcattgtgtaatctaattcctctggaaaacatgcattctaatttctggctccaaagctgtgagaaaacactttgagttctgattgattaagcaacctaacaaagaagtaggagacataattaaaatttgaaaccagcctaagctttgaaactatgagtggtgatgattaccttctccaagttattattaaattaacggcacatttctgagaattgtgaatgttatttcaatggaagtttacagatatgtgtcaaaattttttcatcatttttaaaaaaaatttgtaatgaaatgagaaaagatccaaaatggccataggtctaaaatattttgccctcagaaactaaagaaaatcgttgccacatcctgctctaagtttttcagccataactattcttagatggctgatattttctattccacatggaaaaagacttctcaggcatttgatgaccagacgacagggaaaaagttatgatgttggtggtggaatgttctgctacaggcatttgagaacctcacagaactcttaatattcacttttaattcattccaccagggaggaagggtatgtgttttggagccattcatatatggtttcaaaatttgactctggcatttacctctgtaagaacttgaggaatttacttggtctctctgagctttggtatgtttagaatgaggatgatactaacagattctacatcatgattgttacttgaatgaagaaatataaagtgcattttaaattcatttggtcccttaacattgtcccttcccttgttatcttttcagagtttcttcttgaatggctcaaggactgaagcatcccacaaaatgattctactgaataactcccagaagctgctggttctatacaaacccttggcctggagcatacctgagtccctgaaggtgagggaacagtgagagagtcagaggctttgtgcatgtttctttacctttctgtgcctttaccttcgttcttttcatcaaggaaataggaataatattagcgcctacctcttaaagtttttgtggacactaaataaatccatacaatgtaagtgctaagagcattgccaagtgcccagctagtgcacagtagctctttggtatcagaaggacacctacctgtgagttctgcctacttgatggtgacttcatgtcaatcagaagggtcctagagatgctgctgatctcaccatcactgacttggtcacagtactgtctgttgacttttgtttttctctttctcttcacatccagatctccatctctgaggatcccaggctctcctagtctttccatccctccttcaggtgtatggctctgtgtaccacataaatcacaggaaccccttcaatatggaggtgctagtggactcctggcctgagtatcagatggttattatccagcctcaaaagcaggtaggcacacagatagggacgggtggagccaggttggtccaaagggcctaaggaactgaccagttgagacaccagggctgcttttatagagtgaaagaaaatgtgagtattttaaaagactccttaagtacttcgcaccttgcaagagtgccatgtgttcccacccttcctgtaaagcataagactcatctaggaaaaggggtggagggggtagaggaagaaaatgataaggctgacactcacagactaagggccttttgaggtggcaggggtcacctgcaggggctgagaggaggcaaattgacagggaaagttgggtgtctgagatatcagaacagtgacttagaaacaaaaaccaaagcagaagtctaccagtaaaaatttcctctcagggccaggcatgatgtcttcttcctgtaatcccagcacttcaggaggccaaggcaggaggatcacttgagcccaggaatttgagacccacctctgcaacatagtgagacctcatctccacacacacacaaaaataaataaaaaataaacaaaattagcagggcatggtagtgcatgtttattctcctagctgctcaggaggctgaggtgggaggatgacttgagccccagaaagtcaaggctgcagtgagccaacatcacaccgctgtactccagcctgggcaacagagtgagactctgtcttaaacaaacaaacaaaaaaacaagaaccaggaggttactttgcaggaaccagagaagggaatcataattactgtgtgtcaactatttggaagcaattgtcttgttagtgacttatcattagaacaatctaacgaagtgaccattaatgtctccaatttagagataaggaaatgacactgagaaatattaagtcatgtagctgctggataccagacgttaaagcattgcccaatctgaattaaagttcaaaggactgacggtaaccataggcccttctctgagtttcatcatgtgttaaaatgggaaaaataacaggaccttcttcagaggattacaagacgtttaaatgagatattgtacatcaaagacttagtacatagcacatgattttaaatagtatttaccataattagccattatggtaattggaataaactattaagctgaaataaggaataaactattaagctgaaatagtaatacaaacctgggtctatttttttgccctaaagacttcccctttttgtatgcattttatgcacatctggttagtgaactgaagcctcattgccagcccaacttcatgcgagtataggcgctgagcctccaaatagtaataagccacccgaattcaagactagcgtgcaaactgggtcaggattggaatgcagaaagtgacaaagtgaccctagattgaggaacaaaggggtaaagggggtgagagccaggctgagcctaacaccttccctaaggatgttcttttgatttcctggcttcctgacaatttcggattgaagatgaatgcttagtttatttaatccatggtccaagttcttcaaagtgtgatatgctaaataattgtaggaagccaaatagttctttttacttcactaactttgtatttattatgtgtattttagcatcgtaactatagcatcaaaccataacttcatatatgcattgctttgaacaaggctagtttttataaagtgagtcaatatacaaaaatattgaaatataaaagttccacaggacacatatatgaccaaaaaaaaaggaaagattgaaatatgctgcaatttactttgaattacattcaccttgtctgattccatagtataccatgtttcgtgcagtgttgaaagtcaatttgatcttgaataataactttttagggtgagaaacagaatttatctagaaaaaaatattttttttgttggtttttaatcacaatgataatatatgctgattatacaagggaaaaatttaacatgattttaagaagttaataacctctcacttcccctcccctcctctcctcatttcctaccctttggggtaatcaatgtccttgtgcatattaacatacactgatgatctctcctgtcgtcactttatttatttatttatttattatactttaagttttagggtacatgtgcacaatgtgcaggttagttacataggtatacatgtgccatgctggtgtgctgcactcattaacttctcatttaacattaggtatatctcctaatgctatccctacccccacccccaccccacaacaggccccagtgtgtgatgttccccttcctgtgtccatgtgttctcattgttcaattcccacctatgagtgacaacacgcggtgtttggtttcttgtgcctgtgatagtttgctgagaatgatggtttccagcttcatccatgtcccaacaaaggacatgaactagttcaaccattgtggaagtcagtgtggtgattcctcagggctctagaactagaaataccatttgacccagccatgccattactgggaatatatcctgtcatcacttgttaatttgcctttgacatatgggcatccctttgggaaaatcaatacagaactaatatattcgttttaacaactgtggcattccacagagccaatgcaatgctatttagtcactctttcttctgctgttgggttcaaatttttcacactttgttgcaagtacaaacaatgcttcaaaaaatgtcctcttatatatgtctttacatcctggaaacttttctcaatacaattgatttccaaaagggatgtctccaagtcagaatttattttatcataagtaagccctgccagattaccttcccaaaggattccagttttatttccattagcaatgtgtggaagaattgtttccccacattctcaccggcactgaatgttttccctcttttaacttatgccaaactggtgagtgaaagttggcatcttattgtagatttaatttgcatttccatgactagtgatagtcaacatattgtattttcatatgtttatcagtaatttggggtttacttctgaactgtttgtattgtttcaccatgtttacactggggttttatgtcattcttaaaattctgtaagtgtttttgatactagggatactaacacaaggcgtatgctacaaatttattgcccaatttagaattattttctattttattgatggagattttgacatgaagaaatttttaactttcctgtaatcaaatatgttatatttttcactatgacttcagaggttttgttttctttagttaataattaggaagatttttcctactccaagatcatgcaagtgttttcttattttgtcttacagtgagttaatttttacttttgacatttcaatcttcattctatttaaaatatgtttttgaatagcatgaaataacattcttttatatttttcttccttatggctggctaattatgttattactatttattaaataagtcattccactactgaaacataaatgtctatgttgtcatatcacctttacatatttttgtatctatttctgtatttgtttctagtcttttcttatgctatttcattgttttgtggtaaattttaatatctaataaagcaaatcacccttcaccaatacttttcttactttcctatttcttatacacttaagagccatatgaacaataactaattttcccagttccccaccaactaccccaactaactattgcaattgtggttagtattgtctaaaagacgattgtggaaagattactatttttgcggtactacatcttgtcatctagaaatatggtctttttctcacttttttcagtttctgttctatgccatcttgtaaaatttaagtgttttcctgtagtaaactacatgattttccattaagtttacttttcggtattttatattatttgttaagattattaaattatttttccttttctatttctgagaattattattttgttattgcttttcatttgtatttttgatttccaaatatgtcacactattctttaaaatcctgtttgtgtagggtattatttggttttgttttttgtcaaagtctcttggattttctcaatgcataatactgtaatgtacaaacaaagttatttgctgcttctttgccaatatttgtaagggtttttagtttcttgacttattgcataatttacaacctaaggaaacaataccaactaacaataataatatttttatacttgtctcattcctgattttaataaaatagctataacaacatatatgtagaattgcatttgattctgtctttacatgtttagagcattttcctcttgttcctactttcatagaacttatatttataatggagagtaaattttatattctttcatttttgtcttttctatttggcaacttatatactcatgtaatttttcctcctttaatttatcacactaaaagatcttccaatcaaagccattcaagcctttctaaaacaaactgttcctgttcacatttttttaccttttttttaattgtactttaagttctacggtacatgtgcacaacgtgcaggtttgttacataggtatacatgtgccatgttggcttgccgcacccatcaacttgtcatttactttaggtatttctcctaattctactcctcccccagccccccagtcacccaccccctgaaaggccctgatgttccccatcctgtgtccaagtgttctcattgttcaattcccacctaggagtgagaacatgcagtgttttttttctgtccttgtgattgtttgctgagaatgatggtttccagcttcatccatgtccctgcaaaggccatgaactcattcttttttatggctgcatagtattccatggtgtatatatgctacattttcttaatccggtctatcattgatggacatttgagttggttccaagtctttgccattgtgaatattgccgcaataaacatacatgtgcatgtgtctttatagtagcatgatttataatcctttgagtatatacccagttatggcatcgctgggtcaaatggtatttctagttctcgatctttgagaaatcaccaaactgtctttcataatggttgaactaatttacactcccacccacagtgtaaaagcatttatatttttccacagcctcttcagcatctgttgtttcctgactttttaatgatcaccattctaaatggagtgagatggtatcgcatcgtggttttgatttacatttctctaatgaccagtgataatgagcattttttcatgtgtctgttggctgcataaataccttctttggagaagtgtctgttcaaatcttttgcccaattttgatggggtttttttttcttttaaattggtttaagttcctcatagattctggatattagccctttatcagatgggtagattgcaaaaattttctcccattctgtaggttgcttgttcactctgatgatagtttcttttgctgtgcagaagctctttagtttaattagatcccatttgtctgttttggcttttgttgccattgtttttttgttttagtcatgaagtctttgcccatgcctatgtcctgaatggtattggctatgttttcttctaaggtttgtatgctattaggtcttacatttaagtctttaaaccatcttgagttaatttttgtataaggtgtaaggaagggatccacgttcagcttcctacatatggctagccagttttcccaccaccatttatgaaatagggaatagtttccccatttgttgtctttgtaaggtttgtcaaagatcagatggttgagatgtgtggtgttattcctgaggctagggttttgttccattggtctgtatatctgttttggtaccacgctgctttgattactgcagccttgtagtattgtttgaaattaggcagcatgatgcctccagctttgttctttttgcttaggattgtcttggctattcttgctcctttttggttccatatgaacttcagagtagttttttccaattcagtgaagaaagtcttttgttccttgatgtggatggcactgactctataaatcaccttaggcagtatggccattttcacaatattgattctttctatccatggtcatggaatgttcttccatttgtttgtgttatcttttatttcatggagcagtgatttgtagttcttgaagaggtccttcacatcccttgtaagttggatttcaaggtattttattctctttgtagcaattgtgattgggagttcacccatgatttggctctctgtttgcctcttattggtgtagaggaatacttgtgagttttgcacattgattttgtaccctgagactttgctgaagttgcttatctgcttaaggagattttgggctgagacgatggggttttctaaatatacaatcatgtcatctgcaaacagggacaattcgacttccttttttcctaatcgaatacctttcatttctttctcttgcctgattgccctggccagaacttccaacactatgttaaataggagtggtgagaaagagcacccttgtctgtgttggtttccaaatggaatgcttccaatttttgcccgttcagtatgatattggctctgggtttgtcataaatagctcttattatttagagatacattcgatcaatacctagtatattgagagtttttatcatgaaaggctgttgaattttgttgaaggccatttctgtatctattgagataatcatgagatttttgtctttggttctgtttatgtgatggattatgtatattgatttgcatatgttcaaccagccttacatccaaagtatgaagccgacttgatcgtggtggattagctttttagtgtgctgctggattcggttcgccagtattttattgaggatatttgcagcgatgttcatcagggatattggtctaaaattctctttatttgttgtgtctctgccaggctttggtgtcaggatgatgctggcctcataaaatgagttagggaggattccctctttttctattgattggaatagtttcagaaagaatagtaccagatcctctttgtacttcttgtagcattcggctgtgaatccctctggtcctggactttttttgttggtaggctattaattattgcctcaatttgagaacctgttattggtcaattcagagatacaacttcttcctggtttagtcttgggagggtgtatggttccagcaatatatggatttcttctagattttgtattttatttgcatagaggtgtttatagtattctctgatggtagtttctatttgtaggattggtggtgatatcccctttttcattttttattgcatctgtttgattcttctctcttttcttgctggcgttctatcaattttgttgatcatttcaaaaaaccagctcctagattcattgatttttttgaacggttttttgggtcactgtctccttcagttctgcgctgatcttagttatttcttcccttctgctagcttttgaatttgtttcctcttgcttctctagttcttttagttgtgatgttagggtgttgactttagatctttcctactttctcttgtggacatttggtgctataaatttccctccacacactactttaaatgtgtcccagagcttctggtacattgtttccttgttctcattgatttcaaagaacatctttatttctgccttcatttcattatttacccagtagtcattcaggaaaaggtttttcagtttccatgtagttgtgcagttttgagtgaatttcttaatcctgagttctaatttgattgcactgtggtctgagagacagtttgttgtgatttctattcttttacatttgctgaggagtgttttatttccaattatgtggtcaattttagaatgagtgcgatgtgatgagaagaatgtatattctgttgatttggggtagagagttctgtagatgtctattaggtccacttggtgcagagctgagttcaaatcctggatatccttgttaactttctgtctcattgatctgtctaatgttgacagtggggtgttaaagtctcccattattattgtgtgggagtctaagtctctttttaggactctaaggacttgctttatcaatctgggagttcctgtgttgggtgcatatatatttaggagagttagctctccttgttgagttgatccctttaccattatgtaatagccttctttgtctcttttgatctttgttggttgaaagtctgttttatcagagactaggattgcaagccctgctttttgttgttttccatttgcttggtagatcttcctccatccatttattttgaggctatgtgtgtctctgcatgtgagatgggtctcctgaatacagcagattgatgagtcttgattctttatccaattttccagtctgtgtcttttaattgggacatttagcccatttacatttaagggtaatattgttatgtgtgaaattgatcctgccattataatgttagctggttaatttgcccactacttgatgcagtttctttatagcatcaatggtctttataattgggcacgtttttttctgtggctggtaccagtttttcctttccatgtttagtgcttccctcaggaactcttaggccttgtggtaacaaaatctcttagcatttgcttgtctgtaaatgattttatttctctttcacttatgaagcttagtttggctggatatgaaattccaagttgaaaattcttttctttaagaatgttgaatattggcccctactctcttctggtttgtaggttttctgctgagagatccgctggtagtctgatgggcttccctttgtgggtaatccaacctttctctctggcttcccttaacattttttctcatttcaatcttggtgaatctgacaatcatgtgtcttgaggttgctcttctcaaggttgctcttctcaaggagtatctttgtagtgttctctgtatttcctgaatttggatgttggcttgcctttctaggttggggaagttctcctagataatatcgtgaagagtgttttctaacttggctccattccccccgtcactttcagatacaccaatcaaacgtagatttggtcttttcacatagtctcatatttattggaggcttgtttgtttctttttactctcttctctcactttgtcttctcactttatttcattaatttgatcttcaatcactgatatcctttcttccacttgattaaattggctattgaagcttgtgaatgcatcaagaaattctcgtgccaaggttttcagctccatcaggtcatttaatgtcttctctacactctttattctagttagccattcgtctaactttttttaaatgttcttagcttcatttcaatgggttagaagatgctcctttagctcggagaagtttattattaccgaccttctgaagcctacttctgtcaactcgtcaaagtcattctccgtccagttttgttccattgctggcaagaagctgcaatcctttggaggtgaagaggtgctccagattttggaattttcagcttttcttttctggtttctccccatctttgtggttttatctacctttggtctttgatgttggtgatctacgatggggttttgctgtggatgtcctttttgttgatgttgatgctattcctttctgttgttagttttccttctaaaagtcaggcctctcagctgcatgtctgttggagtttgctggtagtccctctataccctttttgcctgggtatcaccagtggagctggcagaacagcaaatagtgtagaacagcaaatattgctgcctgatccttcctctgaaagcttcatcccagaggggcaacctcctgtatgaggtgtctgtcagcccctactgggaggtgtctcccagtcaggctacatgggggtcagggacccactttatgaggcagtctgtctgttttcagagctcaaacaccatgctggaagaatcactgctctcttcaaagctgtcagagacatttaagtctgcagaagttgtctgctgacttttattcagctacgccctgcccacagaggtggagtctatagaggacgtaggccttgttgagctgcggtgggatccgcccagttgaagctacttggccactttgtttacctactcaagcctcagcaatggcggatgcacctcctcctgtcagactgcagccttgcaggttgatctcagactactgcactggcagtgagaaaggctccattggtgtgagacctgctgaggcaggcacgggagggaatctcaaggactgctggttgctaagactgtcaaaaagtgcagcatttgggcagaagtgtaccattttcccaggtggagtctgtcatggcttcccttggctaggaaacagaaataccccaaccccttctgcttcctgggtgaggcaatgccccatgctgatttggctctccctcaatgggctgtgcccactgtccaacctgtccctatgagataaaccaggtatctcatttggaaatgcagaaatcactcatcttctccatctaactttctgagagctgcagactggaggtgttcctatttggccatcttggaagtgctcatgttcttctgatatactactgaatattttatgcagaatttttatatatgtattcataagagaatatggtcaataagtctctttttgttatttttttaacagatttggcattaggaacttttcttctgtttccaaagcttaatattaaaattatgtgtttgttttggcttgtgtacaatttaaatgaaaaataatctgattttggctacttcttattttttaattttaatttttttctttagatacaagtggtccatatgcagattttttacatgtgaatattgcatgatgctgaattttggagtacggaccgatcccatctgcctggtagtgagcatcgtacccaatagttttctaaccagcccctctgtctctaccctctagtagtccacagtatctattgttcccacatttatgtccatgtatgatcaatgcttagctgtcagttatgagtgagaacatgtggtatttggttttctgttacagcattaatttgcttaggattattgcactgtggaaagtagtctggaaatttcttagagaaattaaaacaaagttaccattcaaccaaacaatgccattagtaggtaaatagccaaaagaaaatgaatgattctacgcaaatgacacatgcatttgtatattcattgctgcactgttcacaatatgaaagaaatggaatcaacccagatgcccatcaattgtagactggattaaaaaaacgtggtatatatattcctgtggaatactacagaacaacagaaaagaataaaatattgtcctttgtagcaacatgggtggagctggaggccataatccttgtccaatttttaaacggtagattttaaatttaatttctcatattttataatagtttgttgaggttttctatgtttttgaaagtcaattttgatagtttatttttgagggataacatccatttcttttatcaataaatatgttgcctttgagtagtatataatcctctattataatttttttgttcttttctctgtttgcattctcatctctcatactctacgcttatttttttatttttgttttttctctgtctctcgtatttccttaaaataccttaccagaagtttatccctctctctcttctctttctgtttttgccatttaaaaatgaactctggtttttatatatcctttatactatgtcttgttttccatttcattataggtagctttcatttttatagatggttccatttgttttcttctagtttactttgataatctttttataattccttgaatatttacttggctattttcagtcatttttaaaaatctggtcttttaaaacatctactattttaaattcatggaagttttggtttcggccatattcaggaacttcctttcataaaaacactcgcaaattcttgaagttttctttaaaattagtcacactattttctcttttttctaaaataatattcactgctaaaactctcatacttattgtttatatttcacccaagaaacagaaattcatcttcccatgaagtttgtggcttgccagaaggtgatcaccagtctatttttttaaacccataagtctaacaccacataaattacccagagtgctgccaaaatttcagctatttcattctattttgtgggcttctggctttaaagacagtgtcactctttcaataggctgatatcctgtaggcttgggaaaaggctgtgtctcattaatgtttatattcactaaagcatcttgcccaagccctggacactagattctaggacactatagattctaggtgtctggtgaaacagtaggcactaacatttagataattcacagctaaatttattttgagccaagtttaaggacttaatcctagagatacagcctcagtacatcccaggatgtgtcacacaggaggttacgtgggggcacagtatatataacagggggatacctgtggcccaggaggtgagaaaagcagggagagaagcaactgatgcaatctgattctgctgggttctcggtgatgctatatataaaataaagtaagtgtgcaattgagtgagtagggagaaaggtgaggcatcttaaggcctggtggaaggtggctgatttcatcctgtcttctttctggatctgataagcagttttataaccagtacctgtcactgaaatatttaacaaactccagttacgcaggcaagaggtcagcagtagcttataagcctaggttttattatccgtgtgcccacctgcagccatcatgggccactggtaaaattttcttttgaactttcatttttctgataattgcaatcagtgagaggtgaagaaaaagttcaattgaatgatctgaactttcaccatcctaaacaggagatgactgatgacgtggattcatacacaaatgtacattgtatgttctccaaagagactaaaaaatcacaagaagttttgaaatatgtgagatcataaactggaaacagatactccaaatccatgataacaagtctgaagaaatgggcaagcagctgttcttctcaaattgagtcatcaactaatattattagcatcacctgagagctcaatagaaatgtaaatttacaaaaactctggggactgggagaagtagagcaatctgtggtgtgacaaagactccagcagattgtggtgtaaactcaagtttgataacgactaagcattgatgtattaatcaggtgggagcagtgtaagtagagaactccatgtctgacaatattgctttcttggctttcttcccaggtcttcaagaaagtttaggtgaggggataagagtggctgcattttcaaagtcactgaaggtagagcaatcaagagcagtcctctttattatggagaatatcctgaagttccatgactccaataaaagcaagctggaagctgagctgagtcaggccacccagatgatgaatttgagagacaaaaacatgtgctggtcatttataattgctattccttgtacatttttgttattcacataagtgagttttggaatgaaaagaggatgaattcatgctttgggatgaataaaagttgtcaatggtcaaaatacacagcttgcaatggtgggtcattagacaagaagagtccctgggatctctagaatgtgatggcacccagaaattacaggggtgaggatgaatgttgttgtctttctttttgttttctatggtgaaactcccaactttaagaatgccctgttggttatctcttattcagggctggtaaatgataactggaggtgcaggaagaatgagaggagctggcgttacatcaagcactgtataggaggcctgccagcagcctgtatgctgggtccagatggggctccggtatcatgattaaccttggactcttcttgtgatgtaggaatagcctacagcatggaaaaataccaaagggcagacgacatggcacgggtgatcatgggattcatgaaatatctgcatcagaataatagtccattttacttctcttttctagaagtaaatgatgactcccacagatttgtggggcagttctgttcctttgaggccacgtgtaagtaccaccaatggacctgatacccggagaatctagttccattttagacaatgaagctacctagctatcttgtgcaagccatctcttaatatatccgtagaagaaaccatagaataggtttcttcacttacaaatgtttattcggcatttatgatatgccaggagcttttctaacatagagacttgatgttagaagacacagccatgctcttgtggaacttacaatccaggctggaggcaggggagagtatagtctttaaatatgcataagtgtagtagggaaggacgggtttagtagtaaacatgtaactagaaagccaggctcagttcttacctcttagaatcagaactctttatgaaatgtggttgacagaatctgctatctggaagataaatgaaggactttaataaaattgtcattagaatatacctaatctatatggatactttattggaaataaataaccctgatatatatgaattgaggcaatggctacactaaagaatggaatcagtctctttgtttagtgactagcaaggtatcaaagtaaagtctcagacaaatggctttcctaggctacctttcatcattgttacgcagaaaaggaaatctagagaatcaagtggactggccttggggcctctgctatggaaataacatttgttgtgcctcctttctcctactctttctcacttcctcatcattattgaagcatggcacagggcaaggtgttgcatgtgaatctggttataagttcagcatttggtgtttgccactgctatcttaaagggtcacgggcattccaggggaagtgaccactaaggtgaggactggagagtgagtaggagtgagccagacaaaaaaagcggaaaatctagatgatggaaaggacacatgccatgcactatcattagaactttctatttgagcgcttatattacaattctgaatcgctgatcttaaaaacaattacacttcatgatcaaaaggtggcctcctttggctctggtcttccactctgccattcatatttgccattggaactctgctaacatggtgaaaccccgtctctactaaaaatacaaaaattagctgggaatggtggtacatgcctgcaatcccagctacttgggaggctgaggcaggagaattgcttgaactgggacctgggaagcagaggttgtagtgagccaagttcacatcactgtagtccaccctgggctacagagtgagactctgtctcaaaaaaaaaaaaaaaaaaaaaagaaagaaagaaagaaagaaaaaaattggaaggcagaaggaaatgtgagtgcagaagagaagaatgtgatgcgatgatgatgaaagcagagagataaaacatgatgtgattcagagacccaagctaaggagtgaggacagcctctatgatctggaaaaggcaagggagctgatttacccacattgcctccagaaagagctggccctgccaacatgtcggttttagccccataaatcctattctgaacttccgactgccataaatataacacattgtgttgctttaagtaatcatatttatcataatttgttataatgacaaaagaaaactaatacatcatagacataagaatcatcttgaaaatttaaagttaagctttaaatttgcaactcaacctagcaaccccttgtgataaaaagcaagtaagaaaaccaaattttcactcctagccacaaaatttaatttagctgagcatctcaaagctcctcagagggtactcagaataaaaagcaatttttttcatcaaagaagtcatcttcatttaagaaagtgttgctataaagggttatcttgacactaatgattggcattgggtgattttaattctgagatgtctgtcaccataaatgaaattatgagaccataggattgagcttctaattttctgtaagaatacagaggaagaggagggtaaaaatgttaagggtgagcttaaataatacccagatcctggataatcaggtgtcttttgtgctaatgtacatcatcatatttgtgtttgaattaatgattttctactgataagatttgaaatggacagtggaactaatcaacaatatttcttggggatgcatttccactgatgccagccacaaggtcaaatcttaaacccaacatttttcagtgcctgtaggattttctcactattatctgccgcatgagcataaaatgggatttctttctgagaaagataactttcaagatgataaccaatttgcgacatgttgccttggtttctgtgtttggggacagtataacccattctcaactcactggactgtcccatcacaagccaagagacaagctgtgcctctggacccagcacaccaaatcctagaaaatcctggatgcagcgttcaatatatttaaagctcctctcatttttcccaaaggcccagtgttcatttacaagacctgcatgtgaaacacctaagaacatgtttgaaaagtttccttccctatgaagaaaaaaaaaattacctttattcagccaatattatcaaacactgaaattccaataacaccattcctttccttaaggatcctacagcctagaggaggcaatagctgtattacaactaccttttctattcctgcttcaaaatgtttccaaataattggtgggggaacaccgtgttttatggtgtatttaatagcagacagataatatgatatgttataggacatctcaaaatgtcccgttaagtatcctaaggaagaaaatgaacacgtctttaaaagagtgaggatatagaccagagaagccctccacgtggctgaatttacttgaaagatgcgtgtatgaaatcatgtgcattttgagttctactccacaaaatatctaaatatacaagatagtaattcgttgaacagatattccaatcaaacatattttacaggaagatgagaacaatgctgatcttacatcttcatgtgtcccaaagcctgtcatcacatacccagaaacgcagtttaagaagctgcaatataggaaaaagaatactaaatttttggtactaacctttgggattctaatcctgattattttcttttggaaaagttatgtaagactcagttttcttgtttgtaaaattatagtaatatcctctgtaaatatggaaatagtgaaagagagaagatctccaggaatttttgcccctctccagggaggaagacttttgagaagtttgtcagtttcagagtcacttcatgtttgccagtgggtgggtaacagaacgctaagttttctatgggtgatgctttgtttttgctcacttccatgcctaacctgatcctgggcttgcttcctgaaagatctcaagtacgctttcctgcacccctctcctgtggatagccaaacctagaatggcaagatataaagatatccatgcgtaggcttagaggaatcaccttagggcaggtacttcatgccagacttccagagttatactactaaatataatttaatccccatttatcattgttccctgtgtatatgttccccttaacaatctcatgggaacactggtggggcaaagcagtatttgaagactgttaacttttctggctaaatcaaacatatctgtgaatgtgtgtttaaattctatttattttttcaattagtaacaaaattattaagcataaatggattactagaggaaagcaaatctctcttctttctctgatctcctattacccaattactttctctagaagcaaccactaataccaatatattttgtacaagtttcccataaatctatgcaattttagatatgtacatacatttgtttattttcacaaatggtagcatactatatacattgttctatccacctcatgtttttttacatagcaaactattttggaaatattttctaatctgtcatgtagagctgcttcattctttgtaatggcttcatagtattctaatgttttaatgtaccataatgattttttctatttccccattactggatgtttaggttgtttcataagttatgatatcacacattaaatttatgaaaatcttaccatccagtttagaaatatcattcatttattatgcatagtctttgactcaacagttttaattctggtaattcatctttcagaaatatttatacaactgttcaataatctatttatgatgatattcatttcagaaagtgccgtaaattatgtgtacatattgcaaaaataaatacataactcatatggagtactaaaagcatacatatcagtgtcaaaattatttacacctagcaggggaacccaagaggacagattttatttttcattttgtatgcttatatactttctataagcatgtagcattttgtaagatataaatagtttcagtaaacattttttgatgccaccatgatgtccattgccctctccgaaggactcttgtgagctctaagtgaaataatatgcataaagaccttgtctaatgaaggctctgttcatgctcagcacacagttcctaacgtgacgccctttctttacccatgcaattttgtagcccatcataatttagtctcaaattctacacttccaagtacagcctttgtggcaactcaataattctatcaaggaatttgggaagtaaaacgtaaaatctcacttcttatcatcacccattttaaataaccccatattgtcattacttgcagtcttgtgtttctttggtaattccggtataaagagcatggttttcatgtaatctacctgcactgattttgaagttgcaacctttcttattgcttcatccaagccctcctgtcaacctggagagaggagaaagacaggtactgctttataccttccatatcagctaggaataaaccacgcatcttttcttttaactcagactagttagattggatctggaaagtttgctcccagttgataacctcggagcgtgacctcctctaagttgtcaggagctttggtgaagatgtggtaagagttggtgtaatgatcccagtcattttttatctccagatacaacaaatatcatacatagccctacaattacaaaatactcttgcataggcctagaatactagagattaacttgtttgaaacattctgtttttctaagataggtgtagaaaatggccttgcagtcgctccaagaataactcactatttatacactgaagatagtgtctttcttttagggcactaaagtgagctgcccttgagagggtgagtaaatagctccattgtctcgaatgggaagtgtaaccaaaatggtgtatgttaaggatttaaaagagaaggtgcctaaggtatggaaaaaatataagaaacaggtttggcaaggctccgggtttttggcaaggtgacacctgagctaatcctaacccaggaaggactctgaggctggctcagtgattggctcttggagtacatgtgaatagataaacttttggaaagaactaacattccagagccagatagtacctagaatagacagcttggtctggctctacatgtctgcctaccctctgctgatgacacttccacttgagagtcctcgcaggtgaaaacacttcttaatcactttcagccatagaagtctaggttgggatgtagtcctatgatcagaattttgatggaatagactgagtgcttggaatcctaattttatttacacatccagggttattgatcactggatctaagttcaagccttatctcactgccctaccctctctcccaaacagcccttccaaaacctgcatacgtcaacagtgtcaacattcttctcaccactcctcagtttcagttccctcattgccacacagagaatgtctggagagtgactgccctggtattcagtaactattgctcctacctggttctgaggctgagtaatgatgatctggtaatctgtccaggcatctaccatcacctccattttgaatgggtttttatgttttatgttgaaaatggtgctgtatgcctataatgcaacagaacaaaacagtaggggatgaagtttttctccaatgtaaagtcttatatgaggcatgggaaataaggacaagaagcctaggaggacttaggatggggccagtgcttccaaggtggttcattgggctactcattgagagttatgttgcaaaagggaccaataagcatccacaaaaatccatgttaacacccgaatcattaggaactggcttcccttatattcattcattttttaaaaattcatgccatttcacattgtaattgtgaaatgtgtgaaaagttcacattgtaaatgtgtagcagatctttaatggcttggtcaacacaaaatattggctacaatcaattacaggtggtaatatatcctgaaagattaaaattagaaaaaaaaggtccagaaccatcagggccatttggggctaaaaccaggatggccacctcctcctcagccgagtgagtgctggaggagggagcctgaaactaggctcactgtgactcatttgtggcacccattattgcccaacctgcagttcactatggtgaaggagcaattcagactcaccctgcagcatcccgtctgggtcaaacagtggctgctccctaaggaatagttgggggcgctacataaagtagtttaaaaactattgtaaaaaggacatgtttcaccaatgttctttccttagattctccagtgtttgtaattcataaaaattccagccgatggggcatgctgaccaacttaagagctgtcaatgcagtaattcaacccctggggggctctctcaactgggttgccctctctggccataatccccaaagatttgcctttaattataattcatctgaaggattgcttttttaccgctcctctggcaaaacaggattttgaaaaatttgcttttactataccagccataaataataaagaaccagccaccaggtttcagtggaaagtgttgcctcagggaaggcttaatagtccaactatttgtcagacttttgtagctcaagctcttcaaccagttagagacaaattttcagactattatatcattcattatgttgatgatattttgtgtgctgcaaaaaccagagacaaattaattggctgttacacatttctgcaaacagaggtttaaaacacagggctgacaatagcatctgataagattgagacctctactccttttcattatttcagagtgcaggtagaggataggaaaattaaaccacaaaaaatagaaataagaaaagacacattaaaaacattaaatgactttcaaaaattgctaggagatattaattggatttggccaactctaggcatccctacttatgccatgtcaaatttgttctctgtcttgagaggggatccagaattgaatagtaaaagaacattaactccagagacaactaaagaaattggattagttgaagaaaaaattcagtgagcacaagtaaatagaatacatcccttggcccaactccagcttgatttttgctactgtgcattctccaacagccattatcgttcaaaacgcaggtcttgtggagtggtccttccttcctcacagtacaattaatacttttacattgtactgggatcaaatagctacattaattggtcaggcgagattacgaatactaaaattgtgtggaagtgacccagaaaaaatcattctttctttaatcaagaaacaggttagaaaagcctttatcaattctgcttcatggtagattggtcttgctaattttgtggaaattattgacaatcattacccaaaaacaaaaatcttccagtttttaaaattggctacttggattttacctaaaattaccagacataaacatttacagaatgctctgatggtgtttactgatggttccagccatggaaaagcagcttacatcaggccaaaagaacgagtcattgaaactcaatattactcagctcaaagagcagagttggttgctgtcatttcagtgttacaaggttttaatcagcctattaacattgtatcagattctgcatatgtagtacaggctacaaaggatggtgagacagccctaatcaaatatagtattgatgatcagttaaaccagctgtttaatttgttacaaaaacactgtaaaaaaaagaaatttcccattttatattactcatatttgagcacatattaatttaccagggcctttaactgaagcaaatgaacaagctgactagctagtatcatctgcattcatagaagcataagaacttcatgccttgactcatgtaaatgcaacaggattaaaaagtaaaattgatatccataaaaacagccaaaaaatattgtacaacactggacccatgtcaagtcctaaacctgcacactcaggaggtaggagttaatcccagagttctatgtcctaatgcattatggcaaatggatgtcacacatgtactgtcgtttggaaaattgtcatttgtccatgtgacagttgatacttattcacattttgtatgggcaacctgccagacaggaaaaagtacttcccatgttaaaagacgtttattatcttgttttgctgtcatgggagttccaggaaaaattaaaacagataatgggccaggatactgtagtaaaacatttcaaaaattcttaaatcagtgaaaaattacacatacaacaggaatcccttataattcccaaggacagacactagttgaaagaactaatagaacactcaaagctcaattggtgaaacaaaaaaaggaaaaagacagtaagagtataacacttggtgaaacaaaaaaaaagaaaaagacagtaagagtataacactccccagatgcaacttaatctagcactctatactttaatttttttaaacatttagaaaaatccgacaagtacttctacagaacaacattttactgataaaaaggacagttcacataaaggaaaactgatttggtgaaaaaataataaaaataaaacatgaacaacaggaaaggtgataacatgggggagaggtattgcttgtatttccctaggaaaaaaacagcttctagtttagatacctacaacttacagaagaagttgccatccagcaaggaagtggagccactgacctgggcccagttcaaaaagctgacacagtatactgaaaaagcctgaagaaaacaagggtaatgtgaactccagagaatatactgcttgcagctttgatgactgtatcaatggtggtcagtctccccatgtcttcaggagcagctgcaacttattatacttactgggaccatgtgcctttcctgcccttaattcgggcagtcacatgaatagatagtcctactaaagtatatgttaataatagtgcatgggtaccaggccccacagatgatcgttgccctgccaaacctacaaaaagaaggaatgatgataaatatttccattggatatcattatcctcctacttgcctagggaaggcacccagatgcttaatgcctacaacccaaaattggttggtagaagtacctactgtcagtgccaccagtagatatacttatcacatggtaagtcgaatgtcactcgggcaacaaataaataatttacagtattcttcttatcaaagatcattaaaatttaggcctaaggggaaggcttgccccccaaaaattcccaaagaatcaaaagacctaaaagtcttagtttggaaagaatatgtggctgatactgcggtgatattacaaaacaatgaatttgtaactattacagactgggaccctcgaggccaattatattataattgtatgggccagactcactcatgttcacaagccccatccatctggcccattaatctggcctatgatagtaatttaaaaagctggaccaggtttataaaaggtgaaaatcaccctatccattaaaatggagtaaaaagagaatttcctcacctcgaccaaagttaattagtcctgttactggtcctgaacatccagaatgatgaaagcttactgtggcctcgcaccacattagaatttggtctgcaaatcaaactataggaacaaaaaatcgtaggccatattatactattaacctaaattccaatctgacaattcctttgcaaagttgtgtaaaactcctttatatgctagttgtaggaaacatacttattaaaccagattcccaaattgtaacctgtaaaaactgtagattgcttacttgcattgattcgacttttgattggcagcacagtattctgctggtgagggcaagagagggcgtgtagatccctgtgtccatggactgactgcaggaggcttccccatctgtccatcttttagcagaagtattaaaacgatttctaactagatccaaaggattcatttttactttgattgcagtgattgtgggtcccattgcagtcacagctactgctgcagctgctggaatttctttacactcctctgttcaaactgcagaatacgtaaataattggcaaaagaattcctcaaaattgtgaaattctcagacccaaatagataaaaaattggcaaaccaaattaatgatcttagacaaaccgtcatttgaaaggaagataggctcatgagcttggaatatctttttcagttacagtgtgactaaaatacatcagatttttgcattataccccaagcctataatgagtctgagcatcactgagacatagttagatgccatctacaaggaagagaagataatcttactttaaatatttcaaaatttcaaaaacaaatttttaagacaacaaaagcccatttaaatttggtgccaaaaactgaggcaattgtaaaagctgctgatggcctcacaaagcttaaccccgtcacttaggttaaaaccatcagaagttccactattgtaaatttcatattaatccttgtatgtctgttctgtctcttgttagtctacaggtgtatccaacagctccaaagaggcagcaaccagcgagaacgggccataatgacgatggcagttttgtcaaaaagaaaagggggatatgtagggaaaagaaagagatatcagactgttactgtatctttgtagaaaaggaagacataagaaactccattttgacctgtaccgtgaacaattgttttgccttgagatgctgttagtctgtaactttagccccaaccttgagctcacagaaacatgtgttgtatggaatcaaggtttaagggatccagggctgtacaagatgtgccttgttaacaatatgtttacaggcagtatgctgggtaaaagtcatcaccattctccattctctaggaagcaggggcacaatgcactgctgaaagccgcagggacctctgcccaggaaagccgggtattgtccaaggttctccccacgtgatagcctgagatatggcctcgtggaatgggaaagactggaccatcccccagcccgacatacgtgaagagtctgtgcagaagaaggattcatagaggaaggcctcttgcagttgagataagaggaaggcctctgtcccctgcctgcccctgggaactgaatgtctcggtataaaacccgattgtacatttgttctattctgagataggagaaaaactcccctgtgtcgggaggtgagacatgctggcagcaatgctgctctattactctttactccactgagatgtctgggtggagagaagcatacatgtggcccacgtgcacatccaggcatagtaccttcccttgaacttatttgtgacacagatttctttgctaacatgttttcttgctgaccttctccccactatcaccctgttctcctgccacattccccttgctgagatagtgaaaatagtaatcaataaatactgagggaactcagagaccggtgctggttcgggtcctcagtatgctgagcaccggccccccgggcccacttttctttctctgtactttgtctctgtgtcttatttcttttctcagtctcttatcctacctgatgagaaatacccacaggtgtggaggggctggcctccttcataagtatatagccaaaatcaatacaaatggaagcaaagtggttaacaacatgggctttggaatcaaacaaaccaaaattccacccctggctcctcttctggctatctgggtcaccttaggtaggtcaaattatttgagcctctctgcctcagttgcattatctataaaatggggatagtaatatctacattgtaggttgtcatgaggatttccttgccagaaaaggtgtgtgaagtgtttagcatggtggtaatttgtgtatatacaaggttctgaaggaaattttaaaaacctttaaatccagtgaaggtgaccattccactggacagaaacataaatgaagaaaactgcagcttcaaagatggactatatgtaagttgcttgaataaacctattggcacaaaatagacattttgaggcaaaccacagatctagaacaagctcatctgtttctgtcactgtctaagatcatgggtgcagtaacaaaatggcacagaaatctgcgcattctgcagactttggtagcatatttccccagaggagagtaatctccttggtaagtgatattatgtcttgctctttattgtgactcaagcatcaagctcagcacttagcatagtggaaaaattaataagcttttgttcagtgaatgaacaaatagagtcagtgaaggttagaaatgtggtttttagaatgcttttcctcaaagactgagcattaagtctctttgctcctggcatagccaagtttctgagaaaacacgtggctgctaacagaaactttcaaagcagaagaaaatgctttatagtaggtttttttgcaatgaatattggatatgtaacctatagggggtgcacaaaaatgtggattaaaaaaaggttgtaaatggcctgttgcctctaccaatagcatatgctctcccacccgcttccatttcaccgttagcttccctccatggctggactctggttctgctctcaccaatgagagacacctagtttcaattcactccaaggtgccaaggcagtagaaggtttatgggtcaacatgatgcaatagtctaatataatataatatattcttcaatatattataatggaggattataagagagtgactattggatcaggtgttttttaacaaaatcgagaggaaaaggagccagtagaagagatcggaaacatggcaaaaaaaaaaaaaaagaatgtgaaaaataagagaatgaccttggaagtcaaaataagagaaaccttcaaggaaagagtgaccaaagcagtcaaaggttgctgagaagctaaaagagatgagtactaaaggcggcagtgcattttgaagttaggagttgattaccgactttgtaagagacatggacaggagaagaaatcagattatggggattggagactaaatgaaatgtgaggaagtgaaggtaactttttgaaagagcttgaccagaaaagaaagaagaacacgagagtatcaaggggaagaagagaggtacaagagctcaaagaaaggcatttctcttattagatgagagttaagcatacctatactaactacaagaggtaagatgtaagtcattgataggccaatgtgtctaacaggacatagaaaggtgacagaaattcaatgaccttatgtacaaaatgccagccactatttcagcttatttatgttgactaattcatgtaatcatcaaccataattatcagcatacttgttaaattaagttttgaacaggaagaatacttcttccagtgagaagtcaaaaaaatttaggatggatgcagatgcaaatgtatgtatgtaggtatacagcaggtcatcaaataatgtcattttgttcaatatcttttcattataatggtgaagagaaaaaaaacagttcctggctggaccactgtctatgtgcagtttgcctgtcctcctcatgtctgtgtggactttctctggataatcccatttcctctcacatctcaaaaatgtgtacattagtatattgacatgtctaaattttcacaggatgagtgtgtttgtgtgtgtgtgagagagagagtgtgtatgtgtgtgtgtgcacgtgtgtccccaggatggaagggtttccagtccagggtgggttcctgccttgtgctctgagctaccaggataggcttcagccacttgctccgctgaactgcaataaggcagttgaaaaatgaatgaatgaaacattcataataaaacaaaaattcataaagtctatgataatgatacaaatgcatgacaataaacaatgctgtgcaaaaggactcagcgagcccatcatatttgtgatggatttttaaattcatagatacaagagttgcttcttacaccttttgctttgcaaacatttatttctcaatttaactcaccaccactgtgatcaccatcacacatcaacgcaacaaaaatcaggtaaataattatcttacttgtttgtatcaatatttcttaaatgtatatacagcttacatttattgcattgttttatattagaagtgcttcagttctttataagtttggtgatgtttttgtcaccagaaatatgctgtaggaacttaactcttctttatattaattagcttatggtaaaaataattttgatatgtgttgtttcatttgatgttgcagtttccaagaacctattgacaatgttaagtaaggactaattgtatacaggagtacacagggttagaaaaaaggagcatagagttggcaagttatttttgaatgtctatttcctggaagaggtaaaatttcttcctattcccaaaatcactttttagaagtgagtgggtgagggagtatgccaagaaagtgttcagaaaaagaagtaggatgttaggggaaatggttagggtataaatggcttttgatgttaatgggagaaacagtggactagaattagcaaggactggcaagcatgcttaggatcatgtaaagagggacaccatcactggaagtgttactcaacagtatattaagctcagcaccctaaaagtagaagcacagaagacaaattaaaacaaaccaagattggctttttcagggctggataacaaaaaagataagggacaaagcatttgagaacatagtaatgagggattgaaactcacatctaagatagagaagaaaaaagtaaagtaggttggagaccaataaagtgagaaaatatagaaaaagcaagggacgaaagtacttgatgaagtcaaagaatagcaatgttaatagacaggggaaaatgtacttacaaataggagactggagtcagatattaggctattagaggttgagatttcagaggtattcagaagtagatcagtttggcatgtatgactgttggcatcaactccaagtcaatagagtaggagccaagaagggaatgggagcttcaggtatcacagacatgaacaggatgtagcagaagttggctgaagagaaaaattaggatgtcaggtgccaaatatttcaacgaatgcagagaaatttggcagagggcaacagaaaagcattgttttattccagccacatgacacagaaggaagaaggaagatttttctatgcaaataagtaatactctagaagcaggattggaggcaaggagaatactgattttttttctttttggtaactatattaccctggagatctagaggttgttagagaaatgtttaagcatattgataatttataattcaaggaaagcatttggacattttacaaattcaaaaggctacacactggctttttctaaagtattttccagcttcaggtacctaaaaggttttgaagaatttgttctcaacattgagaccctggtgagtgctcattccaagggttttcaggggaaaagaaataaattaacaaatacaaatgattgagaacaagaatcctaattaattgaaatgccaagaaaaaaaggctgttctaaacaattctgcttacctgaagtttctttgcagagctgtaggcacactgcctgctgcacttgctcagaatggcaatggaaaggtttctgtagctaacactctatggactcagacacactaaaattcaattgactcacgctgtcactgtttagcataaagcttcaggaagttatgggttcctgtagattaaaccagatgttctgtccgtagacaggaagtcagaggctttgtggaccagaggaggactgagaccatgttctgtattgagcagcctctacaattataagaagttttacacaagaagcttttgatttatacataacttgttatagctgaaagagtattctagaacaatattaagtcaattttctagagttggcaaaaatagcacagctgcagccttatttaaaacaagttagcagagcaaacaaagagttggaaagtttggtttcaaggcaaaatacctggcctaatactttcaaccatttgtgggttggaaaaagacaagaatgcctcaagaaagttactgtaataatgagaactgggtttcatataccttgtcctctggttgtctaaagtggagcaagagggaagggtattgtaagtataagaagaaaaagcaattagtggagaaaagtttcagggggactggaattagctttgtagaggaatagagacaaacattgttttcaatgtgtgttcctcacaccatctacttcaagatcaattgggcttgcttgttaacaatacaagaacttttccagatcaggtaaatcagaggctcccaaagtgcctggcaatctgtatcttataaaaagctatctaaaagagtctgatctatattatattttgaaaacattgagattaaaaaatgggaaaatatgttataaaatttttatcctgggtgcagtggcttacaccggtaataccagctacttgggagtctgaggcagaaggattgcttgagggcagaaatttgatatgagcctgggcaacctaataaaactcatctttaaatttttggtttttaattagccacatataggggcatgtgtctatagtaccaactactcaggagactgagatgaaaagattgcttgagcccagaaatttgagatcgcagtgaggtatttcaccactgcacttcagcctgggcaacagggtgagatactctctctaattaaaaagaaaaaaaagtctttacccactttctggaagtgaaagcaacttcaaattgtaatcatttatgacatgagaaaaacaagagttatttttacacaaataaggaagctgttgctgacaaaaaagtaaatgtcttccctcaagtcacaaaactaaccattggcaatgtctggaatatgaggccgaatatcgaattcttttaatgacaccatgattccatagacagtgattccctacccttaggcagtttataacttcttacaaacctaaatcatctactccagacgacatattaaaaattatcaattaggattttctactatctgcacatgcttgctgtgtaaggcattgaattttatacttttagttactctactttttgaaccaaaagttgttcacataatcaaagaatttttacatatttataattgtaaatgattaatttgttaaatctatatgaaagtttatagagtttacagtaaactaatcatccttttaaaaaaatggtccatttaaactactcaatacgtattttttattccataattgacagcacactgtggatagctgagagaccacatattttatttctatactgagtattacttaagtaatttcttaagctattaaatattttttaaatagtttataatggggaggagaagcaaagcaaatggcagaatagaaggctccactaatcatttccccataccccacaaggccccaagttaacaactacacagaaaaaataccttcatgagaaccaaaaatcaagtgagcactcatagtacccggtttggacttcatatccctaaaagaggcactgaagagatggaaaaaaacagtcctgaatcaccaacccccctccctctcaacctcagtagcagtcatgtggtgcacagtctatctctgggcacgggggggaaggaagaacacagcaattatgaggcactgaactcattgttgttatgttagacacaaaggaaaactagatcaaactcagctgacacctgcccctggaggcagagggagcatttaagccagtcctaacctgagaggaatcagcaatcccagcagtaagaacttcagtgcctgaaaacctcaccacagggggcctacagttctctgtgtttccaagtaaacttgaaaggcagtctaagccataaggactgcaactcttaggtgagtccagtgctgaataagtcccagaaattgtggactagggggatatttgacatactgagacaccagctgggtcagccaaaggagtgctgttatcacccctcccccaactccaggttgcatatctcgcagctcccaaagagactccttccttctgctggaggaatggaaagaaacagtaaggaagactttgtctttgcatatcagctgagccacaagaggataaggcaccaaacagagttgtgaggcccccgttccaggccactgctcctagacaacatttctagacataggctgggccagaagggaaacctctgcattgaaggaaagaattcattcctcagagcattcaccacctgttaattgaagataccttgagccctgaataacctaagcaatacccaggtactattaatacactgagggctttggatgagcatctgagactagcaggtttcaggtgagactcagcacatttcagctgaggcagctatgaggcaagattctttcttcttcagaaaaatggaaggagagtaaagagactttgttttgcaccttaggtgccagcacagccacagcatggtagagcagcaagtgggctcttggcatacccaattgcaggacttagctcttgaacagcatttctggacctaccatgggccacaagggagcccactgccctgaagggtgagtcccaggcaaggcagcctttactacaagctgatttaagagccctttggctttaagagaacactggttggtagtctagcaaccagtgggtaggggtcactatggggtgtggctcctctgcctttggaaagagaagagaaaagtgggaaggacttcatcttgtggtttgaacgtcagctcgactgcaatataatagaacaccaggtactcgtctaatgtttttgactctagtccctgacttctggacagcacctctgtatccacccagggcctgggggatctcactgccctgatgggaaggacacaggcctggccggctttgctgcctgctgattgcagatctccagggccttgagcaaacataggcagtagccaagaagtgattacagcaggcattgggcaagatgcagtgctctgtgggcctcaggcctgatgtagtgcagtcataatggtggtggccacagaagtgcttatgtcactccacccccagttttaggtggcacagacaagagagagaaatttttttttttttttcaagaaattaagggaagaaaacagagcagtctctgcctggcaatccagagaattctcctgaatcatgtccaaggccattgaggcagtacttttatgagtcttcaaaaaccacagtattactgggcttgggatgctccctaaagtagagagtttaaatcacgatacctatgtcctttcaaatatctgcagagcgttcccaaaaaggatggctacaaataagcccagacagtgaagactacaacaaacacctaactcttcagtgctcagacaccgaagaacatctactagcatcaacaccattgagaaaaacatgacctcagcgaatgaactaaataagtcaccagggaccaatcctgaagaaatggggatatgtgacctttcagaaagagagttcaaaatagctgcaatgaggaaacttaaagaaactttgataacacagagataacacagagaaggaattcagaattatatcagataaatttaacaaagagattgaaatagttaaaaagaatcagaaattctgcagctgaaaaatgcaattgtcataatgaagaatgcatcagagtcctttaatagcagaattgaccaagcagaaaaaagaattagtcagcctgaagacaggctatttaaaaagacactgtcaaaagatacaaaagaaaaataataaaaacaacaaagcgcatctaccgaatatagaaaatagccttgaaagggcaaatctaagaattgttggccttaaagagaaggtagggaaagagacaggggtagaaaatttatttaaaggaatagtaagagagaacttccccataccagagaatgatgtcagtatctgagtacaggaaagttgtagaacaccaagcagatttaacccaaagagtatctcaaggcatttaaaatcaaactaccaaaggtcaaggagaaagaaatgtaaaagcagcaagagaaaagaaataaataacatacaatgaagatccaatacatctgacagcagattctttcagtgaaaacctcgcagacagtggcatgacatatttaaagtactgaaggagaaaaaccttttacagtagaatattatatctggcaaaaatattcttcaaacatgaaggaagaatactttccctgacaagagctgagggatttcattaatattagacctgtctcacaagaaattgtatataaagagaagaacattagaaagaacagaacattcagtaagaaaagaacattagtgagcaataaataatcatcagatgtttaaaaacacactgataataatcagtacgcagaaaaagacagaatattataacactgtagctctggtgtataaactacttttaccctaagtagtaacaccaaatgatgaaccaatcaaaaataataactacaacaacttttcaagaaacagtacagtaagatataaatagaaataacaaaaagttaaaaagtgggaagacaaaattaaagcattgggtttttatcagtatactttgtgcttgtttgtttatgcaaatagttttgttatcagatttaaataatgggttataagatggtatttgcaaacgtcatggtaacctcaaacccaaaaacatacaatggacacacaaaaaattaaaagaaagaaacaaaattttatcaccagagaaaatcactttcgctaaaggaaggccggaaggagaaaaacaaggtagaggagttcacaaccagcaaacaaataccaaaatggcaggactaagtccttacttattaataataacattgaaggtaaatggactaaactctccaatcaaaagacatagagtggctgaatggatttaaaaacaagacccattgctctattgcctataagaaacacacttcacctatacagatccacatagactgaaaataaagggaaggagaaagttattttgtgacaatagaaactaagaagagtaggagtcactatacttttgtaagaaaaattgatttcacaggtctggcagccaagatggccaaataggaacagctctggtctacagcttccagtgtgagcgatgcagaagacaggtgatttctgcatttccatctgaggtacagtgttcatctcactggggagtgccagacagtgggtgcaggacagtggatgcagcgcaccatgcacgagccgaagcagggcgaggcattgcctcactcaggaagagcaaggggtcagggagttccctttcccagtcaaagaaaggggtgacagatggcacctggaaaattgggtgactcccaccctaatacggcacttttccaacaggcttaaaaaacggtgcaccaggagattatatcccgcacgtggctcagagggtcctacacccatggagactcactgattgctagcacagcagtctgagatcaaactgcaaggcggcagcaaggctgggggaggggcacccaccattgcccaggctcgcttaggtaaacaaagcagctgtgaatctcgaactgggtggagcccaccacagctcaaggaggcttgcctgcctctgtaggctccacctctgggggcagggcacagacaaacaaaaagacagcagtaacctctgcagacttaaatgtccctgtctgacagatttgaagagagcagtggttctcccagcatgcagctggagatctgagaataggcagactgcctcctcaagtgggtccctgacccctgacccccgagcagcctaactggaaggcaccccccagtaggggcagactgacatctcacacggctgggtactcctctgagacaaaacttccagaggaacgatcagacagcagcattcacggttcacgaaaatccactgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatgaggaaaaaagagcagaaaaactggaaactcgaaaaagcggagcacctctcctcctccaaaggaacacagttcctcacagcaacagaacaaagctggatggagaatgactttgacaagttgagagaagaaggcttcagatgatcaaactactccgagatacaggaggaaattcaaaccaaaggcaaagaagttaaaaactttgaaaaaaatttagacgaatgtataactagaataaccaatacagagaagtgcttaaaggagctgatggagctaaaagccaaggcttgagaactacatgaagaatgcagaagactcaggagctgatgtgatcaactggaagaaagggtatcagtgatggaagatgaaatgaatgaaatgaagtgagaagggaagtttagagaaaaaagaataaaaagaaatgaacaaagcctccaagaagtatggaactatgtgaaaacaccaaatctatatctgactggtgtacctgaaagtgacgggaagaatagaaccaagttggaaaacactctgcaggatattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcagccagagagaaaggtcgggttacccacaaaaggaagtccatcagactaacagcggatctctcggcagaaactctacaagccagaagacagtgggggtcaatattcaacattgttaaagaaaagaattttcaacccagaatttcatatccagccgaactaagcttcataagtgaaggagaaataaaatactttacagacaagcaaatgctgagagattttgttaccaccaggcctgccctaaaaaagcttctgaaggaagcactaaacatggaaagcaacaaccagtaccagtcactgcagaatcatacaaaattgtaaagaccattgaggctaggaagaaactgcatcaactaacgagtaaaataaccagctaacatcataatgacagaatcaaattcacacataacaatattaactttaaatgtaaatggactaaatgctccaattaaaagacacagactggcaaattggataaagagtcaagacccatcagtgtgctgtattcaggaaacccatatcacgtgcagagacacacataggctcaaaataaaaggatggaggaaaatctaccaagtaaacggaaaacaaaaaaaggcagggtttgcaatcctagtctctgataaaacagactttaaaccaacaaagatcaaaagagacaaagaaggccattacataatggtaaagggatcaattcaacaagaagaactaactatcctaaatatatatgcacccaatgcaggagcacccagattcataaagcaagtcctgagtgacctacaaagagacttagactcccacacaataataatgggagactttaacaccccactgtcaacattagacagatcagtgagacagaaagttaacaacgatacccaggaattgaactcagctctgcaccaagtggacctaatagacatccagagaactctccaccccaaatcaacagactatacatttttttcagcaccacactacacctattccaaaactgaccacatacttggaagtaaagctctcctcagcaaatgtaaaagaacagaaattataacaaactgtctctcagaccacagtgcagtcaaactagaactcaggattaagaaactcattcaaaaccgctcaacaacatggaaactgaacaacctgttcctgaatgactactgggtacataacaaaatgaaggcagaaataaagattttctttgaaaccaacgagaacaaagacacaacataccagaatctctgggacacattcaaagcagtgtgtagagagaaatttatagcactaaatgcccacaagagaaagcaggaaagatccaaaattgataccctaacatcacaattaaaagaactagaaaagcaagatcaaacacattcaaaagctagcagaaggcaagaaataactaaaatcagagcagaactgaaggaaatagagacacaaaaaactcttcaaaaaattaatgaatccaggagctggttttttgaaaggatcaacagaattgatagaccactagcaagactaataaagaagaaaagagagaagaatcaaatagatgcaataaaaaatgataaaggggatatcaccaccgatcccacagaaatacaaactaccatcagagaatactacaaacacctctacacaaataaactagaaaatctagaagaaatggataaattccttgacacatacaccctcccaagactaaaccaggaagaagttgaatctctgaatagaccaataacaggctctgaaattgtggcaataatcaatagcttaccaaccaaaaagagtccaggtccagatggattcacagccaaattctaccagagggacaaggaggaactggttccattccttctgaaactactccaatcaacagaaaaagagggaatcctccctaactcattttatgaggccagcatcgtcctgataccaaagcctggcagagacacaacaaaaaaacagaattttagaccaatatccttgatgaacattgatgcaaaaatcctcaataaaatactggcaaaccaaatccagtagcacatcaaaaagcttatccaccatgatcaagtgggcttcatccctgggatgcaaggctggttcaatataagcaaatcaataaatgtaatccaccatataaacagaatcaaagacaaaaaccacatgattatctcaacacatgcagaaaaggcctttgacaaaattcaacaaccctgcatgctaaaaactctcgataaattaggttttgatgggacgtatctcaaaataataaggggtatctatgacaaacccacagccaatatcatactgaatgggcaaaaactggaagcattccctttgaaaactggcacaagacagggatgccctctctcaccactcctattcaacatagtgttggaagttgtggccagggcaattaggcaggagaagggtattcaattaggaaaaaaagaagtcaaattgtccctgtttgcagatgacatgattgtatatctagaaaaccccattgtctcaacccaaaatctccttaagctgataagcaacttctgcaaagtctcaggatacaaaatctatgtacaaaaatcacaagcattcttatacaccaataacagacaaaccgagagccaaatcatgagtgaactcccatacacaattgcttcaaagagaataaaataactagaaatccaacttacaagggacgtgaaggacctcttcaaggagaactacaaaccactgctcaagaaaataaaagaggatacaaagaaatggaagaacattccatgctcatgggtaggaagaatcaatattgtgaaaatggccatactgcccaaggtaatttatagattcaatgctatccccatcaagctaccaatgactttcttcacagaattggaaaaaactacttgaaagttcatatggaaccaaaaaagagcccgcaacgccaagtcaatcctaagccaaaagaacaaagctggaggcatcacactagctgacttcaaactatactacaaggctacagtcaccaaaacagcatggtactggtaccaaaacagagatatagatcaatggaacagaacagagccctcagaaataactccgcatatctacaactatctgatctttgacaaatctgagaaaaacaagcaatggggaaaggattccctatttaataaatggtgctggggaaactggctagccagatgtagaaagctgaaactggatcccttccttacaccttatacaaaaattaattcaagatgaattaaagatttaaacgttagacctaaaaccataaaaaccctagaagaaaacctaagcattaccattcaggacataggcatgggcaaggatttcatgtctaaaacaccaaaagcaatggcaacaaaagccaaaattgacaaatgggatctaattaaactaaagagcttctgcacagcaaaagaaactaccatcagagttaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggatatgaacagacacttcttaaaagaagacatttatgcagccaaaagacacatgaaaaaatgctcatcatcactggccatcagagaaatgcaaatcaaaaccacaatgagatagcatctcacaccagttagaatggcaatcattaaaaagtcaggaaacaacaggtgctggagaggatgtggagaaataggaacacttttacactgttggtaggactgtaaactagttcaaccattgtggaagtcagtgtggcgattcctcagggatctagaactagaaataccatttgacccagccatcccattactgggtatatacccaaaggactgtaaatcatgctgctataaagacatgcacacgtatgtttattgtggcactattcacaatagcaaagacttggaaccaaccaaaatgtccaataatgatagactgaattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacagtgcatgttctcactcataggtgggaattgaatagtaagaacacatggacactggaaggggaacatcacactctggggactgttgtggggtggggttggggggagggatagcattaggagatatacttaatgctaaatgacgagttaatgggtgcagcacaacagcatggtacatgtatacatatgtaactaacctgcacattgtgcacatgtaccctaaaacttaaagtataataataaaaaaaagaaaaatacatttcatgagaaaaactgtaaaaagacacaaataagcttactatataatggtaatggggtcaattcagcaagagaatataacaattttaaatgtatatgcacccccaagtggagcacccagatatataaaggaaatattgttaaagagaaagagaaagatagacccaaatagaataatagctggagatttcaagaccccactttcagcattggacagaccttccagacagaaaatcaatgaagaaacatcagacttaatctgcgctatagaccaaataaatctaatagatatctacagaacattttacccaagagcttcagaatacacagttgtatcatcagaacatggatcattctcaatgatagaccatatgttaggtcacagaacaagtcttaagatattcaagaaattgaaataatattgagaatcttctctgatcacaatggaaacatactagaaattaataagggttgggcactgtcctcacacctgtattcccagcactttgggaggctgaggtgggcagaccacttgaggtcaggagttagagagcagccttgccaacatggtgagaccctgtctctactaaaaatacgaaaaaaaaaatagccatgctggtgtcacgcacctgtaatcacagctacttgggaagctgaggcatgagaatcgcttgaatctgggaggcggaggttgcagtaaaggcgagatcataccgctgcactctagcctgagtgacacaacaagactccatctcaaaaaagtaaataaataaacaaataaaagaaattaataatgagaaattttgtaaactatatactgtatgaataaataaaaattaaacaatatgttcctgaaggaccagtgggttaatgcaggaattaagaagtaaattgaaatttttcttgaaacaaatgataattgaaatacaacatatgaaaacctatgagacacagcaaaagtagtactaagaggaaagtttatagctataagtgcctacatcaagaaagaagaaaaacttcaaataaacaatctaacagtgcatcataaagaattagaaaaggaagaccaaaccaaaccgaaaatttgtagagcaaaagacataataaagatcagagcagaaataaatgaaattgaaatggaaaaaaagtatgaaagactaatgaaataaaaacagggtcctttgaaaaattaaataaaactgacaaactttgagccagactaagaaaaagagagaagatccaaaaaaataaaattagaaataaaaaaggagacattacaactgatactgcagaaattcaaaggatcattagtggctaccatgagcaattatataccaataaagtggattttttttttgagacagagtctcactctgtcacccaagttggtgtgcagtgacatgatctcggatcactgcaacctccacctcttggggtacaggaattctcctgcctcagcctcccatgtagctgggactaccggcacacgctgccacatctggataatttttttcttctttccgtattttagtaaagacgaggtttcactgtgttgcccaggctcgtctcgaattcctgagctcagtcaatccacctgccttggcctcctaaagtgctaagataacaggcatgagccaccgtgcccagcctacgtaccaataaaatggaaaatctaaaacaaatggacaaattcctagacacatataacctactaggattgaaccaggaagaaatctaaaaccctaaccgaccaagagcaagtaatgagatcgaagctataccaaaatctctcagtaaagaaaagctcaggacctgatagcttcactgctgaattctaccaaatattttaaaaagaatatcaatcctactcaaactcttctgaaaaatagaggagaaggcagcaagctaacacaggaacagaaaaccaaacaccgcatgttctcactcataaatgggagttgaataatgagaacacatggatacagtgaggggaaattcatacaccggggcctgtcagcaggtgaaggcctaggggagggacagtgttaggagaaatacctaatgtagatggcaggttgatgggtgcagcaaaccaccatggctcatttatacctatgtaacaaacctgcgcattgagcacatgtatcgcagaacttaaagtatataaaaaaagataaacaattccaatagaaaaatgggaaaatgtaaaaaaaaaaatagagaagggaatacttccaaactcattctatgaggcaagtgttatcctggtactaaaaccaaagacatatcaaaacacagaaaacgatagtccaatatctctgatgaatattgatgcaaaaatcctcataaaaatattagcaaaccctagtgaaagtggacacccttgttgtgttccagatcttggaaaaaaggctttcagcttttccccattcagtgtgatagtagctgtgggtctctcatatatgtcttttattctgttgaggtacgtttcttttattcccagtttgttcagaggttttattatgaaggaaagttgaatcttatcaaatgcttttttgccatccattgtgatgattatacggtttttctctttcattctgttgatatagtgtatcgcattgattgttttgcatattttgaactatgcttgcatcccaaggatacatcccactcagtcatgatgaataatctttctaatgtattgttgaatttggtttgctagtgttttgttgaggatttttgcatcaatatatacacctactctgcacccacaaaaattattaaaaagaatttttaaaggaccaaaaaaagatagacaattcagttggccaacttccaaagaattgtatgacataatatttggacactgccacaaactccatacatgtgaaggacacaattactattgtatggttcctggacgtaccatcttcacttctgtagaactatagaaataagtgggtgacaggtgggaaaagatttgtaagttatgttaaggagtttctaaatcatcacaggggagatgtcaagccactggaaagttagaactggaaaaacatggtggagaggaggatgtctcttattgggatgcacaaaagggatgatggacatctgagctagcataatagcctattgagatgagaagagatacatagatttgagataattcaaaggtagagttgacagaatttgatcattgattgagaaagagtgagaacattgacatctaagtttctggattgatcctctagaagcaacaataatcttaattctttcaaaggaaatcatatgcaaattggtagttgacattttgcttgaagtctttaatataatattttcatgattgtaaaaccaaatgactctccatatttatgaatgtgcttacttttgacagaattttcataggctcactccttctaaactcagttcccttaactctcttcgcatgagatcatatgtttctcaataacaaattctgcagtaggggctattaggtgcccaaccccatctccacttttcactcatgcttcaggaagaacagtttgctatttaccagggaagtcttttaaagctgctatggacattcagctaaaggacactgagaatgtaactaagaaattcaatgatgtcttcaagttgcctgactataggttttgaataacaatgacctacacttattgagagattaacaatacgccaggtaccttctaacttctaagtatactgttacatttggtcctcacaacaattctatgcggtaatcattactattatccacattttatagagcaggaaattgacatagagatagcacaaatagattgctcaaaattacacaagatgaaaatagccgactcaggtttaaggccacagaacttgtgccaagagctctcacgtgagatatacaaacaaagattccttttctaattgccatcagctatttgagaccatattatctgccagtttccttgttgatctagaagcctctttaatcattaactacttccccagaggctctgtctccaaatacggttacattgagggttaagtcttcaacctgtgagttttgagggaacacagtatagtccttaaaagttgctctctgttcccaagctgagtgctaagatctttcctcaataatgaattctttttttgcctaagtcagccagagaagtgcttttaaccaacaatgctaatgagtaaagtatctatatatgatagcaatatatttggtatcctttatttgatgaaatcatttatttgatgttcctttcatttgtacatgtaatcaagaatcatttagtcatttattcaaacatagttttaccactgccatttaaccacctgtgtgactttagagaaattcatctaagtaacagttcccttaactataaagtatagacaattatactgaccccaagattgtttgaaggatttggggttatatgaatctatataattattaaatatcctgacaaatacagttgacccctgaacaacacaggtgtgaactgcatgggtccacttatggttggattttttgcaataaatacagtcaatagtccatattggtaggttccacatctgcaaccccatgcagattgaaaatacagtatttgcaggattcaaaacctgtgtacacagaaagctgattttcctaatggcaggttccacagagccaactgcaggacctgagtatgagtggattttagtatcattggggatcctggaaccaattcctccaggatacggtgggatgattgtagtattaactggcagtatcatatgtttgggtgggctctgacacctttttaaaaaaagatggccaggagaaaaaaaaatgaatatttaatttttggttttcaaaactgtgactgtgaaacaaagctaattccttctttttttcatagtgaatatgttttttaatcattaactatttctttacaaatgaaaattgtatatatttattgagtacaacatgatgttttaaaatatgtgtacattgttaagtgacacagtagagctaattaatatatgcaatatcttataaacttttaatgtttggatgagaacacttagaatgtattctcataacaattttcataaaagtatttttaaacatagtcaccatgcgatacattagatttattggactgctcctaccatctaactgaaattttgtgtcctgtgaccatctccccaatccctaccacctcctgcaacctctattaaccactattatactctctgcttccatgaatttaactttttccaatttcacacgtaagttacataatgtggtattcgtctttctgtgcctggtttattttacttaacacaatgtactccaagttcatctatgtggtttcatatgactgaatttccttccttttaaaagctgaatcgtattctattatgcgtatacaccacatttttaatgttcataaatctgttgatagaaacttaggttgattatatgacttggatattgtgaataattctacaatgtacatagaagtgcagatatctgtttaacatacaggcctatctcagtgattttgaggattcagttccagacgactgcaataaagtgaatatttcattaaagcaagtcacacaaagtttatggtttccccgtgcatataaaagtcatgttcacactgtactgtagtctattaggtttccaattgcattatgtttttaaaaagtacctatcttaatttcaaatactttattgttaaataatgcctaggataatctgagctttcaaagagttgtaatctttttgctggtgcaaggtcttgtttcaatgttgatggctgctgaccagggtgggacttgctgaaggttaaggtagctaaggtaatttcttaaaataagacaacaaacaagtttgctgcattgattaacacttcttttcacaaaagatttttctgtagtatgtaatgctgtttggtagcattttacccacaataaaatttcactgaaatttggaatcaatcattttaacccctgctactgctttatcaactaggttgatgtaacattagaaatcctttgttaccatttcagcaatgttcacagaatcttcaccaggagtagcttctatctcaagaggtcattttctttgctcatccataagaagcaatttcttatccattcaggttttatcttgagattgaagcaattcagtcagatcttcacactctacctctaattttagttctcttgttatttccaccacatctgcagttacttcctccatttaaatcttgagtgcttcaaagttatctgcaaggattggaatcaccttcttccaaattcctgttgatgttgatagcttgatctcctcccatgaatcatgaatgtttttaatggcatatggaatcgaaaatccttccaagaggtttccaatttactttgccctaatccatcagaaaaatcacaatgtattgcagctatagccttacagaatgtatttcttaaataataagaattggaaagttgaaattactccttgatctatgagctgcagaatgaatgtatgttagcaggcatgaaaaaaatatccttttacatctccatcagagctcttgaatgaataggtgcattgtcaatgagcagtaatattttcataagaatatttttttcctgagtagaggtctcaatagtagccttaaaatattcagtaaaccatgctgtaaatagatggtgctgtaatctaggcttcgttcttccatttatagagcataggtgaagtctatttaccataatccttaagggccccaggatttttggaatggtaagagagcattggcatcaacttaaagtcagcagctgcataaactgctaataagaaagccagcctgtcctttgcagctttgacggttggaattgacttcccctttctagctgtgacagtccttgatggcatctccttccgatagaaacctgtgtcatctaaatgggaaatttgttgtttggtgtagccacctccatcaattatcttagctagatattctggataacctgctaccgtttctacatcagcacttgctgcttcccttttgcacttttatgttatgaaaatgggccaggcacggtggctcatgcctgcaatcccagcattttaggagactgaggttggtggatcacctgaggtcatgagcttgaaaccagcctgaacaatgtggtgaaaccccgtctctactataaatacaaaaaaaaagtcagccagctgtggtagtgggagcctgtaattccagctactttggaggctgagggaggagaatcacttgagcccaggagcagaggttgcagtgagccctgatcgcctcaccactgcattccagcctgagcaacagagtgaaactctgtctaaaagaaaagaaaagaaagaaagaaagaaagaaagaaagaaagaaagaaagaaagaaagaaagaaaagaaagagaaaatggcttctttccttaaacctcatgaactaacctctgctagcttccaactttttttctgcagcttcctcacatctcttagccatcaaataactgaaaagagttagagtcttgctcgggattaagctttggtttatgaatgttgtggctagtttaattttctatccagagcactaaaactggctccaaaacagcaataaggctattttgctttcttatcatttatgtgtacactggtttagcactattaatttccttcaaagatttttccttgcactcacaacttggctaactgtttggtgcaaaagatctagttattggactgtctgagattttgacctgccttcctcactatgcttaatcatttttagctgtttgtttaaaataaaagactcgtgacccttccattcacttgaatacttatagatcattgtatggttaataattgatgtgatttaaatgttcttgtgtctcagggaatagggaggctggaagagagggagagagtctgggaacggtcagccggtgatgcagtgagaacactcacaacagttatcaattaagtttgctgtcttatatgggtgcaattggtggtgctccagaacagctaaaatagcaccatcaaaactcactgatcacagatcaccttaacagacacaataacaaggaaaaagtgtgaatattctgggaatgaccaaaatgtaacacagacaggaagggagcacatttgttggaaaaatggtgccagtagacttgcttcatgcaaggttgacacaaaacttctatttgtaaatagaacctttatagtacctctgaagtatgataaagtgaagtgcaataaaatgaggtgtgcctgtactgatttcatttcctttaaacatatatgcagtagggattgctggatcatatgttagctctatttttagctttttaaggaatctctgtactgttttgcataaggctgcaatagcttacgttcccaccaacagtacacaagggttcccatttcctcacattctccccaacagttgtgatctttcatcttcttgataatagcaattctatcgagtacgaggtggtattttggttttaatttgccttttcttgataatgagtactgttgagcattaggaaaaaaaaaacccttagttatttatatgtcttcttttgcgaaatgtctattcaggatggcggtgggaagctagctgcagccggctggggagggggtgtctgcacaccagagagtagtgtgctggatgattctggcacccggaatagcctcctcctcctcccactgcctagacctggagaagccccttctcatccttctcacccatccccttgtggcagggcaagtgggctgagctgccccatgcttgcacagcccagagcccgaacctgcaggacaagtgctgcagagtgaacttcacctcctttccagggctcacgtgtgagccactaccctaggttgtgttgatgtcttattgctgtttctccaaaactgtaataagaccatttttctacttatcattcctgtttacactggactagtacttttaatttccttcaaaattttttcattgcactgaaatctgtttttgtattgacatcctgactccagacttgcctttccaaatctagataagcatagtgaccattccccataaccaagatccctttctcactgttgcctctctcctgacatacctgctgccgtattccctactcttccccctcctcaagaaaataaataaataaaaaataaaataaaaaaagcaaaacaaaactacaaacaaaaaatagcttactcaaggaattaggtaggtagggaatgatggatcacattggagtctgggattaaaaacacacacaaaaagaaaaaagttaaaatgcacttgttttctctacactggctaagaatattgctctacagtataaattttaatgtcatgtgtctgaatgtagtgtgcatttgagtagcattgtgtgtgagtggctccacaagtaccttctagtgcagcccctcagtttaaagaagaaagtggggggaaaaagaaactccagaaagctttaatgttcttgagtgattcctttacctaatgagcatggttttaacaactggagatgagcctactttggaaacagcccctcttaccccatatttattcttagggcacccctttatccactccatgcccattatgtctcattctcaagtggcaatgagttaactagaaatttaaatattttctgtaactttacacttagattatgctttgttatgaatttttacacccttcttctcttaaagatgcagaattgggctttaaaaaaaattattggctcaaataagcccttccccttccacttgtctctcgggaatgtgagctgatggttcttaagatgttgagttttgtttactattcactgctctttagccaggaattctctagtgatcagaagcaatgcaactgaagaccagtttttaaattatgtgttgacatgttaccttatatttaaaaaggaaaaaaaattagctggcttatattatgccagatgtcagtaacatgaagtcctaatttattgttctcagttgttttcctacctaatgtgaacttccgtgtccctgagccctcaggagtacctacagcttatggtgcaatgtcttctcccaaagtgttggccaccatttcacccaaggccctcttccaattcttgcttatctgagtcagatttagagagtaccactgtctccccttatcccttacttcatctccaaaccacatactcgtgctatacttttcttctcagtacctctccctgaatgatgagctgccattttaggaaattggaccagataccaatttgggagctttcagtcaaacagcctcaaacccatttcttcctatgaaagggtgcaagtctctgaagctctcactcacccctgtagtctgtgtagaaaatgtacttaatccccctggccccctactgtcattgcctttggtgtgagatgttccctatttcctagtttagtttgagtccctctctcctctgctagccaacacccatccagcaataaggaaccaagcgacagcctcctattcacactccctgccccctttccacactaccctagggaatacctggattgccccactctgtccacatactgtagcattcattctctatcatcctctcacctgtggtggtttatggatgtgatagagtttttaagattactacaaactagtaaagaggaaaagcaactcaaagagagagaaagagagaaagaaagaaagatctgttcagggtctttgcccatttttaatttggattatttgttttcttgctattaagtttattattattttaaaaattaaccccttatcagatgtatggtttgcaaatattttcttccattccataggttgcctcttcatcctgttgattgtttctttgctgtataagactgttttagtttgatgtaatcccatttgtctattttgcccttcattatctgtgctttagggattctatccaaaaatcattgccacaactaatatcacaaagcttttctcccatgttttgtcctagtggttttgcagtctcaggtcttacatttaggtctttaaaccatctggggttgagttttgtatgtggtgtgagataaagtctaatttcaattttctgcatgtggatatgcagtttttttcaacagcatttattaaagagactgtctattccccattcacgtgttcttgacaactttgtcaaaatcaatcatcttaaatgcatggatttatttctggacgttctattctgttccattgtttcatgtttctgttttgatggtagtacaatcctgttttcattactattgctacatagtacattttgaaattaggtagtgtgatatctccagctttattcttgttgctcatgatcgattttgctcttaaggatcttttgtgataacatatacattttttggtgtgttatatttctttgaagaatgtcattggtatttacataggaattgcattgaatctgtaaatcgcttggggcattgttgtcattttgacagtattaatttttgcaatctataaataataaatagctttctatttatttgtgttttcttcacttttttcatatatgtttcataattttcactatataagtcttttaccacgttatttacatttactcttaagtatttattttttgtagcttatgcaaacaggatttttttctttgtcaggtctttcattgctagtgtatggaaacactactgatttgtgtatgttcattttgtatcttgccacattacggaatttgtttagtagttttaacctagtttgctgcagtctttaggattttttacatataagaccatgctatatgcaaacagggacatatttagctacttcctttccaatttggatgctttttatttttttctcttgcctaattgctctgagtagaacttccattaatgcactgaatagaagtagtgagagtgagcatccttgtcttgttcttaatcttagaaatatgtttttcacatttcaccattaagtgtaatgttagcggtggatttatcataaatggtctttattgtatgagctacattccttctatacctcatttgttgagagttcataatcaggaaatcatggtgaactctatcaaatgctttttctgcttctatcaagtatcatatggattttgttgtttattctgttgatgtggtatttcacatttatagatctgtatgttgaattatctttgcaaccctacgttaaagcccactgtatcatgatgaatgaactttttgacatgctgttgggattagtttgttagtattaatatttattgatgcacctatgttcattagtgctattgcctaatattttcatttgttgaagtgtccctatctttggtatcaggattatgcttgccttgtaaaataactttggaagtattccctcttcttcaattttttggaaggcttttagattggattgacatgagttcttctttaaatatttggtgaaattcagcagtgaagccataaggtcctgggctttcctttaatggaatattttttattactaatttaaccaccttactcattattggtctgtttagattttcaatttcttcatcttggtggggtttatgtatctaggaatttacccatttattgtagattatccaatttgttggcatataatttgtcataatagtctcttctgatttttttgtgatgtaagttgtgatgtctcctttttgtttatgattaactttttttttcccccttagtctggataaaggtttgtgaatcttatttaacttttggaaagatcaaatttcagggtttttttttttcattgttttcatagtttctatttaatttacctgccccaacctttatttattccttcattctattacctttggacttagtttattctttttatacctccttgaagtgtaacattaagttgtttaagatctttcttctttttcagtgtgaaagttttgaggcatctaacaagttttggtattttgagtttccatttttgctgttctcaacatatttttaaatttccattttaatttcctctttaatccatctgttgttcagaagcatgctgtttaattttcatgtatttgtgagttttctaaaaaattttcctgttattaatttctagtttcatgtcattgtgatctggaatgataaatggtatgatttcagtcttcttaaatttattatgacatgccttgtgtcctaatatttgttctctagcatttcctgtaagacagctctgatggtaataaactcccttaatttttgtttttctggcaaagattttaatctttccattacttgcaaaaaacagattttcccgagaatcgtatttttggttgacactttttttttctatagaacattgaatatatcattccatgctctcagcctataagtttctcctcaaaaatctgctattagccttcttggaactcccttatatattatttgcttgttttctcatttatttccagaatcttccttttctttgatttttgacagtttaattaaaatatttcttgtactcttgatgggactgaatcatatcaaacatcttcaatattcctatacctgtatatttctctttccccagacttggaaagtattctgttattatttcatcatataagatttctttccctatgtgtttctcttctctttctgggacacacatgatgtgtgcattggttctcatactgatgttctataattgccataggatgtctttattttttctcatttttttccttttgtgtctctgacagtaaattcaaatgatgtgtctttgagtttattgattctttattctacttgatcaaatctgctttcaaagaagtctatgaaattttcagttcaaccgttgtgtcctttatgtccagaatgtctcttttttaatgatttctttctgtttgttgaactttctattttgttcatgtattatttctctgattctttttagtcatctatctgtgttctcttgaagctcactgagcattttaaagaccattattttaaattcactgtcagaaagttcataaatctttatttttgggggtcagctattgggtattcttttttttcctctggtggtatcatttttctcttatatttcttgatttttaggctgtgcattggtgtctgcacatttgaaaaacaagaaagttattccagtctttgcatactggctttgtctggaaaaacctttccccagtcatccagcaattcttggtagggtgtctgttgtggtgtgcaggtgaacttgttgctgaagtcttcaggcaggctggcctggtgtctgtgtcagcaggtggtaggcttggttcctgggtctgtagagttgggcctgaatcctatatccactggctggatattttcattgggtatgtggggatgaacataaagcctatgtctatcagggcaggcatacagcctgtaccagtaggggctggaatgaagcccatgtctacaggggctgacatggctctgatgtgggcattgaacctgtgtctacaagggctggctaggttgtggaatgggcctaattaaggacattaatatgaacgaagcatcccagagatccttgacacattgtgagaatacacagagggagcatctccaccagcctcccacagacactcagccatgcagtccccattccctgccatgagcaacagtttcaaggcttcacaggggttcaaagatggccagcttattgccactctttgtagtatgaagtataccaaaaaataaagatagatcaaaacattgataatataatggctttaaaatctgtgtattttataaatgtatgcttacaaccacaaaaatgccatgcaatactgttgttctactcacaagatcagtacaggaattataaagcattgattcagggttgacttctgccagcatgtaactgatggtgaatgtgttctcttcattctgcctgagtttcaatgggtgatatcattggtgatacagctggaatctcatatttgggaccctttttgaaagtggggccatgcctaaattgtatcctaggtgtctactccaccatgaccccctgaaggacctgtggtttcccaaaggttggaagaagattcagggctaagcagttggagagacctagaatcagagatctctcacacagactgaaaaccccaaaactgattagcataacctcagcaccagtaaaaccagaattcattgcttccattcagagatcccatgtttgtgccagaatccaagctgcaatgagtgtttcgggaagtcacttatgactaatactgagtatgatgggactgatatcagagctgagctaggcccagagggcccagaagcagtgacacagaaggctaaacctttcagttttgatccatagattagctacatcagagaagtggacttggagaatcccctgctggagtcttgcagagtaaccactctgtcagatagcatgtgtttctgggaggaagtcataggggtctagttccgccttatacccctgcacaccataagcatgggctgagatctagagagagtccagagctggtctgaaaggctgatacaaaggagtctgctctggaactgaggtattctaagaacttggctatctcagcagccctacagatgggagaggagcccacagatgggagaggaagctattctcctggccaaggtcctgagacagtttgacagaagcctaggcagacttgaggccgactgcagctagcactggcactcgaaatgaaacctcccctgtagtcccatggatagttttttgtataaacatagaaattgaccattctggtcttaaagcttgaaacttttatttgttttctatgagtttcatccttggtaaaggacccctaggtccctcaaaaagtataaaagaactgaaattcaccagatgattccatccagatgatggcacaccagacccctcatacattatgattgcttccttaggtctcctgagttcctgtttttctacacatggttacttttcctccctgctatgtaaactcataattttagctggtcagggagatggatttgacactgaactaccatctcctctcctacagcatctgattcagccttctcccttggcaagaattgttgatatgaattggttttctgtgcagtgagcagctggagctagaccacacccctggtgtttcactaacagattttgattccccaaccaggaacactttggctcagctaccatgggcggggaatctcaaagtcctcctaagcagctgcttacccaattttggctagagatgagtaccctctctctagggccagccacagctggccccaaccatgttcctgattgccttgggagaactgcctttgaaatttgatatttgcatccagataggtgactctcctctgtgggcccagacagaaagatctcctcctcacagtttgggaaatttttaaaggaatttccacttgcaggttgaacaagcccaattgatgaagagagggaagtaccctgactatttcagtacggacactcttaggagcttgtttgtcattgtgtgtgtatccaggcaagtgagtgtcatttgtgggaaccagacagtgggatctgctcctctccatctgagaaattctgaaggaatttttatttcaggtcgattgagcccaaccaatggagagaggaagcaccacaactctttcacatcgtagacttttggggcttgtttgatgctgcagcagttggattgtgttttagtaattgtttgcatgtgtctgatacagtcatgggaaattcgaatttgataaactggtactcttttgtgacactgtttggctccagtatagtttggaatctggagtttgctgttgaatgggaaagtgggattttgtgctgctgttttaagcagggtcgggccaggttaatatgtgatgatctcatgcggtgccgtttttgaccccagtgttttgggagtatagggagttttggcctttaaaaatcaaactgccacagaaactcattttatttaaaatttgtttcacagccttccctggattacctatcaaggctaacaaagttcagccatgtggacatgtttgcagacagttgagactgtattactatctcatggctagagttccaaggtaaaagcttttggatctttgtgtgtatatacatctagatgtgtttatgtgtatgcacatgtattacattatatgttgtgactaccaaattggcttatacataaaagaacactcctagattaagtaaataagtccaaagtattttttacattcacgttacttaagtaaatttttaagaagctagcattaaaattattgtaagataaaaatagaaatgtcttcagaattgtcagcatacattttttcggggttttatgtttgtctctgctagatattttggggcatcagagtgtggcacagaaagttataaaactataaccagtagtttgagaccagtctgaaaaatgaagacccccccccgccccaccatctctataacataaaaataagacaattagccaggcacattgattcatgcctgcagctagtcaggagactgaggtgagaggatgcttgagcctgaaaggtcaaggttgcagtgactcatgatccagccactgcactccagcctgggtgacagagtgagaccctgtcaaaaaagaaaaagataagaggcagagaatgacaatggggcacaggagcattgcagagaaactaggggaacagttgtaattgttaatacgatggtcagaggaggcctcattgagcaagtggctttaaggtgaagatttaaagagggtaataaggttttctataggtataatgagaaaacagaatgcaagcagaagaaaaaggacagcaaagtgcctgaagcagagaaggcaaagagattgaagtcagggacatgactggagggatgtcagggaggtgactggattctaagtcatggagaacttagagggctgttataagacttttatatatctttctctgaatgagattgggagtgacagcaggacttgcacaacgaataacaaaatgtggcttttgttttaaaaggagtgttctggttttacatagagaaaagactaaagacattctccatccagaaaagactgccaagaactctgaagcatctaaaagtttacaggggcacagatgcagaaatgctggcagatgacacaagcttccaggtaaaggcaggattttatatgccttcaacaggcagaatgatttatatgtttgtgtcagtcatctttgctccacaagtcctacagaggaaatacaggaaggcagattaatgtcacaaattcaatagatgtgtgttgcagcaaaactgccttctgcttcagaagaaagcagtatctccagcttccaagctgtactctttacaaacatccttgaaaggataggagcaaaggctgtcaatgtctctgctcctaagacatgcagaaatgtgagaggccatgaagacttttctcccaaccagaatgagcagaatgtcataatggattggatgtaaagtgggaggggaaaagatacttaagaataattccaagagtttttatttgaataggtgaaaaggtggagttgccatcaacttaattgagaaagactacaggtgaagtaggctgggtggagagggtggataaggagtttgatctgagacataatgagtttgagatggctattgggtggaatccaagagatatcaaacaggctattggatacatatgtcttgagtttggaaaagagttttaatagtaatataaatgtattagtcattggcaagcagattgattttaaagccatgggaacagatgtgattactagggagtaagtgtggatacaaatgaaggccaatgattgaactctaaagtgatgcaaaattaagaagttggggagaaaagaagggtccacagaggagactgagaaataaccagtgaagttaaaggaaaagaagagagtgtgttttctcggaaaccaagtgaagaaagtcttaaagaatgatctattaagaacagaagcaataattgaccactggatttaataacatagagatcactgatggatttaaaaaatgtttcagtaaaatggtagcagcaaaaacccagttagataagattagggggaggattggaaatagcatttgtagacaatcctttcaatgaattttgctacagagtgttaaagcaaactaaatatggtctgagaaggactctgtgcttcatttgagcccttgtgggtgtagagtaacctagcttaatagacaaaattgaaaacctaatttaggagtctgcacctgtaacaatatttgaatgctggccagtcccagcagccttacatcaccactcatagactgctgaatgctcaaactgtgtttaaataaggcaaacgcccaggtgacagaaatctcactgtttctgtaactcatttccggttcctggatgtcactttaactttttttccctataaatttgttttgaccacaaggcacccctggaaactctgtgaatctgctgtgattctgaaggctgctggatcgatgaattgttcattgctcaactaatctcctttaaatttaagtcagctgaagtttttattttatcagattgtgtcagaagcagaatctgaagtggagcttctagtatccccaggagcactgagtaaacacagaaggtacctgcgggatccacttgtgtccactgatctctcagagcagctgaggatcaaaggtaagctccctcttgcattttggagcttcacacatttgtgttttgagctctctgagtttccttgtgcaaatttgtgatccaaactggttttggagttgcaacagaaaatggactgggtctaggaatgaatttgatctgggaattaactggcttggatccacttagaggccactaacagtagaggccactaacagctgactgggtcataaaggaagtggtagtaagcagtaatgtcgcagcagtcataaaattcggctttgggaaattcacagggatttttgtgttctacccatttgtttcatttttcttgtgtacctagataggaaaattcattggttaagttaatcaaaagaacctgagagtaaagtcagtattttatgtaaaactggaatccttaatttctgaaaaactgagttctttctggcttatacattaggactggaaggcagagaagtcttacacaaatggcaaaatcttactaaagataacttagagtggaacattccaaatgaaaaacaatgcattgaactacatttaaaaatgagggctctcagtaaagtcccttttggctaagaaccggtttggcactatagaatgtcaactgttatactctttggcacatttgtaagaattccaagtgttaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaaaagaattccaagtgttatttcaaaggaaatttacagatatgtttccaaattttctatgcttttttcttatttttgtaatgaaactgggaaaaatttcaaaatggttatagatctgaaatatttggccctaagaaactaaagaaaatctttgccaactcctgctctgaggtttccagtcacaactgttcttagatatttcctattccagaagaaagaagactcttcaggcatctgatgaccaaaataaaagaaacattatgatggtggtggtggagtgttctgctacaggcatgtgggaggctcacagaactcttaatattcacttttaattcattccaccagagaggaaatgcatgggttttggataggactctgtcatttatccctgtaagaacttgagaaatttatttagtctctctaagctttggcgtattcaaaatgaagacgatactaacagtacctacatcatgagtgttacttgaatggagatgtgtaaagtgcattttaatttcatctggtcctttaacattttcccttcacttctcttcagagttttttcttgaagggctcgaggactgaagcatcccacaaaatgattctattgaataattctgagcagctgctggccctattcaaatctttagcaaggagcattcctgagtccctgaaggtgaaggaacagtgggaggttggggtatgggagtaggggtgttgaggatgagaaaataacaggcccaagaatctcgtccttcctgactttgtgcagagggttggagctgggaaacaggatggggttggggacaaaggaggcatgttaagagctgctgcttctcctcggcaacaggcaactaggccgactctgcagattttatcactcatttggagaggtggtgaagaatggtggctacgaacatcggtttggggccagattcaataaatatgcattgcaaggctgccattttttagtcagatatcattgtgcctgtgtctttagctttctatgcctttatctttggtcttttcattaataaaatgggaataatattagtagccacctattaaagttgttgtggacactgaatgaatccatacaatataagtgctaagtgcattgtcaagtgcccagctactgcacagtagctctgtggtatcacaaggacacctccctgggagttctgcctgtttgctggtgacttcacgtccatcagtatggtcctggagatgctgctcatcacactatcaccaacttggtcccagtgctgtctcctgacttccatttttctcttcctcttcacatacagacccccatctctggggatctcaacctctcctattccctttcatccctccttcaggtgtatggctctctgtttcacatcaatcacgggaaccccttcaacatggaggtgttggtggactcctggcccgggtatcagatggttattatccgacctcaaaaacaggtaggcacacagacagggactggtggagccaggcaggtccaaagggcctgaggaactgtccaattcagacaccatggctgctttcatagggtgaaaggaaatgtgagtattttaaaacactccttcgttaatgagcagcttgcatgaatgccacatgttaacactcttcccgtaagcataagactaatttgggaaaggggttcaagggggaaggggaggaaaaggacaaggctgacactcacagattaagggccctttgaggtggcaggggtcacctgcaggggctgaatggaggccaatttacagggaaagttgtgtgtctgagatatcagaacagtgatttagaaacaaaaaccaaggcagtagtctaccagcaaaattacctctcatggccaggcatggtgtcttttacctgtaatcccagcattttgggaggccaaggcaggaggatcgcttgaggccaggagtttgggacctgcctgtgcaacatagtgagacctcatctctacaaaaaaataaacaaaattagcagtgcatggtggtacatgcctatactcctagatgctcaggagatggagatgggaggatggcttgagccccagaaggttgaggctgcagtgagccaagatcacaccactctactctagcctggccaacagagtgagaccctgtcataaaaaaataaaagttgcttctcaggaaccagggaaggggcacacaattactgtgtgtcaactgtttggaagcacctcactcattagtgactgtcatcatcagaacaattttacaaagtgagctttaatatcttcaatttagagatgaggaaacaacactgagaaatattaagtcctgtagctgctggataccaactgttaaagcattccccaatctgaattcaagttcaacggactctgccacttttactagctatataaccataggcccttctgtgagttttatcatctgttaaaatgggaaaaattggaggacactcttcagaggatcacagaaggtttaaatgagataccatatgtcaaacacttagtacatagcacataattctaaatagtatttaccataattagccattgttggccgaggaaacacaaggtatacacgattaagctgaaatagtaatacaaacctaggtctattttttggccctaaaggcttcccctttttgtatctgtttcatgcacatctggttagtgaactgaagcctcatggacagcccagcttcaggtgggtatagacgctgagcccccacataataataagctgagcctaacaccttcccagggatgttcttttgatctcaaggtttcctgacaatttcagatggaagattaatgcttagtttatttgatccatggtccaatttcttcaaagtgtgatatgctaaataactgtatgaggtcaaatagttctttttacttcagtaactttgtagttactatgtgtattttaacaatgtaactgcaccatcaagctgtaacttcatatatgcattgctttgaacaaggctagtttttataaagtgagtcagtaaacaaaaatattaaaatataaaagttccatgccacacatacatgaccaaaaaaatggaaagaatgaaatatgctgcaatttacttggaaatacattcacctagtctgattccatagtataccacgtttctttcagtattgaaaatcgatgcaattttgaagaagacctttttaaggtgagatgcaggagaatttctctagaaaaaaattaattttttctttcttggtttttaatcagaaagataatatatgctgattatacaagtggaaaaatccaatatgattttaagaagttaataacctctcacctcctttgccctcctctcctccattcctaccctttggggtaatcagtgtccttgcccatattaacacacaaactgtcatcactttttaatttgcctttgacatatggacattgctttgagtgaatcaatacagcactaacgttttcgttttagtaactgtggtgttccatagagtcaatgcaatgctagtcagtcattctcctcctgttgggttcaaattgttcatacttctttgccattacaaacaatgcttcagtaaacatccttgtatacatgtctttacatcctggaaacttttctcaatgcaattggtttccaaaagggatacgtccaagtaagagcttctcttatcctaagtaggcactgccagactaccttcccaaaggattccacagtattatttccattagcaatttgtggaagaattgtttcccacattctcaccagcactgaatgttatccttcttctaatttctgccaaactggtgggtgaaaagtggcatcttattgtagatttaatttgcatttccctgactagtgatattcaacatatattttcatatgattatcagtcattttgggtttacttctgaactgtttatattgtttgaccatttttacactgggattttgtgtcattcttaaaattctctatgtgttttggatatgagggatactaacacaaggtgtatgctacaaatttgttgcccaattgagaattattttctattttattgatagattttcacatgaagcaatttttaattttcatgtaatcaaatatattatctttttcactatgattcctgaggctttgggggtttttttgttaataattaggaagatttttcctaatccaagatcatacaagttgtttttttcattttgtcttacagtgagtttttacttttgacatttcaaacttcattctatttgcaatatatttttgaatagcatgcattaacattcttttatatttattcaccttatggctggctaattacattagtgctatttattaaataagtcactctgctactgaaacataaatgtctattttgtcatgtaacatttttatatatttttgtagctatttctgtatttgttttagtcttttctcatgctatttcaatgttttgtggtaaatattaatatctaataaagcaaatcacccttcactaatgtttttcttgatttcctatttcttataaacttaagagctatatgaacaaaaactaatttttcagttccccaattcccccaactaagtattgcaattgtgatttgtattggaggagttttttagacaattgtggaagcattaatatttttgtgatactaaatatttttatcaagaaatatggtctttctctcacttttttcagtttctgttctatgccatctggtaaaatattagtgttttcctgaggtaaactacattgttttctgtcgaagtctcttatattttctaaatgtgtaatactgtaatctataaacaaagtaatttgctgcttctttgccaatatttgtatgggtttttagtttcttgccttattgtataatgtacaacctaagaaaacaatatcaaataaccataataatagttctattcttgtctcattcctgattctaatgaaatagctataaacacttacctttaaaattacatttaattctgtctttacaggcttagagcactttcctgttttcccactttcatagaaattatatttagaatgaacggtaaattttatgttatttcatttttgtctttttatggaaatttatatactcatgtaattttttcctcctttaatttattaccctaaaagatcttctgatcaaactcattctggcctttctaaaacaaactgttcatgttcacattcttttcatatgctactgaatattttattcagaatttttgcatctgtattcataagccaatatggtcagtaactctctttttgttatttctttaccagatttggcattaggatcttttcatcttttaccaaacaatacaattaaaattatgtgtttggttttgtcttatgtagaattgaaatgtaaaataatctaattttggctactttttagtttgtaatttcaactttccttttagataaagggggtacatgtgcatatttgttacatgcaaatattgcatgatgctgagtcttggagtacggacagatcccatcaccctggtagtgagcatagtacccgataggtagttttctaacccagcccctttccctccaccctctagagtccatagtgtctattgttcccacatttatgtccatgtatggtcaatgcttagctcccagttatgagtgaaaacgtgatatttgattttctgttacagcattaatttgcttaggattattacactgtggaaagtagtctggaaatttcttagagaacttaaaacggagttgccattagacccagcaatgccattactaggtaaatacccaaaagaaaatgaatcatcctaccaaaatgacacatgcactaggatgttcattgctgcactgttcacaatagcaaagacatggaatcaacacagatccccatcaaaggtgcattggataaaaaaaaaacttgctacatacattcatatggaatactacacagcagtagaaaagaataaaatattgtcctttgtagcaacacggatggagctggaggccataattcttgtccacttttcaaatggtagatgtttaatttcatttctgatatttctattagttcactgaagttttctattttttgaaagtcaattttgatagtttattcttgagggataacatccatttctttatcagtgaatatgttgccttggagtatataatcttctattataagtcttttttcttttctgtttccgttctcatggctcatactctatgcctttttttctcttttctctttctcttctatttcctttaaatgccttaccagaagtttatctctctcttctgctctttctctttttcccatttaataatgaactttctacatttcagtatttatggcttttatttttacaaattgttccattagttattttctggtttactttgatattctctttataattctttgaatatttacttggctattttaagacattcttttaaaatcgggtcttttaaaacttctactcttttaaattcactgaggtgttgtgttttggccatattcaggaacttgcatttataaaagcacccccaaatttttgaaggtttccttaaaattagttacactattttctcttttactccttaacgataaaattttcaacatgatattaatacattcactgctaaaactctcacacttattgtttatatttcccctgataaacagatacacatcgtcccatgaagtttgtggcttgtcagaatgggatcacaagtctctttctttaaaacccatgagtccaacaccacataaattgtgcagagtgctaccgaaaattcagttacttcattctattttgtgggcttctggctgtaaaggccatgtcactcttcaaagaggctgatatcctgtagccttgggaaaaggcaatgtctccttaatgtttctattcactaaagtatcttgctcaaaccctggacactgcagattctaaaacagtatagattgtaggtgtctggtgaaacagtaggcactaaaacttagagaaatcacagttaaattcatcttgtgccaagtttaagaacttaaccctatcaacacggactcagtacaacgcagaatatgtcccacagggggttatgtggggcacagtatatataacagggggatatgtgtggtccaggaggtgagagaagcagggagagaagcaattgttgcattcctttgcttctgctgggcgctctgtgatgctatatataaaataaggtaagtgtgcggttgagtgggtagggagaaaggtgaggcatcttaaggcctggtggaaggtgactgatttcatcctgtctttgttatgcatctgataagcaggtttataaccagtacctgtcagtgttcaatatttaacaaactccagttaaacaggtaagaggtcagcagtagcttataggccttggttctattatccatgtgcccaactgcagccatcgtgggctggtgttaaaattttcctttcaattgtcatttttctaataattgcaatcagtgagaggagaagaaaaagttcaagggaatgacctgacctttcaccatcctacacaggagatgactgatgacatggattcatacactaatgtatatcgtatattctccaaagaccctcaaaaatcacaagaagttttgaaaaattctgagatcataaactggaaacagaaactccaaatccaaggtaacaagtctgaagaaatgggcaagcagctgtgcttctcaaattgtgtcttcaactaacagcattagcatcacctgagagctcattagaaatgtaaattcatagaaactctctgagctgggagaggtggagcaatctgtggtgtgccaaggactatagctgattgtggtgtaaactcaactttgaaaactactaagcactgaggtattaatcaggtgggagcaatgtaagtagagaactgcatgtctgacaatattgctttcttggctttctctcaggttttcaagaaagtttaggtgaggggataaaagcagctgcattttcaaattcagtgaaggtagagcattcgagagcactcctctttgttacggaagatatcctgaagctctatgccaccaataaaagcaagcttggaagctgggctgagacaggccacccagatgacgaattggagaggtacaaaaaacatgtgctgatcatttataattgctattccttgtacatttttgtaattcacataaatcagttttggaatgaagagacgatgaattcattccttgggatgaataaaggttgtcaatggtcaaaatacgccactttgcaatggtgggtcttttaacaagaagagggcctgggatctctagaatggaagggcacctagaaattacaggagtggggatgaaagttgttgtctttctttttgttttctacagcgagactcccaattttaagtatgcccagctgaatgtgtcttattctgggctggtaaatgacaactggaagctagggatgaataagaggagcctgcattacatcaagcgctgcctaggagccctgccagcagtctgtatgctgggcccagagggggtcccggtctcatgggtaaccatggacccttcttgtgaaataggaatgggctacagtgtggaaaaataccgaaggagaggcaacgcgacacggatgatggtgcgatacatgaagtatctgtgtcagaagaatattccattttacggctctgtgctggaagaaaatcaaggcgccatcagaatgaataaggcactaggtttccttgaggcctcctgtcagtggcaccaatggacctgctacccacagaatcttgttccgttgtagacaatgaagctgcttagcaatcttgggcaagccatctcttaatattaaagcagacaccacagaatagctttcttcacttacaaatgttgattgggcatttatgatatggcaggaactccttctcacatggagacctgatgttaaaggacacagccatgctcttgaggagcttacaatccaagctggaggcaggggagggtatagtctttaaatatgcttaagtgttgtagggaaggacagagttaccaataaacatgtaactagaaagccaggctcagttcttacctctgggaatcagaactctttatgaaacttgattgatagaatctactatctggaagataattgaagaactttaataaaattgtcaatagaatatacctaatctatatggatactttattggaaagaaatacccctgctatgtatagatttatgaggcaatggctatactaaagaatggaatcagtctcttagtttagtgactagcaaggtatcaaaggtgaagcctcagacaaatggctttcctaggctacctttcatcattgttatgcagaaaaggatctccagagaatcaagtgggctggtcttgcggcctctgctatggaaatgacatttgttgtgcctcctttcccctactctttctcacttcctcatcattagtgaagcatggcacaggacaaggtgttgcctgtgagtctggttataaattcagcttttgatgtttgcagcactgctatcttaaggggtcaagggcattccagggagaagagaccactaaggtgaagactggagagtgagtaagagtgagccatacagtaaaagtggaaaaatccagatgatggaaagggcacgtgccatgcactatcataataactttataattgaacacttatattacaatctgaatccctgatctcaaaaaaaaaaaaagaaaaatactcttcatgaaaaaaacgtggcctcatttggctctgctctcccaccctgtcattggagcttggattactgtgaacattgtagccacagcaaaaagaaaaaaaaatggcatttttactccttctgatagtctagattttaaaaaaacaaaagaaatcttaatagaattgtcttttggagtaaagtctaccagtattaaacaacacctcatctctccataaaaaataaacctccacaaaattgaatgtttatacttgatgcgatttgaaagtgtgcaattccagcacctaaagaatagtgtaggtcatggagtttttaagaaactccaattcatcttagaaggctatggtagatctgttacatcttagtataaatcaatccaatcagatttctaaactcctgagacctggctgatttgttacattgactgaaatgaaagcatggtctgagagagagagtaaacatgtcatttgggatttcaaagggtggaaaattcttacctaaaaaataaactcaggaacttggagtcatataaaaacagctatattttggcactcaagaggcaaaagctaatacagatgatgaaagaacacaaagaaaataagatttgcctattcaaaatggtgcctcgggcaggtcctgtatccagaagaggatgttcatccagggtctggggctaaggtcatcttagcacagcccagctgccagcttccctcctctgccgcttccctgaacacaagccagcttcccttatctagcccttcttggccctgttaaaaaagtgattcctaaaccttatcatgcacttggattgaaaaaacaacaagaaagcatgggaaagaggaaagaggattccttaaatatggcacaagtaagtccaacattatcaataaacgcactaaaaatgaatggggtaattttcttattaaaatatatgtttttcatactgagttaaaaacaaagtccaaaaagcatacatctctgtgccctcacatggtagagacagaggagagctcagactctcttccttttcttagaaggacttaataccatcataggggctccacccttatgacttaatctaaacccaattacttctcaaaggcccacctccaagtccattgggagttgggtcttcaacatatgaatttgggggtcactgtcagtacataagaaagcatatctgaaataacacacaagtgttcacggaaaggaaaaagatatactaaatgaatgtgaaactgaaaagcaaagtaataccatcaacacttggcaaaatagaacgtaagttgaacatctgctaaatacagaaattctcccacaacatagatcatgaatctgcctcaacacaacacaactacaaactatacatggcaaaagctgacggacatacaaaagaaaaatgcaaatccacagtctcagtgggagaactcaaaaaacttccctcagaaagcaacagatgatgcagacaaaaaataaagacaatttgccaaaatgccatcacaacttgatatttctggtgatgttggggttatctgcttactgtgtatttgagaacttctgttcacctgcttgtcaaactgaccagcagggggtgctgcggagggaaacactccatctggagaatgctggcaacttgtctcttaagtctagaggctccttgtccccctcatgatcatcacctatgaggtgcaagcactgctgatacaggagctaaaaagaaattattaagcagttagtgtaggtaagagagtcctcggtaaggtttttcttttaataaaaagcagcccccatataatttcttttctagcaaaaatcagcctaaaaaatcaagccacaagcatacataagcaaactaaaaacttgcatagctaaatgctggcacctatgcaaatagaaaagggatacttggaagccaggcatcctcaacatagaggtttcctcttcctatttttttttgtttgtttgtttgttttttcagatggaatcccgctctgtcactcaggctggagtgcagtggtgcattctcagctcactacaccctccacctcctgggttcaagcaattatctccctcagcctcctgagtagctgagattacaggtgcccaccaccacgcatggctaatttttttttcgtgtttttttttttttagtagaggcggtgtttcagcatcttggccaggctggtcttgaactcctgacctctcgtgatccatcgtccttggcctccgaatgtgctaggattacaggcatcagctaccacgcgtggcctcctattcccttttctttgtattcacgtgtgcaggcgacatggcacaggccaggtagaggccccgtttgcatactaaagattcatgtgggatggccaggctcttcatgcatcacataaatggcacacctgctccaaccaaccctctgagccctatgtaaatcagacactgcctcctcaagctcctctataaaaccaaccacaactcgccccaaacccggaaacctgctcaggcacctttccaatgcatgaggaaactctctcttcattcttttgcctattaaacttttgctcttgaacccactcctttggtgtccacatctcaatttccatactgtgagacagcaaacctctggcatttccccagacaaacgatgccgcttcactgccatctcaagcccaagtgccaaaaatgaccactttagtctgaagaatgccacagctgccaccatgctgcttaggataagcaaggacatgaagatggagtggggacgggtttattagagaggccgcaataaaagcatatcccaggcaactttccacttcttaacttctgtcattttcaaacttaaaggtgttttttattgttgttggtttgcttttctttttaacagtttctatttctggccaaaagactgctttttgttttcctgctatgacatatttattctttgttcaaaagtcttttccatgatttcatataggaactaagaagacagccatgtgtttgctcaacacattgatcccctctccacctagaactctctttactgtttctcccaggaagattccacccctcctgttctgccagtttcctcatatttgcctcatacaattgcccttgtaggcagatgaacccgggctagttctactttactatggacaccaaagcttctgaaataacatctgagtcttgggatttgcatatgaatcttcccttgacacagcaaacagtctttccttttaccttcactaaagtcatctacttgggagaatggagagcactaaaattctacagatttcaaaaacaaacctgctgtgcctttccagagtccttggaatgcaaaagagaaaataggttagaagggatattttctccttcctttcttaccttgaaggagctcctatttttaaagggaatcattggggacaatccaaaagaaactcttgcaaatcaagctttgccatgccatcacgagaagggtaacatgtgtgcccagtggtgaaatttttaaattttggtaatgatctccagggtcacccctatggataacaaaaatattttaaaaacctataatggtgccagcctttcagaaccctgtctctttgcaaggacctaccaaggtctagagatcatagcacctcactagcagcctacaggcattctccaaaggttcccacctgccccacccaacatacacacacacatacacacacacacaccctcctgctatcctttggccctagatttcacctaactttattctaaatcttaatcaccctgtgcccccaaactcatgtgttatagggccttggtaatccctttctaagcatattccctgacttcttaaattctatttatgagacatatatctaaagtaaaactatatttcaggccagatcagcacgcttcttattacaattataaacactgaacttcttagttgctgggaaaatatattgaaaaggcattattatgcttgtatagccatagattatctagggaaaagtattgagtgtctcgagaatgagtgaaaattgtttccccaatatacacctttttttcttttgaaaagtatatcctgcgtatattcaaaagataatgtttttcaaaaggggaaattgcctccactgtggactcttattaattcacttatccatcaagttctcttattaactcacttatacatcatattcccttattaactttttattcaatcactggtatttgtttctagtgctcataattgaacacaaatttgtttactattatataaaataaagtaacagctattcaccgtttcctcctttacctcaataagttgacatcttccaatagatttatttccctgttttgctccctcctcagatccagatgagtgtgctaagtgatacaaaatgcttttattcctctaccgttcaaccccctgagcccgatgttttagttccacgtgttttagttccaggtgtcacagaatttcccttgcagtgtgtctcatcaatttaaagaatccttctttaaaacttttcttacacattcccagagagcctatcattgtccatttagagttaactctctacataaaatttgtcaatttttttttactcaccactgtttcctctccttattttctgctcctatctgaaatctcttttcctatttgattaaattgcttcttcagtatttcctgcatgtacatatgctaccgatataatatctgaagactctcaaatccacaaatatctttctttgaccctcacaagaatataatttctgcagccttatacattgacaaatgtttgtcttttaccctcaagtgactgattccctatgacatcacattttaggatgaccaaatataattttccactttatacataaggaaactgaggtacaaagaaacaaggtagccttgaactttcattcaaggtcacaaagctagcaaaaagtggatgactagcgatgaggtcttcaggttgagattaacaaacaacatcacaggatataataggatttaacccaacttcaacttcataaaatgaatggacattccctgatcttccctccactcccacccccacctcaggggatttcaggatgcactgggcaaaactgtctccctccatccccaaccgtttctcaggcagtgacaggtgtcaagaactcctcgccgcccttcttgaagcttacattctggagcagggaggcagaagctaaaccaaaaattaaaacaactgtgaacatattccctataaactcagatgtagtatatgaaaacaacacatgatttgacgacagaagatgatggagggagaaagaacaacaaataaataggaaaagaggcctcagataggagcaggtaaaaaggagagaaaacaggaaggggtcaggactggtttccctcaaagcctgtcatttgacagagagctgcagaaagaaggaatagagccaagcacataacaggagggtagagttgcagtctgaagcacccaaaatggtccactaggatggacaaaggacatacttgaaccaccacttagattcatcttcatctaaaaaataagaaattaagtgtgtgtaatatttaattatttagtacattaattacagtagaatatatagagttgatgctcaatttgttaaaaaatagatatctaaaattaaacctcagagattactcttgcctatgacaacgagcttctgaaaggcaaggataggtctcacccatctctgtatcttcagaatccatcatattatgtggaacataataggtatcaatagtatgttggggaaaaaaatcgaaaccatgctgagcaccggaattctgtgtaaatctttttaaaaagtctcttctactttacatcagagtcccttttgtatttttagtatcatccagccccacgccttgcagataagcccctaagaaatgaatgggtgaatgaatgtgtggacagcgggatggatcattgagtgaggagcagtgattcgcaggacctgcatgcattgaaatcctgccaaagcagcctctgcaaaataaaagaccttgggctttggtttctgacacaagttaaaattatccaaggactctccttgggccacttagttgaggtttcctaatctgtgaaacagaaaatgaattcaatagaaagatgattgagacaaatttctggaaggtgccaaagcaggatgcctggcattgagggacgcttcacacctgttatctctctccctattctctcttcacccctactcccgcccggcaactccccgctgtcagctccaggaatacttacctgctgagaaaaggaaaagcacaacactgactttaccccgcgacgcttttaaaaactccaaaacacccagcgcgatggggagtaggtttccctaaagacaggtggagcagccatagttaacttagaggaaggtgaattgacaaagagggttgagccactacgagcgggagttaccttggactaacagttgtatcttcagcgagcacaagtcctggaatctcccacgcccatccctttttttagcgccacaaatgc

SEQ ID NO: 576 - DNA, 45739 bp, Homo sapiens
ttaaaataagatgaattattttatttctgaattctgaaggtctgctgggcttggccaggtgattctcattcttgtggtctcttatgaggtcagtggtggctagggctgaaaccatctcaaagccttcctcactcacatctcatgggtgatcccagctgttgctggaacctcatctgggactatcggccaaaacactcagaacttctccatgtgtctgggcttcctagaagacactgttcaagtagagggcaagacaatcaagaatctcaagctctatttcaaaacatttcttcccactccactactgctctatatatttttcacaatactttataccttctaacgtaatagttattatagaggtacacgtatgtcttactataacataaactccatgagggaagatatttttagttttgctcaatgaaatatccccagtgccaaggaagcactgccctacacattcatccaaatagtaaaataataaatatctatttttaaacactttgttaattctgcacacatttactttttctaaagggagaaatgtggaacactgaaaagctccttgaatcttagaatttgtttttaattaatagacttaatacatggcataacatgttgtactcaacttactcttcatgcaacgtgtaagcataaatgccaaagatcttactttcaagcatcagcattaatatagcaagttaggaaggtagacggtttggtaattacaaaagctcttgaagtaggcaaaaaccattgttttacatggtagccaagatcacactaatgataagtatttctggcttaaccagtcctcacagcaatatgctaaattaatgaaaacaaacatgggcattgtttgggtgttactgacatcaactacaaaacagaaatgaacagaaattgaaaactatattgtcaaatacaattaaaatagccaaatacatttctaggtaaaatctttataacttcaaatactgccagttttctttcaaaaacttacagtacttgaaagaacgaaaatcagcttaatccagcacaggggaaagaaacacatgagataactgaattttacaaccaaggtcagagaggatatcacactatcaccgtgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaatttttataaaattcctctgataagtatgcttaaaattaacatatttaccaatgtcaggatgaacactagtattttccaattaacttcccagcttccagacttttgatctattactttgctgtgtacttactttgatttgataacttggtgatttatgtttctccctatgcattcctgtttgaaagcgcctatgtcctccaaccatgtactgatagagctgctcaggcacattgagatcagacatacctatcaaattgctgccgtgctggaaaagacaataacagacgagtgaaaagaaattttatggaggaagatccataacacatacccataacaaatataaaaatgaactaacttcaaagcaggttatttcgggttttgttttttttatttccaacttaaagcaaacattaatcatgagttaataaatattaataattctcataaaagttttaatacatgaatgttcaactttaagtactgtcttaaaatacataagagctttagagttagttacatttaacaataaagaaaaatattagttatataattgaaacctgaactgtaaatatctgaatactttcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcaaagagggattaagcccaaggttatacagctattatagtaagttgcagggctatatataaaacacggccatctggttcaacaatccatgaagctgattaagcaatagacaataatgtagttaaatgacttgactcactagttaggaccagaattcaagttgcaattccctgtgtgattcctttcttttttttttgagacggagtctcgccttcttgcccaggctggagtgcagtggcacgatctcgactctctgcaagctccgcctcctgggttcacaccattctcctgcctcagcctcccgagtagctggaactacaagcgcccaccaccatgcctggctaattttttttgtatttttagtagagacggggtttcaccgtgttagacaggatggtctggatctcctgacctcgtgatccgcccatctcggcctcccaaagtgctgggattacaggcatgagccaccacacccagctgattattttccattataccaccagcctctttagctcacgtgccaatgtgaattcaaggccctaatagatggtcaaccacgaggtggattttcagaacacacatgagaaaaaattccttccactacaacttttttttttaagatggagtctcactcttgttgcccaggctggagtgcaatggtgtgatcttgattcatcacaacctctgcctcctgggttcaagcgattgtcctgcctcagcctcccgagtagctgggattacaggcatgcgccaccacacctggctaattctgtatttttagtagagatggggtttctccatgttggtcaggttggtctcgaacccctgatctcaggtgatccgatcaccttgccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcctgatcatatacattttcactattctctgttttcagtcatagtgggctgtcacttattcattctatgtcttgaacactttaaaaaaaaaactttattccctttagtttgttcatgaacactgtaagctggaggaaaagaaatcttaaagtctcactcttgaccacagtttctctcaatttgcaaatctggtaccttgaaaaatatccaaaaagacaagagagctgggcagaagattaagtcgtagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactttctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatgatgtccacaactgtaggtttacctaccaaaaaaaaagggcccaaaatagttctttttaaattgccaatttaagtctttataagcaatgatattcaaatactgtgaaactttgagtcttatcaaaaaaattaccaagtagtagaaaaaaattttaaaggaaaaaaggtaagagtattcaaaaaaaagttttattattttttttaaaacatctcggccaggtgtgctggctcatgcctgtaatcccagcactttgggaggctgaggcaggtggatcacttgaggtcaggagttggagaccagatggccaacatggtgaaaccctgtctctactaaaaatacaaaaattagccagggtggcaggtgcctgtaatcccagctactcgggaggctgaggcaggagaatcgcttgaacctgggaggcggaggttgcagtgagccaaaatcaggtcactgcactccagcctgggcgacagagtgagacaccatctcagcaacaacaacaacaaaatatcttacattttgttttcattactttcaaatccacacatcacatgtggtgaaacatgttcgaatgatgataatgaataaggaggtcacttacttacgttgttaagctgttaaatactatgtttagacatttatttcgagtgtatataataatgagccctactatggtagaatttctgtgtactgatcctagaagtctgactggatacaaaattcacacttttaaaagcaccctataactctaacactaccttgttgaaaacgacaaaatgtactatgtattaaaacccttccctctgaaaaaatgttcacattcctgaaattttatccctataggaaaaaaatgcaatttaaaaaaaaagaaaaaaggctgggcgtggtggcccttgcctgtaatcccagcactttgggaggccaaggcaggtggatcacttgaggtcaacgagttcgagaccagcctgtctgacatggagaaatcccatctctactaaaactacaaaaattagccaggcatgctgacagacacctgtaatcccagctacttggtaggctgaggcaggagaattgcttgaacctgggaggcagaggctgcagtgaaccgagatcgcgccactccgctccagcctgggtgacagagcgagactctgtctctaaataaataaataaataataaaaattaaagaaaaaatcacacacaaaggtaatcagtgtaatgtttatacataacaacaaaggattattagaaacaatctaaaaggttctaaaagttaaaaaaaggcattttacagaccatcaactcaatgaatattatacaaaatgtgttttaaaacccatttataacaatgatctataaaaacaatttttaggctgggcacggtggctcacgcctgcaatcccagcactttgggaggctgagacaggcggatcacaaggtcaggagatccagactatcctggctaacaccatgaaaccctgtctctactaaaaatacacaataattagccaggcgtagtggcgggcgcctgtagtcccagctactcggaaggctgaggcaggagaatggcgtgaacccgggaggcggagcttgcaatgagccaagattgcaccactatactccaggctgggcaacagagcaagactctctcaaaaaaaaaaaaaattttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatgcctgtatgtatgtagcatcactgtggcaatagctatctgatacaatgatactaaagaataatacatctttaacaatatattcacaaatccatatagaaaagatcttgaataggacatataagtatgtaactaaattgttgagcatattaataatgccaatagcatttccatttggcagaaaaagatgacaacacattaagatttccaaaaagtttggacccaataaaaaacagagacaatgttcactaaagtgagtgtgtggaccttaccatttccaggttcatcaccaacatacccaccagcatgtaaaggaggaaagcaggagtccattacttgacttctattggaagtgctgttatccaacacagtaaacactgtgatgtgtttagtttagtgtctctcagggaccaaaacaatctactctgagttttaagtgcaggccactgctagacactgctggtaaagccggataaacagcatactcatagctgattaaaaccacaggtacctcattaaatgtgaccactggaattcagtaatgagctagcaaataaacatggaggttaataacctgcagttacattagccttggataacattacttagagttttgttgttttttttaattagtactagatcattctttgctcacaaaagctaccattgtctttccttaatttttataattttactatttaattgggttaatgtggagtggagagtacatgcctatgaagattcagcactattaatcccatacctatctcagccaacaggacttctgcagtatgtctgtgagctgtcccttgatatacaaggccaatgccaaccactgcagccacttggacattgtgaggaacatccagctctgtggacgttgggggtaagagagcaggaatgcgaatgctaagaagccgagtaatagacatatccatggtgcctagttttgcagcagaaacaccaagtagcagtccaatgcttgtcatttcatggccctaagatagaaacaaaacaaatacatagtttaaaataaaatactgcctgccactttcaagaagtacttttatgttgacaggcaaggtgagaggcactgagaatacagcagtaaactaaacaaacatggtccttgctctcatggacctaatgacttaataggaaaaaaagtgttaaattaaaaaacataaacaaatatattattaaaaagtagtacaataagaaagtacaaagtattatgaaagagtattttaaaatagcttaatttagattgggagggactagaggattattagggatgaaatctctaaagattatacaaagaaatttatattaggacctgaaggatgaaaacaaattagccaggaacagtggcaggaaagaggacactcaagtttagaaggtgaggaagactgtttcaggtgataaaacagcatgtaaataaatggctctgaggcgattcagaaatgaaccctcacattaacatcaactgaccacaagggtgccaagacaattcaacaggtaaagggcagtcttcaaaaaacagtgctgggacaagtggaaggacacattcaaaagaatgaggctggactcaacacaatataacaagtgttggcaaaaatatggagagattggaactctcatgtattgctgatggggttgtataatggtgcagtcattatggaaaacagtttacagttcctcaaaaagtttaacagagttaccatataacccagcaattccactcctaagtatgtaccactacttaccattacttcattactcttgagtaatgaaaacatacatccgcacaaaaacatgtatacaaatgttcatagcagtattattcgtaatagctaaaaagtacaaataacccaaatgttcatcaacttatgaataaaatgtacattcataaaataaaacatttattcaacaataaaaaggaatgtattgctgatagatggtacaacatggatgaaccctaaaattatcaggctaagtgaaagaagcccatcctaaaataccatattttgtatgactccgttcatatgaaaggtccagaaaaggcaaacccatagacacggaaagtagattagtggttggcaggaagtgaagtgaaggtgggggggtgaggtagaggaatggggagtcaccactagtgggtacaaggttcctttatggggtgaaaagatgttctaaaattaacagtggtgatggatgcacaactctgtgaatgtactaaaaaccactgtaccacacactttaaacagtgaattgtatggtatgtgaattttatatatttatataaataaagattccttaaaaaaaaaataacgctgtgaagtgaaagagtttagtttgccagagagctaaaatagccaatctgtatggttagagtgtgggggagcaagaagagtggggctgggtgcagaggctcacgcctataatcccagcactttgggaggctgaagcgggcagatcacctgagatcaggagttcaagaccagcctggccaacatggtgaaaccctgtttccatcaaaaatacaaaaattacgcaggtgtggtagtgtgcacctgtaatcccagctactcagaaggctgaggcaggagaattgcttgaacctgggaggtagaggttgcagtgagacgagatcacaccactgcactccagcctaggtgacagggtgagactccacatcaaaaaaaaaaaaaaaaaaaaaaaaaaaacgaagaacagtggtaccacctagggctggagaagtgaacaggatcacaccagctcctagaatgtatattaagagcaatggtcgatccccctttgccctctggtgttgggaattttggccttgttctaaaccagtttcccttcacagaagttcagccatcgtgtgggatcagaataaggtcctggggcaactaaaggtatctggccaagggtacatccgaaggaccctacaccggcccccagtccccaacagcctgttcaggtgtcggacaaagacttccaatctttcctatcatgtttttcctactgctcttctgagaaatgttacttagttatgtgtctctttgagaaattgcttcttttcagggcaggatgctgggttatgcttgatgaagctaaataaactgccagccagatgagaattatagacaaataatatgcagggacccccccggattcatcttagtcttgagctcatatagaattcagagaaatcaaaggcagttgacaaggagggtcaaggctgagtgcaagtgaacgcaactactcctgctggcttgatccccccctggtcatgaatggtggctgcgcgcacatccacgaccaaggtaagcctgagagacgccttggactctagcacagcagagggaaagactaaggatgcctttttctcccctctctctttctaaatgggtagcctgcactcctctcaagtgcgagacattgggactcctttgatcctcagactctgaagaaaaaatacctggtatttatcagtagcaaggcttggcccagctagaagttggaagatggggagacctagtcagctggggaaaataacaactataatactatcctatagctagatctcttcaaccacagagaaggaaaatggtccaaaattccatatgtataggccttttttgccctgcagaataaccgcaagctctgtcagcaatgtataatagaccttgcacttatagcagtgatatccagccagacttaatccagacagaagggaaaaaacagtctgcctccttagaagaggagacagaggcccctgcaccagcccaggtcccagctcctcttggatcatctcgtcccccttatccaggcccccttttgaacctcatcctgttagaagagttcgacctggatgcgctccagcatcacttcttcctttacaggaaatgcatagtgaatatggtcctatcaaagtacaagtccccttttctttacaagatttgaggcagataaaaagaaatctaggacaattgtgtcgacctggataggtatattgaagcctttcagaaccttaatcaaatgtctgagctttcatggaagggtatcatgttacttctcaactagactcttagagcttcagagaagcaggcggctttacaggtcactgagacatttggagatgaaatgtttatcttattatggcacctaccaaaagggggaagaaattagggagccctttctgacagccaagcaggcagcatccaccaataatcctcaatgggactcagacactgctctaggaaagtggccgagaaaacatttttagggatgcacagtggaagatctgaaaactagaggcaaatctctcaattacattaagttatcaaccataaaccaagggtctgaagagaacccttctgttttcctggaaaaaactgagagaggctttaattaaacacacatctctctcctgactctataaaaggatagttaattttgaaagacaagtttataacccaagcagccccaaatattggaagaatgctgcaaaaagttagctattgcaccagacagtactctaaagaaaatcctgaaagtcaccaccttggtcttttataatcgggaccatgaggaagcccaagaaaaagggagaaaaggaacgagaaaaaggcagaggcactaatagctgccatacaggcatataaacctctcgatcccagggagcttctcattctatgaccgactgttatcagtgtgggagcactaaaagagagtctgcccccgaaatcagaagcagcccccacggccctgtccaatctgtaagggagactactggaagacaaactgcctccagaaacatacgtcccaaggttcagagccggcttctcaaatggtccagcaggactgatgggtcccagggctctcctccccagctctgacagcccaggctgcattaccatccaggagtcccgggtgagtctggaggtcaaaggactcagaggacagacttcctactcaacaccagagcagccattcctgttctcctctccattctgggcctcccctcctcccttagcacaactgtgaggggcgtctcaggaaagcctctgactcgatatttttctcaatcccttagctgtacctagggagacctttcgtttacctatgcctttttaatcatacctgaaagcccgactcctctgaggtagggatattttagctcacatgggaaccaccatccttatggctccaggacagactctttgcctccctctggtggagactgatattaatccaggtgtttgggcaattcaggaaaatactggctgagctacaacagtctcaccagtccaaatccatctcagggatctcatctccttccctaattaaagacaatatcccctaaaaccagaagctaggaaacaactagaagccatcattaataacctaaggatgcagggccttgttaaaccctgtgacagtccttgtaatatcctaatattggaagtacagaaagaaacccaacagggaatggagactggtccaggatctccacctccttaatgagtaactggtgtaattaaccaatttacccagtggttcccaatccctatactttgttaacttagatacctgaaggaactaaatggtttgcattcttggaattaaaagatgctttttttctgcataccattataccccaactcccaaaacttgtttgcattcagggatccctccaaccagactacccagctaacctggatggtgttaccacagggattccaagacagcccccacctgtttgggcaggcaatctcaaaaagatctctctgagttctttcaaactcaagttagtcttaatatgtagattacactctactctgtgccccaactgaggaaatttctcagaaaagcaataaggctcttcttaattttctaactgacagaggacataaagtttcaaagtccaaggctcaactccgtcagacttcagtgaagtacctatgcctggtcttgtcagaagggaccaggacactgggcgaggagagaattggatccattttctccttccttctccccaagaccctcagctaactaaagggattatcaggcattactggattctgcagcctatggatcagaaatctaattaaaagcattgcaatgcctaattataacatatctaataatctagggggacatgcccatgacaaccctattttgcaaaatcctggaatagaacagtccattttcagaggttttcttcctgtcctttctaggtgtccctaatatatgggcatggattttcccccttttagttcctctttgtgttctcattgtaatactcatatttggtccatgtgtacttaacctccttgtaaaatttgttttttctcgcctagaggccatcaaactccaagtggtcatgcaaatggaacctcggttgatggctctcttttaccaggggacacttagataggcctctaagagagacctgactgctgtttcccaaaacaacaccctctgtcagcatgaagcagaacagtcatcacccctatccgaacagcagttagatatacctcttcagagcggggattgatggcggtaggaggcaggtaaattctcagatgaaactcaaccttcaagccaaggacagtcgaaagcctgaaaaccaagctacaagttctggataaatccatggactagagagctctcattcctgtttggcatgctctctcctgattggtccttatccttcacctactttacatatacctgcccttccccagttggtcctctacactatcgtgcctatttctaaatggtgctttttcaagcatacccacagaccaatcagcatgcacttcccccatttcaagcccataaaaacctctagactcagcctcgtggctggcaacccaccttcgggtcccctctcgctgttgagagctttcttgtcactcattaaattctactctgccttactcagggaaaaaaaaaaaaaaaaaaagcaatgggagatcattaattaaatggctttgaccagggaagtgacatactctgatttatgctttagaaagattattccatgtactatgagacaaatggacttagaagtacaagaatgaagaaagaagagcaaatagagcaattaggagctactacaatagccagccaaggcacaaagccaggcactgggagcacaggtctcaccttggtcaagtagtcatggatattgagagtcgccagcttggtaaggtgcccattcaaacccagagccatgagaaagccagcatactcattggccaactcagcatgcttgggcttattgtaaacaatccaagctgagtcgatctgggaggcaggagctatcttcaggccagcagccacaccattatgaaagctggcccagcttgtcatgttgggaggcacatcgatgtttccactattaaggtctactgttgtgttccgaggaggggcacgccctatccagccaaacgaagaacattgagagaataaaaatccacaaaaccaagattgttaaatttagatctttgagactaagattacttacgttttctacattcaaaaccattaaccccataatgcctggaacgttaggtctctatgaccacttaaaacttttgtacatgtgagtcaaacttaatggaactggaaaaaccttcactgtctaaacagttcattgtcctttttgttaaaatgtatgaggctatataatgagataactgataccaatttaacattatacagagatgactgggataatcactcattttttctttcaaacagagagcttaaaaaccaaagtgaagactaacatcactgttaaactatacaagttataaatcccaacatctgatgacactgatgttaatttcaaatgttctatcctatattttcccctagacattaaggaaaaatgacatcttaagaaaagacaaaagccaggcctggtggtgcgtgcctgtcccagctacttgggaggctaaggcatgagaatcacttgaacctgggaggcagaggttgcagtgagccaagatcatgccattgcactcccacctgggcagcagacagagactgcatctcaaaaaagaaaaaaaaaaaggaaacaagaaccttaataaatctgctacaggtcttacctatatatgcccccttctctctctttttttctctctctctctatatatacatacagatatagatatctaattatatgctatcgtttaaaatgcttagagatagttttgtaaaaagcatccttttatagacttgagtcacccagggaacttcaaaagggcattcaccagattatacttttacggtccatttatttaagaacaatgtaaattatatgttcacaatgctatatgttccctacgaattttttcttgattcttttctttttgatctacattatacacagcaaacattgaatctttttaaatatattttgaatattgtcttaagtcatggataaaataattaacataaatattttaattactgcataaagttatccatttcactgcagctttaaaaataccatttttaaagagttctaagatgttatgtaaaataaattttaagtagatgcaaagtgtcttatttgtagcatgtacacatacacacacaaagcacaaagtaagacttatttgtctttactatatgctttttgtacctaaaagctaactcaactgctagtgttagcaccacaatgagtaataagttcataagttacacttgtactttctcaaaaaaggcagacatatcaatatgaaaaaactgagtgacctttctgaaacattcattcatcatatgcaagagacataatatttatacacgagagaaaataaaatgcaaagggtaaggtaaattttcttcaatgagaataacaacatacaaaagtacaacaggccacatcagtgtgggttaagcaactatttaagaaaatattctttcctaaattaagaggataacctttctttttggcctaccagaatgactaaaagaataaaatgttggattaatgtcataaacacattttaaatcatgcaaattcaattaaatgtattcagaaaaaaagatgcatgtatatattttttaaacccacccaagtatcacttgagtgctaaatcacccagattgaatacattttaacatttgccaattttgcattagattttctttttaatctgcacttagtatatgaaatctttcatataaacagttggaaagactactaaaatgaacatctatataccatgccttccatcaagaatcaataattgttaaaattttgccataggtgctttacctctgagacaatttaaatattaaaagccactctgctcactatgtccctcagtgagattagggctcagaataagcatggtatggagatgggaatgtgttctttcacttagtcaatctcatttcctgcatgctgctcaaagcacaagcttttcacaaatctgagtggaactctggattttttaaagtatgcaatttaaaatactgtataattatgtttgcatatattatgtactatttatcatatattaaattatacattatatgctaccacatatactatacactactacaacatacattatacatacattttgtataggtttcacaaaaccatatatactataatagagtttcagtgataatttcaactatgtaattgtcacctttagaacacattcaaatcagcattagggggacatgcactataaaattcattgtaatcaagattataactacagttatatatggcagaaataaaaacttgtgccagccagaaaggcaatttgacatgttccttaaaaccattcatcttgctgtcctaagagttctacttctaagcatttagcctaaatacacaggacgaatacgccccaacaatgtttataataccaaaaaactgtaatttccaacaataccaggctgcttctataaactatggtatatccgctgaatgaaatactctgaagcaaataaaaatgaatgtattgattaaaaacacgtgtatacaatacatacacataattataaacacatacatttatttgctagatataaaaggatgttcactgtaaatttttaaaaaaatctaaaatagatataaattttctgataattaaacaaatataaaattataaatatgtggaaataaacttagtaaacatatatactaaaatgttaaaaggagtgatgcagaagagtgggagtactgcaagtgaccattgtttctctttttgcttagtacatttcttgatttatacaatgatcatctgtttaaactatgacgtaagacattttaaaactaaatatttttacatattaaacttaagattatttaaaattcaagtctcatcgttatcaataatatctttctgaacttctccaagtgactttttagatcttgaaatcacctcattaaaaagcaaaaatgagtaatgaactatattctgcttctctcaaagtttagtttcacatggcatttgagctttgataaccactacagcagctattaggaaaattttaaatcactggggatagagggagcatttcttttgttttaactaatttaaagaactacacttaatgcatgtacttaatcattttcctttctcattgagcccagaatttaacataccagtcagattcaatttaggaataggcaatggctctgttggaacaggatggtacgaaaacaaggtaaacattcctcgtcctacaggaagagccatagttcgctgacacaattggagcaatctgtaattaaagtaaaaaccaacatgtgaaaatgtttaaagcaaagagcaattgaaatatcatctgtaagtatttcaaaagaaggtgtactgtataagatgaagttgtctcaaagtaaattcatacacagatgtgagtgaactacccaaacatgattattttcattttaatattcttgttcctattacactcttagggagagacatatttcctctgttttgtttcatatttacattgaatgaaaaccacctggcctataaaccaagccgactctctctaggcattcaaaaaaaaaaaagaaatttaaaattccactccgatggatgctaaccttctcaaaggaaaatacagtacttttggggtttttatcactgtgttaatttcagtctagctgtcctcagtacatgtgggatcctcctcccatcccttttgccaatacagcctcagaagtaccatttctgtggcctgtacacaagaaaagaaacaaggtccttgtgttagaggtgaatggatttcatggtgtctccaagggaaatacagattggtttcacttacatgatggctagatttataggactaataccattatgtatcaggtatgttcaaggttaaaatggtttctgttggctctactgtgaaattaatacaccactcttcaacttcttcctatgttaaaatagcttaacattccatatagccacttaaaaaaaactaacagaaattttggaagtagggcatttataactaagaaacgcctatacaagctatatctgaagacacagaaatatcccttcagaggctgacaactgacaaacattttctctgcagacaaagctattcataagcatacaccctccttaactggacacacataactgcttttctagctaactggaaagaaaaattttgctgtcttaaagattctctgggaacacaaccgcaacattaatttgggatcaggaaaattcaaagccaagagtctgttgcaacccatagaatttttttagaggaaatcttacacataattcacttcaactttgcacaagtaacaaaattataatgagaacaatattatatcccctgaatataagatgccactcataagatgtatcattatttcatgagaaactaagaaagaaaaagcactgccaattaaactatgacgcctgttcactgaaatacacaactgatttcagagatattaaaaagtgaaaaaacttgcatcttagaatcaatgaactctactactaataatggctgactgcactgagctttactatgtattgagcagtattctaagtgctatgtaaaaataattcacttgatacacagcaccatcccatgaagtatgcctacttttacaaatgaagaaactgaggcaacaagaggtaaagtaatttaaccaaagtcacccagcacagcatggccatgcctggctctagaggccatgctcataaatcctatgctctaaactcaacttctgtcactccatctttttattcacaggtgactaataactgggtacatgtggagaggaaacagttaatagggaaatcacaactaattcagatcttcagcagcctgtggctaagtgtgggtgatggttcccctcaaaacagtaccataaaaaaagtaaagagaactagaaaacagtggcagatgaatgatagatgatagagacaagcagataaaagaacaggagagaattttaaaacagaagtgtcccaagagaatagctctggaatgtcataggcatgtgagtcttataatgtatcaagggatgtatcctgtgcaggggagtggcagaagaaaggcttatctatttttatttggagtatcatctatcatatccaaaaaaaaaaaaatactcatataagtttaaactacactaaaaaccccactaacctcaaaatctattcctgatcaagacacagaaaaacaagtccagtgttttctttgtttgtaaattcttaaggtaactatcaggcaaaatagttttacattcaccttttctaaagagtaaagtgttatatgtatttcaagaggaggacgatatgaaatacaacaattacgtcctcaaaagccaaagacattttgctaacacacgtggtttgttgaagttggatgaaaacttaaaacacagggcatattttcacttgaaagtatcttttaaatctctttagggttttaagtgctaaaaacttgaaggaaaaacaaatatacacaagacacaaatgtaacaatgaaacatgacaagagatagtgcacgtgttttctttcacctgttttccttttcctcgatgaactcgtggtcactgagctctgggtactgcactacattgacacggacaggatgcgcactctgaagaagccttcgcacatcctgcacccttaaatcttcactccatattaatgacatgacctcgtgattcatgtcattcatgccgtcatcttcctcctcagtttctgttcctgaaggaacatctgatgagagcacctgagtaacagactttattgtaataataatttcaaaagcagttaacatgcacttgctgaacatgaggatatataggctgatgtgtcatgactatactagcacagagaaaatatgttttccaaagcaggcatgggttggagccgcaatgtatactgggactctaatctacaaatctttctaaaaagtactatattgctggccgggtgtggtggctcacactctgtaatcccagcactttgggaggccgaggtgggcggatcacccgaggccaggggttccagaccagcctggccaacatggtgaaacccggtctctactaaaaatacaaaaattagctagccagacacagtggcgcacgcctgtagtcccagctactggggaggctgaggctggagaatcacttgaacgcgggaggcaaaggttgcagtgagccgagatcgtgccactgtactccagcctgggtgacagagtgagattctgtctcaaacaaacaaacaaacaaaacaaacaaacaaacaaaagtactacattgcctacttggaaatatttggaaatgacggggagagtttaaatttaggacaacagtcaaggggctggatacaaacagagaaatattctgaataaactataaaaaaaaatctaactcatcctgatcattttaaaaaagaaattattgcaagtagaatatgaatactagtcactgctaataatgctaatttaaatattgtctgttcattaatagaaggagaaggaaaaaagcctgaaaggatatacaccaagggttgggggaagtcacacaatgaaatactttcttactttactacttttaatagacaggatcatggttggatttcattattaagtttttttttttttttgagacagggtcttactctgtcactcaggctggagtacagtggtgtgatcatggctccctgcaacctccacctcttggactcaagcgatctttcaaccttagcctcccgagtagctgggactacatatgtgcactggccacccagctaattttttttattttttgtagagacagagtcttgccctgttggccaggctggtcttgaactcatgacctcaaggagatccacccacctcagcctcccaaatagctaggactacaggcacataccaccacacctggctaaattttttaaaaaattgtttaagtagagatgaggtctcactatgttgcctaggctggtctcaaactcctgggctcaagcagtcctccgccttggccaccccaaagtgctgagattacaggcatgcgccaccacacccagccagttttcactattttttaaaaaatgtgtttccaataaaaatttcttagaaggaaaagtactgaactgcagcgaaacaagtaagagggtaaattccttgattgtcatcatgttctaagcccagcatgtgctttaatatggggcttcccagtccaaataattaaatctaactgcaacacagatgtgaattgcatggaatcatatcatattctctcaaaaacagtattatactcttttaacaaaagaataactccaagttgaaatgttaaagttttgcaacatttaatgtgaaaccaacaaggtcagcctgaaaaaaaagtagatacgaccaaataatcacttttagttcctaaaaattcatttttagttcctacaaaatatctaatttaaaaaaaaaactgtattctaatgggtgagttagctataaaacatagtctcaaacagtgacaaaataaatttagatgggattaattataaaatgtagcctcaaataactgaacaaactgtatttagacataattacttaaaatcacgttcaaatacagattaatgttttaatgctaatggtgctgaactgctctctctcacaggaaaatcattttataagcaaaaagatttgttttctgtttaaaacaggatgtaaatactaattcaacgaagagctgtgatagaggcgcagattaaaggagagagatgctgggatgaccctgctggagatcagatgcccatggaaactgactccggcatgggtacacattaggcaactctgaggttaggaataagttttgatataggctctgaagaagtagtaataagacctaaggtgactcgtagttacaatgtactgattattatgtattgattcaaaagctactaagaggcaaggccaaattcccactgtcttctcagggacatgaacataaaagagtcaccaggagtggaattattattcctgaatcctccttgatgagattctactgttcattttttaaagttacctagaattctagaataagttttaaaagtttcattttcaagttttgaggatgatttaaaaagataattggagagtaatgaaataatttaactttctacttgcaggattcctagaactcatttaaaaaaaaaaacagacttgatgactgatgaaagacagtatttcgggagggatagcttaagacatgtttttaaacaactctactgaaaaaaacacattttttccctggggctgcagttttatgtgattaaacaaatatgtttacacctatttaaaaggttaaattcaaaaaattcaacacatcaaaaaatatgcagtagaaaatacttatatataattactcatccaaattcaggatatatgtgctctcccttttcctatgtaataattacaaagtggttaattactaatatggtacaagtagggaaatagccatggtagtttccatgactaccctcaggacttgtcctgattcaaggcaaagaaagatccaggcacaagacagaacattcacaaaatctcctgctcctaatgctcatcttaacaattaataagacgcgtacaattacaaaccccgtctggcatataatataaaagacaagctaatatatatacttagaaaaagccttaaaggaaaatgaagaacatttctactttatgattttatttaaggctaaaattggaactctgaactttctatgttgatactcacagacttccctttgggtaagtttccttcgcaggcctgcttggaaagatcctgacgtccaatcaagagacagacagcttctggccagtctgaggcaggctgttcacgacagtgataaattgcatctctgatgggaagagcaattccaaagggaagagtttccaaatctcttaaagtgaatcctaatggttaaaggaagagagaaaaattttaatttagactcgccactgtcccaattatcctgactgaagttggcaacaatatctatcctgacaaataagttcattttattcatcttactaccagactaatgtcttgacatcaaggactagtataggaagtctctttgaaagaacttgtaaaaacctgaagaaaaaaagacaatctaatagaaaaatataaaggacaaaaagacatttcctagaaggggaaacataaatgggcaacatgcatatgaaaagatgctctacctaattagtgatcaggaaaatgcaaattaaagctactgagaaatataaatgtcaaagccaatcaatactaaatgttggcaactatgtagagcaataataattctttttattcttttttttttttttttttttgagatggagtctcgctctgtcgcccaggatggagtgcagtggcgcgatcttggctcactgcaagctcctcctcccgggttcacgccattctcctgcctcagcctcccgagtagctgggactacaggcgcccgccaccatgcccggctaattttttttgtaattttttttaagtagagacagggtttcaccgtattagccaggatggtctccatctcctgaccttgtgatccacaagagcagaagaagattctgatcatcatgacaggacaaaaaacataaactaggaaacagggacatacatggcatatatggtcaccctaccagctgcagaaagcataattggtgaattatttgcccaactgctccagatcctggtcagtagcccacacactagaattatagttgctgagcccatccccccttattccaagaatctctgattggctgccttggaagctttagctcttctcactgtcataccacctttggttctactgtccaaatgctgaccttctgttataactgcaggcagcctggtggtcaagcagatgtccccaagaacttcctggggttctctctgaactttgagccatttagaatcaccaggatgccttggtcactgtcaacatcaaaatgtgaatcttcttagacaccaccggtagttaccgtacctctagaggaactgagggttcttcacccacaaatgaagaccatctctaaagtgccccatcacattctagaaggatacagctgctggaagaaaataaagtgtcccaccaccactcccacagttcttaagctcatacacaccaacaaccactccaggaaccaactgaagacttcaaatatcatagtaccagagagggttgatgccaaacccacttctaaaactgtgttcactctcttggagttaccaaacaggcttcacaacctcaaagccatttcacaatctccccaaagtctcaatctccccacagtctccccagtcacaatctccccaaagtctgccttcccagactttgctggtgactgccatcactgacataacaacgtggctggaaccctgctgctgccaaaaccaccctccgactctctggccaagtcaaacccctcacaccactatgggagtagtgagaactctctgaaaggccactaacacttctgtaagccacaactaccaaaacaagtcctctgagcccatgccactcacagtcttgtcataccacacctaccagtgaacagtattgccttataagcatatagttctgactcaagcagcgtcaagcctagccttttcacaggataatttctaacagttgggtctacccatgagttacacgaaccactctccagattcaatgagcttctattacctctgttacaactatcactcttgtgagtacagactaagttaactcataagactgtttagaagatgcctttgctacaaagggcactcctcgaaagttcttcctaccctcccagacatttacgatgtgtgaagagaaatgccccaaccagtcacaatctccccaatgtttgaagtagtcagaggtatcacacagtaaccttgaactacttctcttaggtgccaataggactatgaactccatgaataaaatcagctggtactaaaaatggtaactgcttataagtcaaccaccaggtcaaagatggcttactcaaaaaatgtcacaagaaaaaaaacatcaaatcaaagtgaccagcctcactgcctagcaaccaacccactcactcattcacacagaaggcaaaattgaaaggtagctgggacgcccataggaagaaaacagttaggatgatgcaggggagactgatacaaggctgttattctaatcatcccataacagagacagagtcacagctagggaattattcaggaattaggaaaagttatttctggtaaacaaactcccacatactgggttaaaatttctttggaactttatttatcatgaccctaggagctctagtcatatatgcaaatggataaacaacaaagctataaaagcagagggttttaattttgcttttattttttaaataatagcaacaaggaactttagtaagaataacatagtaaaactagacctgtaaaagtcatcaaaagcaaacatgacaggaatagcataaagtaatttgtgaaagctagtattatcaaagcactgacagaagaaaaagaatgatgctaaaaaatacaaaacacttctttcaataccataccttatcaatggcttttccaacccgagaaacactgctgtggatgtctttgtggtcggaggccaatttttgaacagtatcctttattcttttacagcactgtgtcaaaacaagtcaaagtgtccctgataattcagcatcttggcctataaaaaaacaaaggaaggattggttactcacttaagcaaacccaaagatggcaagtttctaatgggccttttggaccatgaaagatggaagaaaagtgaagaaaaaccagtatctgctttgaagctgatggtcacattcatagatgtgatttttcaaatggatactcagaaagatataatttttttattttttggaaataagaaaattttactgtgaaaggaatcatttttatcattacaacaaccagcacaggctgtgaataatactgtcaaggcagtattatttttgagaaaatatgtctaagtgaataaactcacttattaaacccagttacactgttcaagtcattctcaaaacgttctggttgttactaaatttcctcaagagagatgatttagtgcaaatgcttcatattccatataaagaggtagaagaaaacaaacttccctgggtaccacgatgtgcagaaaggagttaacacagcaggtcatagactactacccttagaaagtcctgcttacaaagtcacctcttggctggcatatagaaacctgggagtttgggagtgttcccatcactccctaactcagtgttccccaacctttttggcactagggaccagtttcgtggaagacatttcttccacggacgagggctggggggaatggtttcaggatgaaactgttccacctcagatcaggcgttagttagattctcctaaggagcacgtgagccagatccctcgaatgtgcagttcacaacagggttcatgcccctatgagaatctaatgctgccgctgatctgacagtgggtggagctcaggcggcaatgctcgttcaccgctgcttgcctcctgctgtgcacggcctggttcctaacaggccacagaggggtactggtccatacccgggggtttggagacccctgccctagctgaaaagaatggctcattgtgcctaaactgttgtacagtgtgatttatggtgaacatctgctttccttctgggaatctagaatgttgatacatgctaggcagtgagtacctggctttctcctggcttggagaaagcttccaatagtcctctcccagtgaagtcacatggaatatgcttaattcctgcagccatggtttgtgagaagtgttaagtgttgcctaccagggaagctcattagaagctcagtgcccagggtttttattgggggctggtcaccagggcacccactgcctaactctggactgcctaactttggactttggacttctgccccatgagtcttttccctttggtgattttgctttacacccttttgctgtaataaattctagctaagagtatgattatatgctgaattgtgtgactccttttaatgaatcactggaacctaaaggtggttttgaagacccctgacacacatgagatcaaccaaaagttactacagtttacatcctttccctgagctacctccctccaaattttgttcctatagcaggaaaaaaaggaggagaagggagaaaaacagacagataaaacaaacccagttatggtatttgtcatttctctctctatctacgtattcccacctgtaagcaacaggcctggtttctgaaatcctaaccaacattatatagaagagcttcttgaattttaatttacatcagaatcacttaaagttaaaacaaagtagctggaccccatccccagagtttctcattcaataggtccgggatggaacctgagaatttaaacaaggagcccaagagtaaaacagccctaggatgcctgctcatttaaccaatatttattgagcactcactatatatgacaggtacagcagtgaaacaaaataaccaaaaatcccttcccaacaacttaacttctggcaagagacgtaacacacaaaataagcaaattatatactacgacaaaagatgatacatgctacctgggaaagaaaagcagggtaagagagatggggagtgtgtgtgggtggagcagccgcaacttcaaaacagtgctggcatggtaggcttcactgagtagatgacactggaggcaagacttgaaaaaagtgaaggaattaccatgtggctggctactttggggtaagcatgccaggctgcggggagaaaagccctactgcaaaaatacacctagactattcaaacaacaaagaggtcagcatgtcaaaagtggatttctggccaaggaaaatagaagaagaggtccaagagataatggtcctggtttggtaggatctctttggcattgtaaagacttatgcttttactttgactgaaagggaccactgcaaggttttgagcagagaaggcatgtaaactaattaaaaaaaaaacccacaaaaaacatttttttttttgagacagggtctcgctctgttgcccacactggagtgcagtggcacaatctgggctcactgcaacctctgcttcccgtgcttaagcaatcctcctacctcagcctcccaagtagcttggatgacaggcgcccaccaccacaccggataatttttgtattttttgcagagacagggcttcattatgttgcccaggctggtctcaaacttctgtgctgaagcaatcctcctgcctcggcctcccaaagtactcggattacaggcgtgagccaccatgcctggccgataaaacatttcaatatggtcagtctaactggcaacgggagtaccagaactgagcaggaaaataagaggctgtggcagcaatccagatgagaaatgacactggctcagtccaggatttcatgactggacatgagtgaagaaaaggactcacagatgtctccaagatttctagcctgggtcaactagaaagatggagttgtcttcagttaaaacaaaaacaatctcagcacttcaggaggccaaggcaggaggatcacttgagcacaggagtttgaaaccaaccttgggcaacagagtcagaccctgtctctacaaaacatacaaaaattagctgggcatggtggcacacgactgtggtcccagctacttgggaagctgaggtgcgaggatcacttcagcctgggacgtctcggctgcagggagctacagcactgcactccagcctgagtgacagagcgagacctcaactccccatcctgccaaaaaagaataaaggctaagcaggtatgaggggagaggagagagagaaagttcagtttggggcttgttaagtttgagacattgagtaggcaccgcagtgcataagtggaggagttggtgagatatacaaacctggagttcaacagcagtgttagtgctggagatacaaatttgtgagtcactgacattatatatatatatatatatatatatgatacttaatgcatgggactatatgaaatcaccaggggagtcagtacagacacagagaagtgataaaagaactgagtcttgagaactccaagtttatgaggctgggaagaaatagaactggaaaaggaggctaacaaagactactgaagcactaactgtgatggaggaggaaactcaagaaaagtataatgttggggaaaccaagagaagaaaatgtgtcaaggaaggaggagtaaccagctgtgttgatgtgctactaggtcaagtaagatggggactgagaattggccactggatttacaatgtggaagtaatcagtgacgatgacaagaatagtgtctctaaaattctatgaaaagaaatcctaaaaggttacagggaactgtgaagagggactatattaagtctggttcaatgacaactactgagataaatgaaaagataagaaaaaagctttccttatctctaaatacagttgcacaaagtttctatcaagtgtttccaacttccaataacacaattaggcttccaacttctaataacataatttaggctaaggcaagacttggtacttcaagaaaatttcaaaatctgtttaaaaggtgttccacagatttcttggaccaaaagcatctaattgcttcagcagctctgttctggccatttctgatctttctgtacctaaagcacacctaacctcaacagcctcatcttctctatgaacccatctgaccacagacttactccctcttctgaattcctggtaacttctgatctctcccctactcccccagcacttaattataacccattttaacaatttcatgtatatataccgtcatcagtctctactaaacataagcccccaagggaagaccaagtccttattataaattgtatactccagttttatattaatagtgcctgcaaatgtgcaagacatataagtatctgaattgatggtaaataaagtgaggaaaaaatagtttttgtttttgcttttgttagagccatattcaacaaatggtgctgagacaacaagatatccacatgcaaaagaatcacataatatataaaaactaattcaaatgagccaaatgcagtggctcaagcctgtaatacaagcactttgggagcccgaggtgggtggattgcttgagcccaggagtttgagactaacttgggcaacatggcagaactccatccctacaaagaatacaaaaattagcagggtgtggtggtgcacgcccacagtccaagcttctagggaggctgaggtgggaggactgcttgagcccagaaggtagaggctgcagtgaaccgtaagcatgtcactacactccagcctgggcaacagagtgagaccctgtctcaaaaaaataaaatcaaaaataaaaattaactcaaatggaataaagacctaaatgtaagagctgaaactatcaaattcttaaaagaaaacagatgcatttctgaccttgaattaggcaatggtttttcagctatgacaccacaagcacaagcaaccaaagaaaaaataattaaaatggacttcatcaaaattaaaaacttgtgttgcaaacactatcaataaagtgaaaagacaattcatagaaggggagcaaatatttgcaaatcacattctgataagggtttagtatccagaataatataaagaactcttaaagctcaacaataacaagacaaacaatgcaatttaaaaatgggcaaagcacaaggcacagttcacgcctgtaatcccagcactctgggaggccaaggcaggtgaaccacttgagcccaggagtttgagactagcctggacaacaaggcgagactctgtctctacaaaaaaaatacaaaaatgtggctgggcacagtggctcatgccagtagtcatagcaactagggaggccgaggcaagtggatcccttgagcccaggaggctgaggctgcagtgagctatgattgcgccactgcattccagcctggatgaaaaacaagaccctaactcaaaaaaaaaaggtcaaggatttgaatagacatttttcaaaagaagatatacaaatagccaacaggcacacaaaaagatgctcaatattattggtcattatgagatgaaaatcaaaactacaatgagatactacttcatgcccacaagattggctatcaggaaaacacaataataactgttggaaaggatgtggagaaattcaaagccttatccattgctagtggaatataaaatggtgcagacaccatagaaaacaatttggcagttcctcagaacgttaaacagttactatatgacccagaaattccactcctagttatatcctagttatatacccaaaagaacaacatgtccacacaaaaacctgaatcagaatgttcacagtagcattattcataagacaaaaactggtaagaaaccaaacctccaaagaatgaatggataaacaacggattatccagtcattaaaggaaatgaggtactgatacatactatgacatagatgaaccttgaaaatattacattaagtattcaataagccagacacaaaaggccacatattgtgtcatttcatttgcatggaaggtacagaatagacaaatctatagagacagacatagattaatggtatttggagtgggaggagacagggtgggaatggagagtgactgttaatgagtactggatttctttcagaaataaagaaaatgtttttaaaaagaagtcatacctcctatccatccagacacatttatttctacaaccagcagacaacaaggtaggaaaaacacaaaaaataaaaagggtgccaggtacgatggctcacgcctgtaattccagcactaaggaaggccgaggcaggcggatcacttgaggtcaggagtctgagaccagcctggccaatatggtgaaatcccatctctcctaaaaatacaaaaattagctgggcgtggtggtgagcacctgcaatcccagctactaaggaggctgaggcaagagaatagcttgaaccctggaggcagaggctgcagtaagccgagattgcgccactgcactgcagcctcggtgacagagcgagactcggtctcgaaaacaataataataaaaataaaaaaggatgaagccaagctggaggaaagaggtcacctagaatttaccactgaacttccacgcaccaaccttgaaatccaatgatattttcaaatcgtagtaacttacatatctggagtttggtgctatttgttacctccttttcttcctttaccatctacaaattcctctaatttttggttttcaattttatgaatgacagatacaagcagtttatggccaattaattaatactgagagttctcagaatgctccaaggaaaaataatttctgtaaggtatttggaaactcaagaaaagcagaatggaataatctgaaagagaaccctgggaaagccctgttaagagagaaagagttcactaatgcattttcaaatggactcagtggaaagcagccaaaggtttaaaacaggtttgaaaattgctataatgaccagactgacagtcaaccaaacttctataagtcctactgggagagttctaacgttcttttgatttctctgtatgaaaacacaacctgcttctaggagaacctttatgtgaaagaaactggattcagttcctagaagaaaagctggggaattactgtgacagccatctccaccataactacatccaggttggccactgcggtggtcacttgtcacccagaagaaagtcctgcactaactgtgtcttccaatgtagtaaacccagggaacccaggcccaatgcatgagcctgaaagaaacaactctgacgcaatgctcactcatcactggagggtcacaagtactttttaaagtcagttttatgattaaacaagtgtaagaattagcatgttcaatataagcaaagaacgaacatatgtagaccatctacgtgtgttgctttattaagttaaaattttcaataaaatagaacagcaccttttatcatataaacagattttaagcacgacactcaaaattttcaagttctgcccttgagcctcactgctttgccattttaggatgtatgcccactagtttcacagaaacaataaataagaaaaatgtttgtttccatagcatcctatacttccctatcagagtttcacactttgttgtaaatagttatttgtccattactcccacaaaattaactttagtaggaaatatgaccaatccccaacgtttagtatagtaactggcaaatactacacgttcagtaactagttaccaaaagaataaatatgaaaataattaattatgtattacataatctcaatttcaaacccagcattgaagactgtctggtactaccaacaccctctgaaattgccagcagtttcactcagcagttcactgacccctcactctctcacagaatgtttagcatctgctacacagtaacactgcagcctaagttctgcaaataccaagtaagttaggaaataatactgttcctgtctgtcaataacattattgcctaagtagaaaatcccaaagaatctacacacaaacacaatccaagaatagatgagagttcaacaaggtcacagtacccaagatcaacacaaacatacaaacacacatatgcacacatattttcaaataagacacattcacaaaagagtcccctggcatcagttataagttccttctctcttccaaataatgacctctcccaccaaccccaggaattaatgggcttgtgctctgactcaagtcacttttgagacagtttcttttttacaaaactatttccacatttgtcaaagatgcaatgaaacatctctaatatataatgtgaccctataaaagtatattctaagtcagatataggaaggtataacaaacgtacacattaaaagggtgactggtttgcacaaagctaaaaactataaaatccctactaataccttggttacaccttcaatacacttttagcattttgtacatacatttgttttactttcttccctactgatcacaagcctcaaaaaaaagcacgtctcgtgtccagctccgtgacaagatttacccactattttggctcaccttaatacaatctagacaaatatatcattaatattgacaagtacgtttctcatccctactcagtatctgcacttttaattttctgtctgccacttatttttatgatatggggggagggggttcaactctgcacaaacacactgttaaagatagcattgctaaaactaaacagctggttggtaggcagcacaccatgttgcagcctgaaatgtctgccatcaggagataataaaaagttctaatttggtctataaaaggcagtttaaaggtgtcaattacaccatgaaatacatgctgcccacgagtcaaacacatgagagatgagacccaccatacttgagagcactctataaaaaaatagggaggcacaatataaaaaagtattgttatggtgatgattttcaagaaggttgaaagtatcaccacctaagactggaatatttccacagaaataagattccgcagaaatcactaagacctggcttgacattttaatgaatatcctataggcagtaaaaatttaaaatatccaagtttataaatattacatgtatcgcatttgagctcttctgagttatgaaaagttaactccactttcataagatggacagagatcttaaatttagaattaagtggaaagcaaaatggaacacaagttttgatgcagataaatacaaagaaatccatttaggaaacaaacctaactgtacctaaatgaaaactcagacctcatagagatatactccagaattcattctagattagctatttaaataaaaacactaaaatcagaaagctaaaagagtattaggcatcactaagaaggctggtggggggggaaatctatgatataccactcttataaaagccttgatgccttaaaatacaaaatgaaaccaagaaaaaacagaaaaaaatgtaaaagggagaactatgacatttagagtcaattaacatttattgagtgctgaaggcctgtgtcagcaatgttcaagatacttttcccatgttaccaatttctacacagatttaagaaatttagaatgggaataaagtagataaaggataaaaagatctaagactgactctagaaaagtcactgacaaggtgaccatggatatccttgcgaagtactagaatagaaaaacttgaaacttgaaaaggtaaggttggaattttttaaaaataagggactatttcattttgtctgtagtaaaataaactgcggcccattgaaatttgggattcttgtgagctacttcagcacctaggacacagcggctgcttagaggaaagagaaaaggcacaaatagaacacattcatttttttctggaggaggtaaacactgaaaacaaaatttttccagtatattagtagctggtaaatctgcaaagtaaaagaaagtatggtatttggtgttcaactcctgacctttcagagaacagtagactgacagacacgtgttctgatccagagagattattaaagactgtgcatcaaattagaggcacagtgtgctgcaaaccaaacatgaggggaaaaaaacgaaataaagttaatatttagagtgaaattacatggtacagactaatagtgctcctggagcaaagaacagtatcaatgactatcatagagaagacaggaaaggcttcaaagtatatgaggcaagaattgcagagagaagaaaaaagatacaggcacaagattttaaacatatgtctgtgacagtcacattttagagaacctattcactcccttcaaattccaaatataaagacttaatctctaggcatctcatttatctctgaaatgaatggtggaaccacattaggtttcctgtagcattggaatctggatttcatatttaaaaatcaaactcaggccaggtgcagtggctcacgcctataatcccagcactctgggaggccgaggtgggtggatcatttgagttcaggagttcaagaccagcctggccaacatggtgaaaccccatctctactaaaactacaaaaattagccaggcggtagtggcgcatgcctgtaatcccagctattcaggaggctgaggcagaagaaacacttgaacccaggaggcagagattgtggtaagccgagacactgcaatccagtctgggcaacagaatgagaccccccctcccccaccccccaaaaaaacaaaaacaaaaacaaaaaaaaatcaaactcagatttccaccttcccctctcctaaacttcctattttctacctggttccataatgatctacccatcattcatgtttaaaaccttggattaacctttggtttttcctgcccttttctcctactctgccagactccatctgtgcaccaactcctggtcattccttccctcagaaatccctttcatgtgtccctttaaatttctaccaccagtacccaaagacaggtccctatttcatcaaatctaggttgacacttagccttagctaaccttcttgcctctagtcaaacctcactcccaactccaaaccaacctaaatactgctgacaactggtctctgatcgtgtccctgtcccctccctattcaaaatgtccccaccccaccccaaagtaattcaatatcttcccagtctactactttccctggtatccatggctttacaaaacctgattccaatttaattttaatgctcttatcgcctttcccctgcaatctggtccttcacctctcactcctctacacctttgttcttgccatcctcccctccaggcactccatatagctctttctgctatccatattcaatttctgctactaaaacttcccataggtaaaaagagtctctccttgtctcaaatcctacccctttttgtccacaccactcatgtagcatctagcctagatacataaccgtgcattacagggcactgcttttgtttgtgtgtttgttaaaaaatgccagtctcatctccctaactggacacaaagttcttagaggatgaaaatgcttgttctttgtaactcctagaagattttgcttagttctacctataaatggtgattaataactactgatgaggtgatctaaagttcagttgaaataatgcccatctactcccatgcagttctttctaagggctctctctcttcactggtgtctgtactaaccagaagcactgttacacactgtgtgccatggtcttgttttttccccctttcaaatatgagtctggtctctccaactaacttctaagttccttaaagactcttataccttttaagcattctttacaatgttaagcagaccactggacacagagtggtatttaacataaaccagtaataaagacacctaaatattacccaaaatgtctcaattaaacagtgcttgggcccggcgtggtggctcacgcctataatcccagcactttgggaggccaaggcaggcagattacgaggtcaagagatcgagaccatcctggccaacatggtaaaatctcgtctctactacaaaaaaaaaaaaaaaaaaagtcaggcctggtggcatgcgcctgtaatcgcagctactcggggggctgaggcaggggaatcgcttgaacttgggaggcagaggttgcagtgagccaagatcatgccactgcactccagcctgggtgacagagcgagactcagcctcaaaaaaaaaaaagcttaacaccacttaaggcacagactttataaataacacgtctaccctgttttacaaatttcaaagccagttcacgtctattatttatttcactctcataactctgtgatgtcagtttactgaaggaaaaactggctaagcaagattgtaggatcaggccgggcgtggtggctcatgcctgtaatcccagcactttgggaggctgagacgggtggattacttgagcccaggagttcaagatccccctagccaacatagtgaaactccgtcactactaaaaatacaaaaattagccatgcattgtgcacacctgtaatcccagttacttgggagcacaagaatcgcttgaaccctggaggcagaggttgcagtgagctgagatcacacaccactgcactccagcctaggtgacagagtgagactctgtctccaaaaaaaaaaaagattgtagaaccagtaaattggcagtgcaaggattcaaacccagacctcctgggcccagggtcaaaattttaggtactattccacaaatacagattcaacttctcaattagcctccaagttcctggaggaccagggccatgaataatttcttttaaaagattctctcctcaactcctcccaaatgtcttcatgtatcaataagatgaattaaacctatatgaattctgcagatacaacaaactcatcataaataacacacagcctgacactacattgtgcccccataacagacgaaatcaccatccaggcctccatcttaagtggagaaagacttggtaatataagcctatggcctctccaagcgacattcccaaacaaccattttgagctcagccacacaatcaccacacccatataaggtgaaagcatactgtatttctcaaaatcctcgagtcctgccagacagtctagtctttgttctctgaagggttgagttaacatctaatctaaagagaatggccagaagtgtctgctactctcagagctttcaaggaaacgtccagttagagagcatcatctcctggaagtaccacgggtctccaagtacacatagctcagagccagggccctccataattttctccctaaactgcatttttggatcatttttaaagactttggaagccttacagatgaagaagcagggccctaaataaaaataagttagttttaatattccaagtgaacagtttgctaaaacaccattttcatcatcctaaagactaagagactaagacatgaaaacaacagaaacttctctattagctctagtatgacagtatcacagaagtgttggcaagtttctccttaccaatgttattatccagagttagaaactactttagaaataaaataactttaggaaaattactttactatgtcaagcattaaagtaatttcaaaaaagttctagaggaacatgaaccaagttgtattctctagtctatagattaagtcatactaacaactcactacttgaattatatgagcattatagttaggaggccaggcaaaagctgagaaggcgaggctagtcaggaaaacatctcagagaatgttactgatataacatgtagctgttgcactgtaatagacatatattactctgtctgggtttaagtgttcctttctagaactgtctctttacctgatgaacagtgtattataaggccatatacctcctgagggggtgagcacagctcaaggtggccagaagacctcactccctggtcccagttactgattcagggaaaggatccataacggaataataaaggtactccctggagtatctccaacaaaatggccatgttcctgtcttttgagctccattggtcatctctaccccatgtgaagaaaactaccctgaaaatgaagccaacagttgacagaagagaacaagatcagtcctgatgacatgcctggtgcccctggagccagcctagccctaacctcagcctatttatacatcaacaaattccattttaatgaaaactattatgtcacctgccagtctaaatgaatatggtgccaaataaaaaagaattaattatctccagagtacgtctggaaaaagaatggctaacaaagttaaatctacttctaaacccaactggaaacaccaatatactgactttttattcttaccacctaaaatggcctaaataacttgagaaccagtccgttcttctcttagaatgtttgaacaatgtccacccaaacttttatttatgacctactgatatactattttccagactagatgttaaaaacagatatcaaattgtattcaaaacaaagtcactattctctcaagagtgtcttgttagtatttagcaaaagtctgggtaacaaatgggcaacctggctatgaggcctactccatgcacaccaaagaataaggctaaaaaggtaaacaagctacaagtctaccaagccccgatataatacatttactttcattcaaaacaatatattcaacactggtcggctctgaaaaagcacagatcattcatatatacaaataagcatacttttcaacacatgtgtttaatatacacaacccaaattctagattggaagattatacctaacatgcgaccctcaacctctggtttctgtgtactgatgcaatatcataccacagcaatgagttaaaaacgtgacctccacaagtttctttttttgtttttcatgttttacttgcctacttaccttctcatttgttaccttcacatttttaaaaagacagcagttctccaactggtaaccaaagtttcaacagtttctttgattcaccgaagagataagggtaggagttatggtttacatgagttttactactagaagtcacaacatacacacacaccaaaggagttttaggtgctaatacagtatatgttgatcactcccacagatgaagacatctttaccaacttgcaaagtgagataacactaagccttaatcatagtaaatggaaatacatatccgatgcgttaaagaaaaaaggaaaagtgacaaatcgtcatttcactggattcttttaaaattttttctggaggtcgggcgcagtggctcacgcctgtaatccctgcagtttgggaggccgaggcgtgtggactgcttgaggtcaggtgttcaagaccagcctgacccacatgttgaaaccccgtctctactaaaaatacaaaaattagccaggcgtggtggcaggtggtgcctgtaatcccagctactcaggaggctgaggcaggagaattgcctgaagccaggaggcggaggttgcagtgagctaagatcgcaccactgcactccagcctgggtgacagagggaggctgtctcaaaaaacaacaaaaaaattttttttctggagactggcatttatgtctgtgaagtgggcaaccaggtggtccaggaacaagagtagaaagatttttcaatgggtgtcttttttatcatttgagtttataccatttgaatgtactattcactgggttatctttttcattgtttgaatggataccatttgaatgtatgacttactaaaaattaataaataaattttaaatttagaaaattccttgaaagtcactttcagaaaccacattagaactccgttagtctaaaaataatcagaaaagaatactgcatgtcctttactcttacaaaaactgcaattttcccaagtatacttttaaatgtgtcctgaaaccattaccaactgtttctgcctaattttctttcacaaagtatgagtgcagaataccagcaaaacatgataaatagttcttttctgtttttcccttccaccacagaggtgctaatgggaaacaatataaatttgccaataggaaaaaaatgctaaaaggcatatactcacaaatcaaatcactaaaagttaaccatacagtagttaaccctgttaagccagggttatccaaagcaccgctcccataccactgatgcgaatggtaattttagctagtatgtaaactaatattttaattgttatgaatttattttaacatgtagtttattatacctaatacctacataccacatgtaggactacacaaatatcactgcctaagataaatctacttaagtaaaatcgtgaatccatctgaaaaataagagtgcacatgtgtatgagtgaagttttagaagcaccagtgcactatacaaattagatcgaggcacactgggaatgaccaccagcctacattaaccacaatgaacttagaccaaacttcgtgctcacagggaaactctcactgaaaggctggcacaactaaatgacagaagctgtgatctctattcctcttaccttggacacctcactgcaggctctggatcactccccaccctcctatctaccaccctaaggtttctaattccaaaggcatgaagagaagtctagagtcagtctccagggagaggaatgtcttggcctcggcagagctcttcagtattctccctggttcttattgcctcttcatatttctattacacctatgttgtccctgaaccaccaatattccctaactgtctatggcaccaagtcgaagcctgcacttccctctcagagccttatattccattattgttctctgctgcaggcctgataccagtccaaccccatttaaaagaaaaaaaaaaagatattcctgttgtcaggctgatggatttggccagaggtggattaaatggcagagcacaaaccaattcaccaggtatgagagaccagcccatactatcctcatttccccaagtgtatctgcattaacaaacttgcattttaaaaaagattaacgagagaaattttatgtaaaagaatttcaagctacttaaaggtgatttagaccacctgagaaattttagggctcactgcaggactatctcccagccagcaatcaggcagtatttacaatctggaataagggtgctgagactagaaaagggttgtcaatgggcttactaactaaactcttatttatgtatgatcagtttccatcacaaactatcctaacagctcatttagtatatagctgtctgctcacaacttcagagatgaaaaaaaaattttaacataaaacattcatcctcagaaactgaaccaatccctttaggttggctaaaggatgcttctgcaacagtcattcaccagtatgatgcaatgatgtgttctatatagtcctcaaaaattctgttttattcataccagattcttgcaagtattaccacaagtaatctcagagaatgaggtccaaagtcctgacagaggggtcccaattagagcctctcaggttatcagaatcatttgcccagacaggtatattcagaagcccaaaaatcttccctttaaacttgaaaatagagttccaaactcagttttcagtaaaatacctttgagaagggcatatttaagtttcaatgtaatatctaccacatcacctgccgagaactttaatttagaaatcatctgttttcaaaaataccatagcccagatgccaaagcatgatgtttacctttacacaaaaaaacaccaaaagaagaaagattttatttgggaaactagacctggcacttgtggtatttattttctttcatgttttataactacctttagtcacttaatcctattattgaagaattaaaggaaatcaaagagataccaatataagactagcaatttggtagacaagagggaaaaaattaggaggctgaaaaaggaacacacaaactcaccaactcagactgtttttaacagcatagcatactgtgtggccaatacccctcaaaccataaattctgagaaaagttccctagtacccagtggagagtcaaaaacaaattcctgcctcagcaatttctcaccatcattttatccatctgagcctggccctaaattttctaaaacaaagctcacaatcacatcccccttcaacttacatcctctctcatggaagaaaggtactttctgttccatcattttcctctcaaactctgcctatgacctggtccctaaaaacgaaatgttccttccacctctccaagtctaggcccttcattctcttcctccactggttccttggcagggccgggagcacagagggaatacctcccaccgctgtactggatttcccacaccgcggttcacatcgaatttttcttcttaacccccagtaatctggcttgtcttagcaattctatgaaactgcaagcacagagggttactgactcccaatagccaaataaaagctgaccaatctctccttttctaagtcctcgcccttttcgatttctgctggctctatctagccttggctctccactcgccaaggaaaattcaagactgtggttagactctagtctttcttctgtgcaatctaagtgatcccctccactgtcctcctagaaatgacatcagaaaacaatcttagacctatgcatctccagccaccagtaaataggaaagccctcgattctatcttcattaagcccttcaaccttacttcacatgtccaaaaccaaattcaaagtcttcccaggattcctgtcccattccaccttcacttccctgtatctaccaactatatcatcatcgccacgtcagtcaaatttcccttcacaggcagccaccaaggtctgctcgtttttccatactagtattgcaactcctatgagaattaatacggtttttccatattaaaatctcatccactatgactgcaggtttgcttccttcctggagttcaaaaatgactgcagtgtccagaatgagaagctgctgtaagactcctttcccatggaccagcacccatcctcaactgaaacgcagtctgggaaagtgtgaaaaaatgaaggagaaggagagagacactcagctaacgccactgccctcatctcacctgccacaaataatctgcatcttcccccagctaccaaaccgtccttcacataaatttctgttcagcccacaagctgaaaagcctcctcagcctcttattaaagacccactaaataagtcctttacttcttgatcaaaaggaatcatcgctgtgacttctaaactgtaagaaaaccaaacctttaaaagtacctgtcctcagggcttggggcagtaaaaaaaaaaaacaatctaggtgaaacgtcttctataggaaaatttattttttttgaacgaacttaaccaggcaaagcaagtaactagcaacatgtgcaccatttacttgggcaaatgtcgcccgttcctcctcggtgtcatcaaaaggtacactgggagaacagaagggttgaattgagctggtttccaaggaaccatgtcagagccgctgcggagttaagagctgcgtccacacagcagccaaatcatgaagttgcaggagcggctgttgttaacccacagctaagaataacgctcgactttccaaaataaaacgaagaaacgaagtcccctggccaatgattcggggcggcacagaggggaaacggagcttcctgcactgccctcatcactcagaacctggggtcccaggcgattcagtcaccgcccgcagaacagcgccgcgggcaccacgtgaaactcccggggccggctgggggcgggggacgaggggcgcccactcgggggtcggcagtttgcaggtgcgatgggcggccccctcacccacgtttatccggactggagcccgccgctcccggccgggtttccgggtggttcgcgctccttctgaattggcagcgaggtcgcggcaggttcgaggtaaatcggacgaagaggggaaaaagtctcaggggtctgggggcctccgcgcctcaggggaggcaagggccgggccagaggcgcgagggtgggtgagggattcccgccgcggggccgggaccggggctcgggcagtgggccctgccccgcgcgcccacgcgggccgccctaccgtggctctgcaggatctcgtgcttgagaccgccggtgtagtcgatgagctcctccaggccgcgctcgcacagctgcccgtagcccgagaacttgtgcagcaccttctccagctcgcgctccaccgtcacgcactgatccatgccggaggcggcggcgctcggctcctcggcgcccaggtgtccgcagccgttcggcccgggccccgccgaggccgcgtcctgctcctcgttccccaagcgggcggcgcgggaggctgaggcggccgaggcggcgggcgcactagccgcggcgccgggggagccccgcgcagccggagcccgcctgccccatggcgccctagccccctggcgagtcgccgctgctcccgttcgctcgctgcactcggccccgcgtccccaggccccgctcgcgacgttcgggtgcctgcgacggcgcggccgattgtttttgttttcacgggaaccgaccgatgacctggttctcccgggcggca

SEQ ID NO: 577 - DNA, 478242 bp, Homo sapiens
ggatgccaaatcaaagaagctagtaggaagagtgacaacagaaaagaaccaaccacagaggctgctgatttacatgttattgaaatactttgaaacacaatgattaattaaaatgtttcttctgaacaaagagctaaagaactcaaccaatgtcttcactccatcttctaaaaaataaccagaaaaggaaaaggaaaaagaagtaattagaccatccatgcctacctcataggctagtgaaagaagaacacaactaatacatgtaaagtactactataatcaagagaaatatatatgtacatataataatattttattaccaccctttgcaactttgaagatgtcaatcaaatcttttataatttttcactatatatatagctctctctctatatataatataaatgtctagcctggattatactcttgataagaacaaacaaaaagtaaaaataatatgccatgggattattactttggggtattttgaaaagtaagtgaatactttgatatatatatatatagagagagagagagagatagagagagagagaaattatcttttatttatttttgttccttgcactccacgtagtactttcatggtctgtgcacttcaataacaaatattttcccctataaagtgctacttacaatgaagttgctaggtgcttctagaatgctcacaactgtcattgtcactacttactatgtatgccctaataatcatacttcatatataccacctcgataaagcctcatgtcccaaacttttttcccctttctccaggaatttgacctctgctgctccatttctaataatacctgttatcttaactatgatcatctagagacaatgatccaacatagtttagtaattttactccttcaaatttaactctaatttttgaaatttaaatattgtggaaagtatatgacaaagttagtggtggaagtaggagtaggaggagcagagtagatgtagagagaaaagaccttttattatcttaaaaatcacaccaaatttttttcagtggagctcagccttttaatactgaataatattttgagctagaaagcaggtaatgttagcaatcttgaatattcatcaaagggctaacaagtgattaagaagcctgtgtgtgtgtgtgtgtgtgtgtgtacatattttatacagatagtggcaattggtggaatacaaatatgagttttcttttttccatcaaaatttgatctttctcaattcagacaaaattctaccgacatttaacagaacacagaaaaccagctacaagacctgcaaataatgaattaaaggatagtattactgagctataaagtacaaagcattttggaacaagtcagtgttttgttattggagttatttcttgcctctgttgttgtttcaagcccatacacagattagcctacaatttcctattgctttatactttagacggactgaagaattattcaatggagacataggcctttgaccgcattcttggctggctccatattcaatcagctttgccatgctttttcaaaagcagatttagagttgagacagatataaaataccttttgtggtggagagttaaaaaatatgtagtcaaaatctttcctagtccttcctccacacataaacataaaaccctcattctctatttagaaaccagcatgtcaggatccaagcagaaaaatcagtaaaaattatcacaattgaaaaaatgttctgatctgcaacagcagctgggggtgggtattagaattgtgtgtgattcagatgctatatagatgatgaatatggatgaagttacacaacttgatggggtgaagagattggttgagctctttgttcagagaagcatttcaataaatttctgaatgtatttcaaggttactctcaccattttgtgttttctaaatatgagttatttgggggtggatgtcagaagttatggataccaaaccaagtctttttctgaaaagactttagttgccagtaatgaagactggagttcctttgcatgtcactggaattgaaaacgaggatcacattctgtgaagttgtagctatggatacttaaacccactgttatgattgatttgatgaagcaaagatttttataaaattcttgactttattgttagaaactgataatgtcgttataaaaaaaccaaagcacaaataattgtgactcctccttccataaggatgcatattacagaaaaatggaaagaaaatgttgcctttgtctaacaaaatggtcatatactcaaagtttggcatagtgctttcgtatacaaaggaatgatatgactcaatttacataaagtaatatgattcaacatgatttaataaaataaggcagaatttcatttctgttttataaagggaagtgactaaagatttaatatctgatcctttattttgaaaatgtacaaaacctacagccacattccttctgggttaactgtgtgaagagattctcagcatacttgaattaggcgtgacacaagtcactgaaaaagctgagtaggaattaataaatgaaaatatggtcttttggtttttcaaggtcactaaatcaaatctcagccaaggtagtaggggctgtgggtcattaccattctgagactgctaaggagctaagtgaatgaatcagtgatctgtcttctacttctagtgaactgtgtcaaatgtcccccaaagcaccaacacaattatcattaattaaagaactgactaatagtcttagagaaatggtcaatgccattgttaacagggaggccaatctaataaaagtcaaattgtacttcttaactacataattgtttcctttagtaccaagttgtaacagttttgctcgaaaaaggaaaagtcataggatagatatatttttaagtttatgaggaacctccatactgttttacataatggatgtaccaatttacattcctgccaactgtgtacaaggcttccattttccccacatccttgccaacacttgttgtctttaatcttttttatcctaatctgtgaggtgatatatcatgtgtttttgatttgcattttcctaatgattatgaagctaagaattttttcatatatctgttaaccctttgtatgtattctatgaaaaaattatgtctttgggacctttgttcatgtttgaattgggttatttttatgtacttatttacttatttatgtatatttactattgaattgtatgagttccttatcagatatatggtttacaaatattttctcccaatcagtagctcgccttttcattttgttgattgtttcctttgctgtgcataggttactaagtttgatgtagttccacttgtttatttttgcttttactgactgtgttttaattcaaaaaaaaccattaaaaaaaaaccattctaaagagcagtattcaaaaaaaaaccattctaaagagcagtgtcaagtagcacttttcctgagctttaatctagcagattaatggtttctgaatttacatttaatttttaatccattttaattgatttttgcatgtgatataagggtcaaattttattcttttttatgtgggtattcagtttttgaaacatcatttattgaagagactcttgtattttcttggcacccttgttgaaaattagttgacaatatatgtataggtttttttctgggccttttattctattagtctatgtgtctgttttttataacagtaccgtactattttgattactatagctttgtagtataaactgaaatcaggaaatgtgatgtttccaaatttgttcttctttctcaagattgttttggctattctgaatcttctaggcctgcacatgaatttttgattgttttattctcttaccatgaaaaattccattggaattttgatagaaattttattgaatctgtaaatcacttcaaatactatggatattttaaagatattaattcttccagtgtatgaacatgggatagctttctattgttttctacaatttcttttatcaatattttatagttttcagtgtgcagatttttacttccttggttatttctaattattctaatctttttgatgctattgtaaatgagattgttttcttgatttccttttcagatagtttaatgtgatccagcagtccctcattatatatatgggaaataaaataagtatctcaaagacacatatgaactttcatgtttattgcaacgtcattgataatatccaagttataaaaacaacctaagtattaacatatgaaataattagatattatttaaccttaaaatagaagacaacgctgccatttgcagcaacagggatgaatctgaagagcataatgctaattgaaataagccaaatatgaaaaaaatatcctacgtggtccacttatacatggaatctaaaaaagttgaatttatataagcagagagtagaacggtgtttaacaggaatgggactgggtggggaaagtggagagatgttgatcaaaggatacaaagtttcaattatgtaggataaatacattctagaaatatgatgtacagcatggtgaatatagttagtaatacctgtctaacagttaagttatgggataccatccaatttagcaattaacattacattagttttgtaagccttacatcttaagttttactgcagtagtaacattgcaaactctcatgatttaaagaaaattgtagaatatttgatcgcaacttggatatataaattctctgaggtaaattcagaaagacttttacaggtgctgtattgcatctaaggagcgagttgaaaagtttaaaaactggactcaggcagtcaattgtgttttgactaaacaatcaaacagctggtttgatattttcataaaatttatgaatatctttattttgtcagggattacaaactggcaaattattctgcagaagttgtgtgcatgtgagacaaagaggggaatgtgaggaaggagggagaaaagagacagagttaggcaacatggtatttctgaaataaacattttaatctggaaatttttacatgtacagtaatgttgcaattatataaccgacactttctgtaccttcacccagtttcccatttcttaacattttacaaacccatgatttatcaaaactgagaagttaacattggtacattacaattattcaaagcgcatactttattcagtttattttgtttctacctaatgcctttttctgttcccatataccatccagtacaccacattttacttggtcatcgtatcttcttaatttttgatctctgacagttttcttacacctttccttggttttcatgtccttcatagttttgaagaacactaatgttttgttgaattctccatgatttaggttagttttatggggttatgggttttggggaagaataccacacaggcgaagtgtccttctcatcctagcttatttagtggtagccagatatcataaattttcactggtgatattaatcttgagcatttggctaagtcatatttctccatgggaaagttactatttttgcattttctgtaatctattctttggaagcaggtcactaatttctgtccaccctctagcaggaatggtagtatgggagagagtttaggctctaccttcttaagaaggtatctgcacacattatttgaaattattctgtaagaaagatgactctttctcatgttttattcattaatttatatcagtatggagctctgtatatttattttgtgctttgggctatattccaatactaatttattttgttgctaaaattattccagatttgaccattgagaactctttcaggttgcttcctatgtctctttgacatatctcatagtttcagtttttgaagactttcctgtttttgaatggcataagattctcataaataaattacctgccatttgtggaaggattttggttcctctttttagaaagtggcatttagaaaccaagatctgggcatgagtatgcctactgccgccaggagtgtaatattttataaatgtttttatttaaagttcattaaatgtattatggagacttttaatgccaaaatccctacgagactttactggattcttacttgataattttacacatttttaatattgtcttttgctataaagaaattttcatatagtaaaatctatcatcttttcttgctccttccactctgtatattttccctggaaatgcttctgaactcccaaggttattgaacatatttctttacattttcttaataatatgttgatgctttgttatttgatacataagtaattgggcatgctatgtcttcttggttgatcagaacttctaaaaatctaaaatatttttcatttaatttaatgtttttcttctttggattttacctgaactaatagaaatatagtgtctgtttccttttcctgagtatgttttagatgtgcttgtctttattttaattcttcataccttttaggtgtgaccttttccaagaagattttaaagaaacagtgtgcataggttttcttccaagatggcggattaggggctttcagtgtgcctctgccgcttggatatagtaaaattataaataaagataaactctgtgagatttaattcaagatggaaaacaggaatccaccagaatagtgaaggacatcccagatcccaaggaggaaagagtgggcaagtgtcccttatgatggcatttggctgataaaaccgaatgaagcctcagaatgggaggcaggcagtctccctctgtgactcaccttgtaaatgaagatccaagcaatccaagccaaaggagagaactctgttactcccaaaacttggagataacctagggaaaggtttggagatgctgagaggaaaagacaccagaggaagctttaggcattttcccgggttggggagggagagcaggatgtcctttttaatctgggtgcatgcagagttagttattctttggtgacttggcagtggcggcgatgcaggcattttagtcttgggtcagagataggagcacctgctctggagtggggcaggagccttcacagccagaattgaaggggtaagtatggaaaacacccagctataggcattggaagtatgctctcccctgttgcaggtctggggcaggagaagagctgctgcagccacagcttctcctgggcaacaagacttgcagtcagggccagcttggtgacctgcaatgggtctgtgtctgacattgcagggcatcatagcctgctccctccccagagattatggtgcagaggagccctttctgttccacaccctggcagatatccagatattcggagcacccacttgcataaatcagcagtctgagttgccctatcctccctgtgcaaagatcataaaccagggcgaccctctgctccatgcccaggcagatatccaggcattcagaatgtccactctcctggattgacagcctgagccctccctcctttcctgtgtatagatcagatgcagtggggtcctctcaactctatgctaaggcagatttccaggcatttggagcgcccactctcctggatcaggagcctgagctgccccacccttcctgtgcatagatagtggtgcaagggggggtcggggggcgtccccatgccaggcagatatctaggcattcagagaacctgttcagctagaccagtagcctaagtttcctatccctgctatgtgtagatgtcatttcaacggggctgtctccacttcatgcccaggaagctctctaggcagtctgagcaccctcttgtgtggataaacagcctgaaacacccgaacctcctgtgcagagatagtgatgcagtaagacactttctgctgtatactcaggcagatccccaggcatctggagcccattttcctggattaagagtttaggtatccccctgccctcaccatgcagaaaacttgaaacgaaagaggttccacagctccgtaactagtcacacctctgggcactagggggccacccactaggcccctgccttggcagtgatgcttgtacctgccactggatgatctgtaggcaagactgactgctttgaccctacccatcttggtttccccctatggagctgagcagagagcttataccactgtgcattctatagataagcccattgcttgtggcagacaagaccctcttccagtaaacaaggatcatgtataaacccatccacattggctgcagctagctttgtggtagaatcataaagcccaatattaaaccatccaagtgcataaggctatagtagcaaaagaaaaagagcctactcaacatttcctacagccacaactcttatggagggggcaaaggttatgacattataataataataataataatatagtggggaaagaaagaaaaaaatcctatttgcatgaaattaattactcaggaggcttaggtgggacagtcattttaacccctggaggcagaggttgcagtgagtcaagattgtgccactgtaccccagcctgagtgacagagtgagacttcatctcaaaaaaaaaaaaaaaaaaaaaaaaagaaagaaagaaactggtcagaactcctggaataagaaaatacctaatggtttgcaaaattaaattaaaatctttgttaatatactagaccaagaagaaaaaagcatttgagagtttaaagacaagtcttttgaactaactcagctagaccaaaatgaagcaaaaagaattttaaaaaagaaggtcatcaagaattacgggattaagtaaagacatcaaacctacacattattggcattcttgagagatgagaaaaataaacaagttggaaaacatatttaagagaatatgccaagaaaatttttctaatcttactagagaaatggagatccagatacaagaaatccagagaacacctgtgagatgctacacaaaacaaacatcaccaagaaatataataaccagactgtctaaggtcaaagctaacaacaacaaaaacagtatttaaggcaactagaggaaaaggtcaaatcacatacaaagcgaaccccatcaggctaacagcggacttctcagaagaaaccttacaagccacgagagattacgggcctactttgagcattgttaaagaaaagaattccaacccagaacttcatatcctgccaaattacgctacctgctaccacaaaaacatacttaaatacacagtccacagaccctataaagcaactatacaataaaactataaagcaaccggctaaaaatttcacaataagatcaaaacctcacatatgactatcaaccttaaatgtaaacagtctaaatgctccatgtaaaaagcacaaattggcaagttgaataaaaactataagacccatctatctgttgtcttcaagagagccatctcacatataacacccatatgcttaaaataaagggtaggggaaagatctatcatgcaaatggagcacaaaagagaccaggcattgctattacatcacatgaaaaggattttaaacaaacaagagtaaaaaataaataaagaagaacactacataaatgataaagtttcaattcaacaaaaagatttaacctaaatatatacacacccaacattggagtacccgcattcataaaatgagtacttctagacctatgaaaaaacttaaacagccacacagtaatagtaggggatggtaatggtccacagtgttagattattgaggcagaaagctatcaaataaattttgaacttaaatttgacacttgaccaattggacctaatagacatgtactgaatactccacccatcagccacagaatgtacgttcttctcatctgcacatggaacatgtgctaagatcaaccatatgcttggccataaagcaaattttaataaatgcaaaaacaatgaaattgtaccagccatactctcagaccatcatggaataaaaatataaatcaataccaacaaaatccctcaaaatgacaaaattacatggaaattaaacaacttattcctaaatgacttcaggtaaacaaaaaaaaataaagaattttaaaaaatcattgaaataaatgaaaagaaagaacacaacatacaaaaatctctgggatgaagcaaaagcagtgttaagcagaaaatttatagctctaaatgcctacctcaaaaagttagaaatatctcaaaccaacaatctaacattatacctagaggaactagaaaaacaagtacaaactaaaacaaaagctagtggaagaaaagacataactataagcagagcagaactgaattgagacccataaatccacacaaaggatcagtgaaactaaaagtctgttctttgaaaggatgaacgacattgataggctaccagctaaattaacaaagaaaagaagagagaagatccaactaaaaagcacatatgataaaggtgacattacagccaatcccacagaaatgcaaaagattttcagagaatattacgaacacctctatgcacacacactagaaaatctagaagaaatggataaattcctggaaacagacaatctctcaagattgaatgaggaaaaaattgaaaccctgaataggccctatcaacttctgaaattgaatgagtcacaaaaaagtctaccaaccaaatgatggcctggaccagttgaattcacagttgagttctaccagacatacagagaagaacaagtaccaatcatactgaaactattcccaaaaatcaaggaggagggactcctacctaactcattctatgaagtcatgaccttaatatcaaaacatgtcaaggacacaacacaaaaagaaaactaccggccaatatccctgatgaagatacatgcagaaatcatcaacaaaatattagcaaactgaatccagcagcacattaaaaagttaattcaccatgatcaagtaggcttcatacttaggatgcaatgttggttcaacatacttttctttctttctttcttctgaaactcctattagattattttagagctgattctcctatgccatatacctcatattttatattttgttatattttcactttttaaatattgtatgatatttatagagtatcttagctttattttaagtgccatatatatatgtataatttagaccatgttagattctttattttgtaaattttattatttctatttcaaatactttttctaatccttcctttttcatagtatcctgtcattttttatgaatacactatcctcttgagtatcctagatttcaatagacacatttacttgtcttttcagtatttctaaaattaatatgcactttgctatgaactgaattgtttacaccaaaacttatattttgaagccccagccctcaatgagattgtatttggagatagggcctataaaaggcctccagaactgtaagaaaataaatttttgttgtttaaggtacccagtttatgtgttattttagcccaagctaactgatatgtacctttaaacaaatttgtaaatatttttccttaaaaaactgatttaaaaatatatcttagaatgaacattttttggaattgaggaaatacattatttgtccttataaaaattagcttatgttccttgatgttttcctcttcattttttcaaaagtattttttctacttgaaatattggttcttccattcagtgctgttggttttcatcaaaagtttagcagttttttttttttacttttatatctataaaatggaggactacattattcagtgtaagtttctgttgtcagtcttggtggttacttttccaacagacctgcatagacagactttacattagtaaatctataagggacaaaaattagtagaagtctcatttctcatcaggctgtgagagcagaggagtaccagcatacttgcagatgcccagctgaaagaagacatctatccatttatgctacaaagaatcctaagaatcaatgtagtaccttcacccttcttcagccacttgtctaatttcttgctattgccaatatgtctcttgtatttatcactaccttttacttcctctgccactctgtgagttctgttttatgttttcccgtgcatactacaatttgggtcataccatctacccatttgaattctttcagtgacttctcattattgctcttaaaaaaatcagaagttcttaacaatatgcaaagtcctgtgtggtataattctcattggacttcatttctatactgttccttttgctgtctttattgcagccatattagctgatatggtttggctctgtgttcctaaccaaatctcatcttgaattgtaatccccacacatcagaggaggggcctggtgggaggtgtttgaatcatgggggcaaacttccccctcattattcttacgatagtgagtgagtgctcatgagatctggttgcttaaaagtatgtagcactcccccctttgctctctttctctcttgctccatcattgtgaagatgtgcgtgcttccccttcaccttctgccatgactgtaagtttcctgaggcctctcagtcatgcttcctgttaagcctgtggaacagtcagtcaattaaacctattttatttataaattacgcattctcaggtagttctttatagcaacatgagaattgaataatacagaaaactggtcccaggaatgggacatttctgtaaagatacctgaaaatgtggaagtgactttggaactaggtaatgggcagaggttggaacagtttggagggctcagaaaaagacaggaagatgagagaaagtttggaacttcctagagacttgtgaaatagttttgaccaaaatgctgatagtgatatggacaatgaagtacaggctgaggtgctctcagatggagatgagaaacttattaggaactggactaaaagtcactcttgctatgctttagcaaagacactgctggcattttgctctggctctagggatctgtggaactttgaacttgagagggatgatttagggtatctggtgaaagaaatttctaaatatgacctggctgccgctaatagcatacagtcatatgcattcacaaagagatggtctaaaataggaacttatgtttaaaagggaaacagagcataaaagtttggaaaatttgcagcctgaccatgtggtagaaaagaaaaaacaattttctggggagaaattcaagccagctgcaaaaaatttcataagtaatgaggagccgaatgttaatagccaagacaatggggaagatgtttccagggcattacagagatcttcgtgacagtgcctcacatcacaggcccagaagcctacaagagaaaaatggtttcatggccaggccagggccccactgctctgtgcagtcttcagtcatgattgtaagtttcctgaggcctcccagtcatgctttttgttaagcatgcagaactgtgggtcaagtaaacctcttttctttataaattacccactctcagatagttttttatagccgtatgagaatggattaatgcactagcctacttgccaatttttggaccagccatgtgttctgccatcagtttttaacacattgtctcctttaacatccatgtgatttcatctttgcctttactcacctttacaatctcaggtaaaacattacttcctcagaaaatacttttttcaatgttatgaagaagtaaaattattttcttttgttctctcttaacccatgcatctcgatgtcagaagtatgtatggttatttgattaatgtctttcttccccacaaacattaaattttgtaaggacaggaactgtgtttggtttcactcacaattttatctgtggtatctagcacaaaacttttatatactaggtaatcattatatatttgataaaataacataaattaatatgtaaattaagcactttagtatatttcacctctgaattggattaacattaattttggtttcttttttgttttctctacttatcttttgatgatacttcaagtctcttgaattttgctcctcttgtttttgtggcctgatctttacaggatcttatagttcctctattatgaaatattgattcctaagttttcagcagcctacttttaaacatgtttggattacagattcttccactatgctttttactttcctaaatctaattttgggttagaaatttttctttacttgtagaattataaaggacaataatttatcctgtcgtgatcataataattctatgggttacagacaagaacctagtttagttctcataaactgaagaataagagcttcaaatggcagatattaaaagagtgggtatgcagttttgaagcatggatcatgccaggcatctgtactcatcaatgggggcactactactgggcaattagtgaaggcaaaagcggtatgagagcactgaaaagcgtggaagtaatgtaaacataaatgctccagattgcataaaaatatacaaggatgccaaagccaaaatctgcctgttgcacaatttaccccattgctagctaacagataggatatattatatttaacatattcttgaagcatagtggctcaagaaatgaacatgatgtaatcattagtaattttagcacttagtactaaataactggaaatcatcatgcttctattaacaatggcaaacttgatccaactgtataattaaaaatactactaggttatcaaaagtgtgtagttatgatagtgaggtccaacgaattaaccataagcaaaatgacttaaagccttatatctagtctgttaggaaaacactatttaatgttacctgtcatacctgacatgtattctttattttgtatttcatacactgtagtaagtgatagatacttttgacactcctgctgcccacattagtcttaacagctcagctgttgaagttgtcttatagcctaagcatccttaatttcaacatgttcattctccccatcttttttttttacaagtttaataaaacacatttttaattagcaatgcactaatgaataaatataaacagatctatggcccagtacacaaccatgatgaagcctataaggttgaatataaaaatgtgaatcttcatatagaagacaaatactatgaattaaatatatatcaagtactcactgcaaataacattatcaaaatttaagtaaaacaaagttatttctcaaaaaatgatttcagagatatcatttagtagttgattttcatcaatgttaattatttctttagttgggagaaagttatttttaaaacttgtgaacatagagaataactgtaggttattgagtaaggagccattagccaataactaccactactcaatacatgaagtaaattgcaccaataacagaataaattgatgtcagggtatttttggtttgtataacatgcacaaaacataaagttggaatgtttgtgttaaagtcttgattctgtgactatttagccaagcgatttggagaaatgaactttctcttttttgggggggggtctcaataactttaaacatttgttttcagttttcttaaggtataattgacaaataagattgtttctatttaaagtgtacaatgtgaaaatgtgatatacatataaaaataagtcaaaatcatagaaacagagatgagaatggtggttgcaaagggtgaaggtagggaaaatgaggaaatgtttgtcaaaaattacaaactattagttataagatgaataagttctgaagatagaataaactttgtctctattaaccttaattatcctatttgtctaataaaacagataccattctcaaaaggtttttgtgagagagaatttaattcaagaacaagtaattagtgtttgaaaactacaaggcaataagctattttcccattttactttctattctttcagaaaatatttccattttcattctttaagcatttagacttacaggtttcaagcatggaaatttatccaaagtgactatgatattatttgtaactgtggctgctcttcagaataataaactccatgcatttttttattttattgattttaacttattttattgaaatgattgttaatgtttactttttaaattcatttcttataattatttttatttataagttacataataatgggacatatttatggaatatagtgtaatattttaatgcacatacacattgtataatgatcaaactggggtaattaccatattcatcatgttaaacttttatcatttctttgtggtgacaacattcaaaactctttcttttagctatcttgaaatatatactacattactatttgctatagttacctgtgtaataaaacagcaaacaccagaacttatttttcctgtcttactgtaactttgtgtccatccattgaccaacctcttcccattcctgcttgtccaagtttctccagcctctggtaaccactattcaattatctacttctatgaaataaactttttagattccacacataagtgagaccatgcagtgtttgtctttctgctactggcttatttcacttcacatactgtcctccagattcatccatgttgccgcaaatgacagaatttcattcagttttatagatgaatagtattccattgtgagatatatataaaatatattatatatattatatataatatataatatagtataatatataatatatattatataatacaatatataatatatattataattatatatattttaattatatatacttttaattaataatatataatatatgtatatataaaatatatattatatataaatatacataatatataatatatattaatgtatatattttaattaattatatatataatatatttatatatgaataaataatatataatatatatacgatatataatgtatattatatagtatgaaatatatataatacaaaatataatatattatataatataaaatataatatattatataatataaaatataatatattatataatataaaatataatatattatataatatgatatataatatattatataatatgatatattatttattattaatataaaatatatattattaatataaaatatattatatatttatatattatatataattaatatatattatatatattatatatcataaaatatataataataatgtatatataatatatataatatataatatatataatatataatatatataatatataatatattatatttaatataataatatattttatatatataacattttctttatccatttatctgtagatgggcatttaggtcaattccatatcttagctatggtgaatagtactccaataaacatgggagcacagatgtctctctgacttactgattttatttcctttgggtatgcatgcaaccagagctattaagcaagataaagatataaaagggcatcatatgggaaaagataaagtcaaattgtccctatttagaaacgatatgattatatatattgagaaccctaaagactccaccaaaaacctgttaaaactaataaatatatttagtaaagttgaaagatacgaaatcaacacagaagtaccagtagcatttttatgttccaagagcaaactatctgaaaaacagatcaaaaaagcaatctcatttccaacagctacaaaaaaatgcctaaaaataaacttaactaaggaggtaaaatatctctataaaaaaactgtacatcattgatgaaagaaattgaaaaagacacaagtaaatggtaaaaatgttccatactcatgaattggaataattaatatttttaagatgtctgtatttccaaaagcaagctaagattcaatgcaatccctatgaaaatatcaatgacattctccacagaaatagggaacacaattctaaaattcatatggaaatgtgaaagaccccatatagccaaagcaatcttaaacacaaagaaaaaagctggtggcatcacattacctatttttaatgtatactataaagctatagtaaccaaaacaccatgataatggcataaaaacagacatatagaccaatggaggagaaaatagaaaccagaaaaaaatccacacacttacaactaactgatttttgacaaagggaacaagaatacacactggagatttttaaaaagtcactaccaaaaaatggtgctaaagaaaatggatatccatatgcatgagaatgcaactagatccctaggtctcaccagatacaaaaaacaactgtaaatggatcaaggacttatatgtgacacctgaaactctgaatgtcagacgaaaacataacagagacacttaatcaaattgaacttggtataaaggtttaaaataagaccccaaagcacatacaacaaaaacgaaagtagtgcaatggaattacatcaaactaaaaagcttctacacagctaaggaaacaatcaatacagtgaagagacaaacttcagtgagaaaaagtattggcagactatgcatctggcaaggggataatatccaaaatatataaggagcccaaacaactcaataggaaaaatataatcccatttttaaaatgggcaaaagagcctaattcctctaatgatgatgtaaaaatggctaacatatatatttaaaaatgttcaacatcactaatcgtcaaacacaaatccaaaccatagtaagttagaatgactgttactgaaaaaaacaaaaaatgctagcaagcatgaggagacgagggaactcatacgctgttggtggaaatgtaaatgtctacagacataatggaaaaaaattatagcgtctcctcaaaaagttaaaaatagagctcccatttgaaataattttagacattcaggaaagttgccaagatagtacatgaagtccccgtatacttttcatccaactccctctaacattagcatcttacatatccacagtacaattatcaaaataaagaaatttgcaaaatactattaaggaaatgtcagattggattcaggtatcaccagttttcccccaaattttctgtttgtttgtttgttgttttctgttacagggtccaatccaggatcctgtattgctttctgtggtaatatattcttaatctcctgcaatctgtgatagattttcaggtttctgctgtctttcatgatcttgatgtttttaagagcactggtcagttgtgttgtagaatgtcctttaatttgagtttgcctgatattttcatgtgattagattgacgtcattcattatggggaaaataccaaagaggtcttgtgcccttctcagtatatcatacattataccaatatgtcttattactagtaatgttaaccttagttaaaatagtgtcagccaaagttatccactgaaaagtttctactttccaatgtgtaattaataaatagtttggggcagataatttgagtgtatgccaaaattattctatctaaacttttgcctattaattttagcatttatcagtggatctttcatgcagcaattattactctagtgtactaatggtgattttattttttctttccttctacatttaattaattgatattcttccgtaagagttttcatactttctccatttatcaactatttattcaataaatatatcagcgtgaatcataaatacatatttcattatttgggttatattttattgacgttattatttactgtgttgatcagattgttccaggttctgcccttgggtgatcttttgagtaggctcctatgtcattttgacatgcccccatctgttttatgccctaacactttcttactttctggcaccacagggtgtcccatgtttaccttgtatttcccataccccagtcctgtgaataaacagttctccagagagtgctgttttcctttactggagaatggcatttagaagctagaagctgagtgctaggtgtgctcattgttactagggtattcacaggttataggctctcttagcaagcagaactaatgtgtatactaagccaagtatgcatacatatttatactaatttctatatttatattttaaaaatatgatttgatactgatatatccatcttaaatttcagcacaccagagtttcttctatctgccctcttgtttatttgtaattttcttctctaacagtgagaaacctggctctcattattttcagtgtacttacttacttcttcaaccttagttgaaccctaccagtgtacttacttgttaaaccctagtgtactttttttttttttttgatacaggtaaggagtttgagaattgcccatccctactcctatgagacacaaatttacctactatagtagagtgtttgtgtgcagtttttcttgtctttaatcttacagtatcagggcaaaatgttgttccaaagtgatttagttcatttttttactccttattcccttcagtaggataatgccacaaatgtttattatggttagatttatttgaaatagtctgcatttatcttgagttatgctgatatcctaatttaggtgtttaaaattgcatttagcaaaatttattatctgtaaggtacagttatatggaatctaacaaatgcatagagccatacttccatggtaccaagcagaacagtttcatcactcaaaaattcctcattaactgcttctttgtagtcaatttctcttccccattgatatctggcaaacagtgtcctgttccatatccttatattttgccttttttaagaatgccatataagtagaatgatacaacgtgtatcatttatgtttttttttttgcttagaaaaatgcatttaagattcatttatgttcaatgaatccatggtttatttcttttcacaacatactacttagcaaattagtatgtatgatggtttgcttattcattcatctgttttttcaaaaaagagttgtttcctgttcttttttttttttactattgttaatgaaactgctgtgaacattagcatacaggtttttagtgtgagcatagttttcagtttacctggttaacacttaagagtgggattgctgtgactcctggtaactttctaagagattgacaaactatttctccaagtggttgtaccatttttgtactactaccagcaaggaagagttccagttattcccatcctcccttggtattaccagtttttatctgtctcaatagacatttagtgctatcttactccagttttactttgcatttcctcagtaactaataatgttgaacatattttcctatatttatttgccactcatatgctttccttgataaaacatctatttaaatattttcaaattgggttgtttcctttcttgtagagttataagagttgttcacatattctggatacaagttctttttcagaaatgagatttgcaaatacttctacaagtcagtgttttagatttttattcttctaatagtgtctttccagaaaaaaattttaattttgatgaaattcaatttgtctgttttgtaatgaattgaacttttgctgtcatgtctaaaagttatttgctaaaacaaggtcatggaaattttctcccatgttttcttctagaaagtttgtaagttcatgttttatatttatgtctgtgatacattttgaatatgttttatatacaatatagtatctggcatgtgtttagcttcattattttgtgtatggacatccaagtaatggtcccactaccacctgtcgaaaagattaaccattctccattgaattctctttgcaattgctttcatcaaaagtaacttgtttatatttgtgtgaatctacttctgaaagctttatgctgctgttagtctcttccatatttctatccttttgcccatagcagattttcatgattattgtagttttagagaaaaaacttgcaatcaggtatgcaagtcctctaactctgctccttttcaaaattgttttggctcttctaatttctttacctttccatacacattttagaatcaggtttttgatatgcacaaaaacatgctgggattttgattttgattgcattgaatttagcaatatatcatggagaagtgacatattaattatattgagtcttacatttatgcatctgaaataggtgcacaataattttggtttttaatgatttccttcatcagtgttttgtggttcccagcaaacagatcatgcacacattttgctacatttgtatcccagtattttaattttcatgctattgcaaatggcattcttatttaaagttgattacaagtacatataatttaacatttattttctgtattgatagtgcattctgaaaagactgaactctgtagttctaggaacatctttgctgattcttgggaattttctatgaagacaattatgtcatctgtgaatacagtttacttccttcctttcccattggtgtgccttgtattactttttgttgcctatttcactggcaaaaatatcgagtatgtattgaataggagtaataagatagaagaaactttcctatttcctgccataagagtacaacattctgtctttcaacagtaagtatgaagttagctgtaggctttgagtagtttgtagatacctcttatcatgttaaaaaaaagttctcttctatcctagcttttgagtttttttttccaattattataaatggatgttaaatttatgctttctctgcatctaatgagatgatcacattattttcttcaattcgttaacctagtaaatgatattaattttcaaatgttgaaccaacttctcatcctttagatgaatctgacttagtctgatattttatcctattatatattgctgaatttaatttactaatatattgctgaggattttctgtctagtttgagatattgatttttagttttctattcttgtattgtctttgtctgtacccagtactatgatcaccttctaaaattagttgagaagtattcccttttcctgtgagagattatctggtacttgtttggtagaatttgaaagtgaaactacatggacctggacttttgtttgtggaatattttcaaccagattcaatttcatatgtatattcatagtttttttcttgagtgagattttggtagtttgtttttcaaggaattaatcaatttaatttaaattgtcaaatttaaggtcatagagtagtgttcccttaatattttataaattaatggttagtagtgaagtcttttcttacatacctgacattggtaatatgtatctacttattttttcttgctcattctgattagaggtttatgagttttattaatcgtttcaaagggctacatttgacttcattggttttctgtttttgtgtttttaatttcattgtttattttgttgcttatttttcttattttctttcttctatttccttttatgtaattgactctttttttttctagtttcttacggtggaagtttagaaatctgattttatgtctttccacttttctaatgtaagcattttatcttgtaaatttccctttaaggattgctttaaatgtaccctgaaaatttgatatattgtattttcattttaattcagtccaaaatatttatttaactttgctcttgaaacttccattttgacacctgtgttatttggaagaatgttttcttaaattcgaaataattgtaaattttcctgatatctttatactatttatttctgtaaagttgtgttatgattcaaaattatacatttaaggacttgtgaaggactcattttctttttttttcttctttttatttatttatttattattatactttaagttttagggtacatgtgcacattgtgcaggttagttacatacgtatacatgtgccatgctggtgtgctgcacccactaactcgtcatctagcattaggtatatctcccaatgctatccctcccccctccccccaccccacaacagtccccagagtgtgatgttccttttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccaaatcatgagtgaactcccattcacaattgcttcaaagagaataaaatacctaggaatccaacttacatgggatgtgaaggacctcttcaaggagaactacaaaccgctgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtcctggtaccaaaacagagatatagatcaatggaacagaacagagccctcagaaataacactgcatatctacaactatctgatctttcacaaacctgagaaaaacaagcaatgggtgctgtttttaataaatttaataagtggtgctgggaaaactggctagccatatgtagaaagctgaaactggatcccttccttacaccttatacaaaaatcaattcaagatggattaaagacttaaaacgttagacctaaaaccataaaaaccctagaagaaaacctaggcattaccattcaggacctaggcatgggcaaggacttcatgtctaaaacaccaaaagcaatggcaacaaaagccaacattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatctcattttcttaaattataaattttatcacttatgttataaattttctgatgataaaacattttttcaagaaaatgtgagtccttaaatgtataattttggatcataacagaactataaagaaatcaatagtatgaagataccaggaaaattgacaatcattttgaatttaagaaaatattcttccaaataacacatctgtcaaaatggaaatttcaaggccaagttaaacaaatattttgaattgaattaaaatgaaaatgcaatatatcaaatatttatttataattttataaaggtaaaataatttttacctttatcttggtgaccgtttcctgtccactaaagaagaatgttattctgctcttgttgcatggatggatttctaaatatctactaggtaaagttggtggatagtgttgttgttcaagtcatctgtattcttactgattttctgccttcttttctgtcagtttttgaggaaggagcattaaactgtcaactctattcgtgaatttgtttgtttcacctttgagttcaattaacctttgacctatgtgttttgaagctcttttgttagctggacaaacattcaggattattatgtttactttgagaattgtccctttattataatataatgttcctctttattccagcaaatatttattcctgttaagtctaacttacctgatgttaacacagctattttatctttctgttagtgtttatgatatctttgtttatcatttaacttacttataactttttatgtctttctctttgttgtagagagcatattgttgagtcatggttattgtattaaatttgacattttacgtcttttaactcatggtcttagagcattcacatttatagtgattgagattgttaaatttcaccagtttaggttttcctatatattccatgtgtttattgtttttttattttcctgtctcaggttaattgataattagtaggattacattttatctctctattaattaactatacctcctcttacaattctattcacgattgcaatgcagattactttcaattactcagtctacatccaaataatattttaacacttcctgtataataaaagaatcttaaaacattatatttcccaatcttctttcccaacctgaatactattaatattatacttctattttcacacacacacacacacacacacacacacacacacacacaaacataatacattgctactgtttttgctttaggcagttacattttagagcagttaaagttagaaaaatattattttaccattattttttccatttccagttcactttatttctttttgtacaatgaaatttcggtatggtatcttttctgcctgaagaatttctattaacattttttatagagtaaatctactgcaaatatattccccaaatttttgttggtttgatctttatacctgtatgtaatgtttgtttgctcctgtatgtgatatttcttttttgtctggctgctttagcaattgtctctacagtttttaagcagtttgagtatgatatgactagcgatgtgtgtgtgggtgtgtgtgtgtgtgtgtgtgtgtgttgctatttatactgcttggtattttatgaatttcttggatatgtggtttggtgttcgtcatttacaaacctatcacccattacataattcttcaaatgcttcttttgtttctttttctctatctctctctctctttctggaccctccttctaggaccccagttgcccttatattagacatttgtttattgtttcacagttattggataatctggctttcatttttttaatattttctcctctgagtttcagtgttgattacttctatagatgtatactcaagttcactaattctttccttagcgagtattgagcttactaatgcatttctagaaatcgttgttttctaattgtttaatttttttatttttatttttattattaagggtacataatatttatacatatttattgggtacgtaattagggtatccatcacttaaagcctttatcattcctttgtcttcagaacattccaattccactcttagttattttaaaatatacaacaaattattaactatagtgcccttattgtgctaccaagtgttggatcttatttattatatcttactgtatttctgtacccattaaccatcccaattttatccccccatccctgccacccttcccaacctctagcagccatcattccaccctctatctttatgaattcagtttctttaagctcctacctatgagtgagaacatactatacaacctttttatttctgtgcctggcttatttcccttaacataatgtccaccagttccatctattttgttgtaaatgacaggattttatttcatttttatggctgaataatattccattgtgtgtatgtaccacgtgttccttacccattcatctgctgatggaaacttatgttgcttccatatctcagctgttgtgaatagtgctgcaagaagcatgagagtgcagatgtcacttttataaaatggctttctttcttttgaatatatatccagtagtggaactgctagatcccttggtagttctagctttaggtttttgagaaacctccatatagttttccacagtggctgtactaattcacattcccctcatcagcataagagggttctctttactctacattctccctagcatctgttattcccagtcttttcaataaaagccattttaatttgggtgaggtaatatcacattgtagtttcaatttgtctttctctgatgaatagtgatgttgagcattttatagacctgttgaccatttgtatatcttcttttgagaaatgtttattgagatatttgcacattttaaataagattatttgctttttattaagttgcctgagttcattttatattctggttactaatcccttatcagatgtgtagtgtgcaaatgttttcttccattctgtggtttatctcttcacattgtttattgtttactttgctattcagaagctttttagcttgatgtgaaataaaattattctttatcaaagtctttttaaataatatttccatttgattgtttagtgatagcctacatttataataagagtttgtttggcagtggattttgttttccaatgtcagctctacccttagccttaagtctttcctttgcattgttctctgttgttttgagtatccctcagttttaggctggtactttgtccttagaactcatggagaccactgtcagtgctgtttctcttcttgcatagttctgaacatagaatttatttctgtcccactttaatgcccaactgacctgccccttcctacagctgtaatcagattttacaagtactctaaatatgacagtgttcgttgtccctcctaccacaaatttaagttattgtttgatggagtaaataaggaagaggagaccagatgaagttttttgcccatcctactgtatctactgttcccatccttcatttatgaatatgagggagactttctcaagacttctccaagctctctgtgatcacaaagtgggatcttagaagaaaaagcaagaaagaggatgtagacgtcctatgtacatgcaaccaccagggacttaaccctctatcacgaatatgcagtttactgaccttcaccaatttgccaatcaccctagctgaactcctcttattgatgtccagttgcatcttacccatacaatccagggctcaagtttcaatcctcccagtaagtgtctgtctctcccaagattctagtcattttctcattttgagatgtcagtactatgatgggttctagaaaagttatgaacttgctcttggtccagcactttttagagttgtaagatctggagaaatgctctttccaactttcttcatttccaagtaaaaccagaattgtcattctaatcatttttattcttacatttcaaaacatcaagatttgaaagttcaatcagatgtgattaggcttatccttatgctcaaatacttcttcttgtttctcagggagcagctatcaataagacttatatatatgttttctctgtgaatgtcaccatcgattcagacagcagcaacctcaaaaacaaaacaatattttcatttccatgtaagtgcccatattcccaaatttatttatgtttcaacatttaaaaaagaaaatatgccatatgtatattgtgtatcctaaaatatattttttcaatttttatctcaattatgaccatattggaaattgaatataaatgcaaataaggttactacagtctcaaatgttagtttgataaaggttgcttataatgtcataattttagtgctgtctacaaaacaaaacaaaaacccagttttatttcttcatgttactagcaagtgtgtgcatcctgatttcttgattttgttaataaatctacagaaaaaaatagaggctgtaaaatcagacaattactagttgtgcagtcttaggcaactactttaagtattctcttccttagttgttatattacttacagtagttccaacttagcatgggttgcagtaacaggtaaatggttatgctcaaaataacatggaatcaagcttttcttttcttagcagtgcaccaagaacactgtcgagttacacagataccaagttctcaattcaatagatgtgttttgaagctggctcatactggctcatgagatctgatttttaaactttcagaaattttgcaagttggtttttacatcattcgtagcttgaaattgtcttcacagtggcattatttatattagaaaatgctacaaattagagctccttttccactgttagagagctgctttaccaggatatcactgcatatgcctgggcaactcaatcatatgacacccagaaggcctcagatggattaaaaattctgaactctgcatgtaacagcttatttatgatcagaaaatggatcagttggttaatgagtaaaaaaaatcataggtcattagtccatgtaattcacagaataatagcaatgtatgtagatgtatgacaagataatgcagtatggatttttattctctgatgttactaagcaactccaggaaaacaaacatttacaagtaataaaagaagcattgaacaattgaccaaactaccttatttatgtaaattaactaaaaacctgagatgtgcaaaataagggagcaattaaaaatgtagaataatatgaaatgttagttgtttaacttttctgtcagagataatttaacggttttaattcttaagaattttattaaatttcagggaaataacaacattgtctctctcttaaaagaaagaaagaagtgttgctgtgatgtaaatttaacaccatgctcattataaaaattttggaacagaaagagaagcagaaagaaaataaatcattcagtcttcacccacaaagacaaccactgtgactatttcaaattgtttccttccaaattttgctctaggtttcgtctttctttttaaacttttatttctttttatgcattatatttgtgtttaatatacttatggtcatatgacatatttcataacacacttatgtaagacatatgcccttatgtatgatagttttagattcattcacattataaatgtagattattagtgcagaaaacaaagaaaagtacattaaatagaagtatatttaaaaagaaaaaatacaacttaaattatgtcaattacattacaaagattttgggataatgcaccaaaacgttaatagtgtttatatttgggtggcgattatttttatctttaaaaaatgcatatcataaaaatgcattaacataattaagactaaatcgtacatacaaatatttaagtatggtaaacatgaacatttacaagtatttgataaaaaaattgtaagaagaggtttgttacaaataggaaattatttgctttgtttaattaaataaaacatcatgtaatgtaatttataaaatgccaaaaacacaactatttttaattgatacattatattttacatatttatggagtacatgtgatattttgctccatgcacagaatgtgtaatgatcaattcagagtatttagggtatccattacctcgagtgtttatcatttctatgtgttgagaacatttcaagtcttctcttctagctattttgaaatatacaatacatcgttgttaactacaggcaccctactctgctatgaaatattggaacttatttcttctgtctgactataagttgcccattaatctctcttccccactgcccccaccaccacacacacaccttccctagcctctggtatttatcactctattctctacctccattggatcaaagtttttagctccggtgagtgataatataaaacacttaactttctgtgtctggcttattttacttaacatactgacctccagttacatccatgttgctactaatgacagaatttcattttttatggccatatagtactttattgtctatatataccacattttatttatctattcatcctttgatggacacttaggtttcatgtctttactactgtaaatagtgtggcaataattatgtaggtataggtatcccttttatatactgattttcttttctttagataaacacccattattggggttgctgtagagtacggtagttctatttctagctttttgagaaatctgcatactgtttttcattgtggctgtactaatttaaattcccacgaatagtatatatgatgctccttttctcttcatctttaccaatgtctcttaatttttgtctatgtagtaatagccattctaactggggtaagataatatctcattgtggttttaatttgtatttgattagtcaggctgagcattttttcaatatacttgttggccatttgtatatttttgagaaattttgatttatgcactgtcttcactttttaatgggattattagtttattaacttttgggttatttgagattcttgcatattctggatattagtcactagttagatcaatagtatataaatattttctccctttcaaaagattttctctttaatttattgattgtttccttggctgtatagaagctttttagtttaatatacttccatttttttaatttcgcttttgtttcttgtgcttttcagtcgttagccataaaatatttgccttgacaaaattcctaaagtgattttcctatgttttcttttactagtttaatagttttaagtcttacatttaagtttttaatccatcttgagttgatgtttgcatatagtaagagatagcagtccagtttcgtttttctgcatatggacatacactttttcagcataatttattgaatagggtgtcttttcttcaatgtatgattgtggtacttttgtcaaaaatcagttggcggtaaatatgtagatttctttctgagttatttattctgttccattgacttatgtatctgtatttatagtaataccatgttgctttggtgaaatggttactgtattgttacgcaattttgctcttgtgttgtactaaaaattttttaatttttttaacaaagtgcattcaaagtgtagtaatcattgttaacaaatattagagcagagtactacttattgctttcaaatttcaaagcatgtgaagagattctaaatgtgtttggatgaatattttagttaaaataactcacattccaagaaaatacaaaatcaatttagactacagatgaatcctacaaattttaaatgtccatgccaaatttaaagcaaaagttactccactcttttcgcaattttgtggccatctaaacattatgctgcacattctagttttcttggtcaccttctgtggtaggcagaattgtaagatggccctaaaaattctcagcatctggcatacacacatcttctccttgttgttcagtaaaacactaatctaagtactattgtgaagagattttgtagatgttattaagaacacaaatcagttgattttaagatagggagattatccaagtgggcctaacctaataacatcagcaccttaaagacggagtgttctacagctagtgatgggaaagcaagactccagttgatgacaaaagaggatgcactcttgtcttctgggagtaaagcaaacatccattttgctacctgcttatgaaggccacatgacaaggaaccataagtgtgctatagaagcctagagtagtccctactgacagctagaaagaaaacagatcctcagtccttgtaccacaaagaacagaattctgccaatagtgagcttgagagaggactctgagtcaagataagaactgcagccccagctgatactttggttttagcctggtgagaccttaagaagaaaatccacccattccaaaacctcaggcctacagaaattaagataaaagacgtatgtagttttaagctgctaagttcgtggtatttttttacacagcaataaataactagtacacactctaaaatgtaaggcattctagctatttatcctctcacatatccttctctcttgctccatgatttcatatcctgatcaagattcataatccttccttcccttccagaactttacactgtgtaaagttgatagtcatctctgttttaaatatattcactgattgctttttctgtatctttaccttgactgaaaccggctcttctccatgggcaagttttgcctataaccttttcaaagcgagggtattcattctatcatacactacgaacctcagggtcagttgagaataatggtaataatagagaacatttgctgaatattcgtgtggcaggtactgtgtgccacaaatgggtgcctttacacacatcctttgctttacaaaacaaaaaaattatgcgtaaggatgtgtgccagcaaatgatacctacttcatagcactctctccttccttctttatgaactgaacttcaatgttgttcgaagaactaacttcccaactaggaactgcatttcccagcccaccttgcagatagatagctatgtaacagagttctggtcaatgagatgtaaaaaaaagaaaaaatggtttggacttcctggacagctctttagaaacaaaaagaattcagttggcacgaagttttgctgtttgttctttcttgccagcttaagcctagttgcgttgccttttgggcaggaggtttggaaggaaagagtcacctggcaactctgaagactagattcactttaaaagataggtggtgaaccccaaaaacagatggagattgagaacaccaccgccagagtcacaagaacagcaatagggaactggtgctcaaccaatagaaaccgtgtccatcggctgggcatggtagcttaacgcttgaaatcccaacacttttaggaggccaaggctagtgaattgcttgagcccaggagtttgagatcagcctgggcaacatagcaaaaccacatctttacaagaaaaaaaaatagctggacatgatggcatgtgcctgtcttttcagctatttgggaagctgaggcaggaggattgcttgagcccaggaggtggaggttgcagtgagccgagattgtgccactgcactatagccttggccacagagtgagaacctgtctcaaaagaacaacaacaacaacaaaatacactcctgatccagtcacctttcaccaggttccatctccagcactagaggctacatttcaacaagagagttgggtgcgaacacagatccaaaccttatcagcaggccgccatcttttatcgccctgtagcactcgccactgttgccctgagactccagcctcccaaagagctgaaacgacaggcacatgccatcatgtccagctatttttttttcttgtaaatatgaggttttgctatgttgcccaggctgatctcaaactcctgtgtagatcccaagtactgtgtagctattcaacagaaagctgaccagactgttttccatgaagatttctgttcctgcttctccccactgagcagggcctcccaacatgggactccagctcaactaccctgcccctgcctgaacacttcagttggaagtggctttgcatttctctgaggaggaaatcttagaaacaaaccacaggccagcagccattgcagctgcagtggtaccatcctaattgtccttgggctagggaaaaaaacaaaggacctggttgctgtgctggcacctccagcacactgcagccaccatacagagaggagtccagtctcttttccctgtaactcttcatcccccaatcttcacaaagcgaggcccctggctcgtaatgttggaacagctgccccacccctacttgagcatacccactggtagtggctcccggaggcaactgaaagcccctctgccattgccagagcagtggatctatccctgctgccctcagtctgggagagaaacaaagagcttggaggcgtcacacacacttctagcacaccacagtcaccatatagagaggtgcccagtctttcctggctgtgagccctgaactccctgctcttcaccagacagagccccaaacctgagccagagagtgcagtaccccatactatggctgaacattcccattagcagtggatccgcatttctttgaggtggagctcccagaggcaaccaaaaatctctctgccactgctcttccaattgttctacccttgccgcccttgaactgtggaaggagcaaagaccctgagtgctttaaccacacctctagcaagctgcagttgccctaaggaaaacaggccagtctgtctccctcatcatctccttgccctccctgctcaccaccaggtagggcccctgtggcttgggcacacaacagaaccaccctagtctgagataattgcactgattgatagtggctctgcatctctttggggtggagccccaagtgacaagtaaaaggccctttgccacaaccactgccatgatctcttcctctgctgcccccaagctgtggagggagcataaagcctgagctcaccccagagctgtggtgtgcagcctatgagtgccaagccaagatctatagctagtactagagcgggagaggagcccacattttcagaccactgagagggtgcctgattgcaatgttgaggaaatacagaggagtcatgtggctgagcaaaagcttacctactgaccataacacttaaatgccatctactggataatagcccaaacttcaacaccaaaaaatactttgctagcatactcccttgtggaaccaagaacaagaactcatctacaaataaagaccttacacaaagcctcagatctctgaaaacattcagaaaagaagtctactgactgtactcaaattacattaaagttaaaggaacatcagcccacacagatgagaaaacaccaacagaagaactctggcagctcaaaagctagagtgtcttctttcttccaaatgactgtatgacttctccagaaagcattcttaactgagctgaaatggctgaaataaaacataaatcaaatttatgatatggataggaatgaaatctctgaggttcagcacaaagtcaaaacccaatccaaggaatctaagaattacaataaaacaatacaggagacgatagacaacatgcccattaggagaaagaatcacgctcctctgatagaactaaacaacacactacaagaatttcataatgcaatcattaagtattaacagcagaatagaaccagctgaggaataaatctcagacgtccaatactgactctcttaactcactcagaccaaaaaattgaaaaagcataaaaataataactgggagaaaacaagcaacttggaaaacatatttcaggataccattcataaaaatgtccttaacctcactagagattctaacattcaaattccagaaatgcataaccccagtgagatactacacaggaagaccttccccaagacacacaattatcagattcttcaatgtggaaatgaaacaaaaaatgttaaaggcagatagaaggagcagatcacctacaacggggaccccatcaggctaacagtggaccatccagcagaaaccctacaggccagaagagattgagggcctatattcagtattcttttctgtctttctttcttttttgtttttgaaacagagtctcgctttgtcacccaggctggagtgcagtggtgcaatcttgggtcactgcaacctctgcctcccgagtagctgggactacaggtatgtgccaccaggcccagctaattttttttgtatttttagtagagatggagtttcgccatgttggccaggctggtctcgatcacctgatttcaggtgatctgtccgccttggcctcccaaagtgctgggattacaggtctgagccactacacctggcctcagcattcttaaagaaaataattttcaaccaagattttcatatccggcagaactaagcttcataagtgaacaagaaataaggtcttttcagacaagcaagtgctgagggaatttgttaccaccagacctaccttgcaagaggccctgaaggaaatgctaaatatggaaagtaaagacacttactaaccactactgaacatacttaagtaagcagaccattgacattatgaaacaaccactcaaacaagtctgcataataaccagccaacagcatgatgacaggatcaaacctgcacatatgaatatcaaccttgaatacaaacagaatgattgtcccaattaaaaggctcagagtggcaagctgcataaagaagcaagactcaactgtcttcaaggaacccagatcacgtgctataacactcatagactcaaaataaagggacagaaaaagacctgccaagcaaatggaaaacagaaaaagcagggggtgctatccaaatttcaggcacaacagactttaagccaacacagatcaaacaatacaaagaaaggcattacataatagtaaaaggttcaattaaactatcctaaatatatatgcacccaacacaggagcacccagagtcataaaacaggttcctagagacctaagaggagactttgataaccacacaataagaatgggagacttaaatactccactgacaatattagacagattattgaggcagaaaagaacaaagagagtcaggatctgaagtcagcactgtatcaaacgggcttgatagatatctacagaactctctaccccaagacaacaaaatatacattctttttatcaccacatggcacagactctaaagtcaacctacaattcaaactatactataaggatacagtaacccaaacagcatggtattggtacaaaaacagacacatagaccaattgaaaagaatagagggcccagaaataattccaggcacccacaaccctctaatcttcaacaaagtctacaaaaataagcaatgggggaatgactagctactcaaaaataatgctggtataactggctagccatatacagaagattgaacctagactccttctttacaccatattcaaaaatgaattcaagattaaatgtaaaacctgaaactataaaaatcctggaagataacctaggaaatatcattgtggacataggccttggtaaaaattttacgatgaagatgccaaaagcaattgcaacaaaaacaaaacgcgacaagtgtcaactaattaaagagcttctgcacagccaaagtaatgtcaacagagtaaatagacaacctacagaatgggagaaaacatttgcaaagtatgcatccaacaaaggtctaatattcagaaattttcaggaacttaagcaaatttataattaaaaacccaacagccccattaaaaagtagacaaagcgcattaacagacacttttcaaaagaagacatacatgcagcccacaagcatatgaaaaaatgcacaaaatcactgatcattagagaaatgcaaatcaaaaccataaggatataccagcccatataataagaatggctattatttaaaagtcaaaaattacagatgctggcaaggttgtggagaaaaaggaatgcctatacacagcaagtagtaatttaaattagttcagccattgtgaaaagcagtgtggtaattccacaaagaaattaaaacagaattactgtgtgactctgtaatcccatcactgagtatgtaccgaaaggaatataagtcattttcccataaaaactcatgcatgtgtatgttcattgcagcagtattcacaatagcaaagacaagaaatccacctacatgttaatcaatgatagactagataaagaaaatatggtacatatacacaatggaatactacacagtcataaaaacatgagattatgtctttttcagccgcatgaatggaactgaagactattatcctaagcaaactaatgcaggaagagaaaaccaaatattgcacgctcttacttataaatgagagctaaacaatgagtaaacatggacacaaaggggaaaaacagacattggggctgacttgaaggcagaggatgggaggaggcagaagttcaaaaaactacctatcagagtgactatagttaaaaataattgtacattttaaaatacttaaagagtgtaattggattgtttgtaactcaaacgataaatgtttgagaggatggatgtataaaaaataacctatctgttgagtactatgcttattacctgtgtgacgaaacaatctatgcaccaaaccccacaacacgcactttatctgtataacaaaccatcacatgtacctctgaacctaaaataaaagttatagaaaagatgaataacaaactaaacactaatcgggctatgtttctttaaattaggttttgcattacatatagctagtcctattttaacctaatattgtatactttacattaattaaataaatacaacaacagggtaaggtgagtaaaattattatccccattttagaaacgaagaaacagaggcacagtgaatatatgtaaattttccaaggttacacaggtatggagggagccaccatttgatcctaggcaatttggcattagattcgacattcttaactccaatgctgtactgtccagttccatcttaacacttccaaatctatagttttccaccaacacataaaatttctactcttttgaggtttatgccataaggctggctgtattaaccaacaaataaccactttactgtcatatacacagcttctgataatttatccacaattattgaagcctttgcttttttttttttttttttttttttttttttgagatggagtctggctctgtcacctaggctggagtgcagtggctcgatcttggctcactgcaacctccacctcctgggttcaagcagttctcctgcctcagcctcccaagtagctgggactacaggcacgtgccaccacgcccggttaatttttgtattttcagtagagatggggtttcgccatattggccaggctggtcttgaactcctgacctcaggtgatccacccacctcggcctcccaaaatactgggattacaggcgtgagccactgtgcctggccgccatgttttataatctttatctccaagccaggttttgcattgtttccttgaaatcttcatcttcaaacaacttcactacactattttagccatacactctccaaacccagtggatatactgtgcacctaaccggcttcattaatggcattgcttctgaaattttagactcagatgttctattgtgtcatcacaatgctctactcatatattttatcattcagtcactttcgttacacctgttcctttaatccaggtcactcaaatcctctacattcctcccatctgttgaccatccattctcttttattttcatattccatcaagattattttcaattcaactcctgaaatctcagtgcctacctccaggctgcttatcaggaatagagaagattgcataactatgaaggttagaaccattataaacccatagacaacaaacttatcttggactttcccttccttataatgactcattcaaagtattttgtttctccaaattccaaccttttaattaccttatggctttcaacacatacctttttatttgtttcagagagaaaattgaatatgcaaaacaagaatttccttaattttcttaaaccaaagctattgatgtgtaccattttgaaatggttcatgcaccatctcagctctttgccgtgctagaggaatttaactgtatccctaaaaatattctccacctacatgccctcacaagttttctcattctctgaggtaatggaattgtagtttaactccctgtgccctctttgaattttattaaagttgtattacactaaggaaatacacttccttgtttatagtataaatgtggggtcatcaccttattctactgtaatttttttcttttattgttggtttctttttgcaaaattcagaggttagatgttgaatgcacattcctatatttctgtcttctctaaatgtcccagctcttttaaacttttaattaggaaagcttttttttcatgattacaattgtgataaaacattcccatttttcttgtactgaatctcattctttttcttccatattaacattccactaatatcatatgtatttatttattattaaagactgaattcttgagcttctcaaattaagtctcaatatcattgatttaattttctacacaattataacttttaaggccttcaatacacatcttagtattcatttagttttcttaaattccttcttattttcatcttagtcagttgtctattcatcttagatttttctttccatttagctttctactcccttttcaggggccttgaatgtattttattttgatggagactgtaacattcttctactttttttctggttcttaaatttaagaagttatttacaaaactcattttttaccctttaagtccttagaaaagtaaatatttttttcataggtttcatgttgttttggtattgttgttatgctgttttcttctcaactcattcccaaataaaactactattatatagtcctaatactggacattacttggttgcacactcattttgcttaggagtaggaaaataccttttttagatctgtattaggaaataagttagatgtgcccaacttctcatgtaatttttagtcattcatctaggattgatatattgtactgaaaaaaaaatttctgcctccgttgactgggtctctgataccctaaaaattaactctaatcaaaaatactgtccccagtacacatctttcttctggcttttcttgtcattgtatcttttccacaccacacctccaacatgggttggcatatatcatctgagaatctaagatgcaagatgcctgattactttctccctttactaacagctcaattgttttacttcagtcaatgaattttgatggcagattcatgggaaacaaaaatgtggcttcttcaaagacagtatgcatcaaagttatggtgtgttattgatacagacctaatgtagctaacagaacgatttttctaaaatattgctttcaccatattgtaccctattcaaatacttacaagataaaaatctaattctcttggtttgacattcacaggtcacctgaataagaacaattcatatccatctcagcacttttacttgtactgctcctctcctttctctctgcctacccttgcattttcaagtcaagcaacaaagcctatcgttgttggaaggactctgtctttgaaaagcctaacacttaatttccacactctatgctttgtaatcagtaagctccaggaaagcgggtactgtgcataacttgttctttttttcttttgatgctgttttattttccaaagcctaaaaagccatgtcttacactcatttctatcttaaagacgtgccataatgttattcttatacggagttgtcaacaaatgcttgttaactatatggatagttattgatcgattgaatgaatgcctctgtcatagaatctgaagacttttcacattatgtatttatgagaagtaacctatacctaacctccttcttcattcacctataaagatagattaatatcgttagtcaagtggcattttttctataattaaaataacatttcagtaaagataaatttataattatatgctcctattggaattgataagtagtactttagtattggaaatgtgaaaacaaaagggaaaacgtttcaatttgtatgaagaaaatatgtatggtatattacatacttaagaaatatatctgaaaatttctcaagtaaaaggatcagttttgttgatgctttctattttagaatagttaaaaaaactgtaatatattttataaagtgtgctctgaagtgttgcccaaatctgatacttgctactaacagagtatgtgacctcaggcaagtcagagaacttctacaagttcagttttattatttataaagtgcatgtactggccaacctcacagggttttatgaggatcaattgaaataataaatgcaaaataactttgttaagtattgtttaaatatgagaggatattaacattcccaataaatggccaaaaagaaatctactcagtaaactacaatgaaaagatctgaaaagagatgtgagatcaaatgttatgtcatacctttttaaaatcttgaatggcaagagacaagaagtctattaatttagagttgccagataaaatacagtatgcccaattaaatttaaatatcagataaacaaaacgtatgtgtttcagtataagtaaattatacatatgggctcttgcctccaaagcatattaaagacactgctaaatatttgtcaattaggaatgtgattactatggaataataacaaactagttatcttttcctaccacttgttactgatgttgaagaaggaacataaaaggagattgaatataagttaaagattgaggaaataatatgtttttcagcttaagtgcagcaaatgttggtgttccattattttattttaatttgtgtgaattcatagaacatcaaacatatctatgttcaagtaggagaacataatcacttgtcaaagtttaatataagtgatttctccttcattccctcttttagattttccaatatggcatatgtaattgtaagtaatcactgcatgtctatggtggttttatagtaccttagaactaagaatggtcctgagagtacttgaattattctaaaagaactgatataatcctaataaacttagtgaaagaaagagaacaaacgattgataacaaatggacaaaacagactgacgttaaaaacaaagtcacaccaattaatttagtttatcaattataaattattgtgttagaataaaagacataaaaaacattagggcaatatgggggaaattttttgttcatgtgaaggtattaagtaaattttcaccttccattactgccatcttcttaactcataaatttcattttaaaattctttctgccaagccagccaatatcttgtctaaaatgatatgcttcttttcttatgtgcacttcctttatgagagttcatcttaaggcacagttttaaaagaaatatgtatttgacaaatctaaaagcttgactgtcaacttaaaattcacttctctcttcgaaagctaaaacatgaatgaaagaaagaagttaacatcccaaggtcttaattttctgtataaaatttataaattacttaaaggctaaagattctatgtgtctacaaggattattatttactttccaaatggattacaaaacccttggaaggttgttctctaggcctcatatatatattcaatccaggaagatagtgcaactttgagttaaccatgttaagtctatatacatctgcttctgtatcccacaggagaaaatttctaaaccactccatatagatttaatttcatgaatgatggtttcttccactatttattgtctccattcttactgcctataaattctttggtaagttaattaagatctcttagtctgcattcccacaagtaaaatgggacccccgaatgactcagtatctccatgacccaacttcatattccctcaggagaaaaggtcattgactctggtctaagcaatgtagtactaatttcttcagcatagtgccaggtaggtttgtggagaaagttatcaaacattcagaagatttgactcaaatatctcaatcttagtggcttctcaaagcatgccccagtgcacacatctttttcagatcgtccttgttcttctaagtggaatgttttcactaagtgcatttgtgtagggcactcttttaatgattgatgcatgaaataaaaatatttgattactatattaacattgtaatgaatacccccactttcacataaacaatattatgtaatatacatatatacaatagatatactgtacatatggaattgcaataaacattttctctttatgttctttaagaactgaaaatgtgaatattcagaaaaaccttgggagtagcccacagaaagattgaatatgttaagaatctaatctcatatgtccatgtgctattatagatgcattcacttactcatgcataaataaaagcagaattttctatgtgcagaacccactgcatttttttgagtttaagtaattgaaaaataaagtcaacatttcatacaaagcatctctttccaagagctgaatattatgtattttgaattgccttttatattttgttaaatcagtgattttaaatgaagataacctcataacttttattatccagttaaccacattgtaggctattaaaatcaaatatgtagatattcaaatgcacacaggatggcacatactttctctgtgcaggagacagatggcttttattaatattaaaagtgattaacatgtcaagtaaattagcaaactttcagcagcatttttatttctttagcttattattctattctctcttagaagtactgacctggagcaacttccttatcttcttgtctattctggagtagtgagcctttgtttacaagccaatacaaatggttctatttataaagtcaggtgtcaatcatttcaggtcacatacactttcctatactcaggaaagtttggccacctgagttttgtttgtttctaactaaagatgaatttaacatttataaacatacagtcaataccttcacacaatatattcatattattttgccccattctgtacctataatcaatcattccagtcacaaacataagaaaaaatcaccagtgactattaaagtttgaaatatttattctgtgtaagacactgtactaggcattttgggacctgcaaagataaagtaaatattttctaccttcttaaagacacacagatagtgtataactggtaggagtctggattcccaagagaaagaagagtttgcttctaataaagaaaattcttggcttaattgaatttttaaaataatgataagatatgtcaaaaatgcataaactagataatcagatataaagtatccaattttacatcacccatattaaacagatgttttactttttttgtttcgggtctatctgaagatatgtaagtcattacaggtggactaatgcccttttgtgttactgattccaaatcattcctttagaagtaatcatgaaacttaaggtgatgtgatcttcctgttcacatttttataattttctacataaatatgaattcataaacagtatatgtatattcatgattggtatatacaaccacaatatttacataactaatcatatttattttcataatttgatgttttactcaattttttttttttagatttgggggtaaaagtgtagttgtattacatggatatgttgcctagtagtgaattctgacctttcagtgtatgtcatctgaatattattcattgttccaaatggataatattttatctatcacttccaccaccaccgtcccatcttttggtgtctctaatgactattattccactctgttatgtccatgtgtactcattattcagctttcacttgtaagtgagaacatgcagttttgacatcctgtttctaagttatttcttttaagataatggcccccagttccaccgctgttgctgaaaaagacataatttcattattttttatagttgagtagtgttccatagtgtgtgtgtgtgtgtgtgtgtatacacacctgacatttttaatccagtcatctgttgatggatccttaggttgagtccatgactatgttattgtgaagagtgctataataaacatactaatgcagatgtctttttgatataatgtcttcttttccatgagtagatacccagtaattgaattgctgaactgaatggtagttctatttttagttatttgagaaatatccatactgttttccatagaagttgtactaatttacattcccaccaacagtgtataagcattccctcttctccatattcttcccaacttctgttattttttttacttttttacaatagcaattctgactggtgtaagatggtatctcatcatggttttaatttgcatttctccgatgattaaggatgttgagcacttttttttaaatttactttaagttctgggatacattttcaggtttgtaacataggtatacatgtgctatggtagtttgctgtacctatccatccatcatcaaggttttaagccccacatgcattaagtatttgtcctaatgccctccctccgcatgccccccaacccctgacaggccccagtgtgtgatgttcacctccctgtgtccaagtgttctcattgttcaactcccacttatgagtgagaacatgcagtgtttggttttctgttcccgtgttagtttgctgagaatgatggtttccagcttcatccatgtccctgcaaaggacagaaacacattgttctttggctgcatagtattccatggtgtatatgtgccacattttctttatccagtctatcactgatgggcatttgggttggttccaagtctttgctattgtaaatagtgctgcaataaacatacgtgtgcatgtgtctttatagtagaatgatttataatcctctgggtatgtacccagtaatgaacttgctgggttaaatggtatttctgcttctagatccttgaggaatcgtcacactgtcttccacaatggttgaaataatttacactcccaccaacagtgtaaaagagttcctaattctccacagcttcaccagcatctgtggtttcctgactttttaatgatcaccattctaactggcatgagatatctcattgtagttttgatttgcatttctccaatgatcagtgatgatgagctttttttcatatgtctgtgggctgcataaatgtcttttttggagaagtgtctgttcatattccttcccccactttttgatggggttgtttgtttttacttgtaaatttgtttaaattccttatagattttcgatattagacccttgtcagatagatagattacaaaaattttctcccattctgaaggttgactgttcactttgatgatagtttcctttgctgtgcagaagctctttagtttaattagatcccgtttgtcaattttggcttttgttgcaattgcatttggtgttttagtcattaagtctttgcccattcatatgccctcaatggtattgcctaggttttctaatagggtttttatggtttggggttttacatttaagtgttcaatccatcttaatttttgtataaggtgtaaggaaagggtggagtttctgttttctgcatatggctagctagttttcccagcaccatttattaaatagggaatcttttccctattgcttgtttttgtcaagtttgtcaaagatcagatggttgcagatgtgtggtgttatttctgaggcctctattctgttccatcggtctatatatctgttttggtaccaataccgtgctgtttcggttactgtagctttgttgtatagtttgaagccaggtggcatgatgcctccagctttgttatttttgcttaggattgcttggctatatgggctcttcctgggttccatatgaaatttaaagtggttctttctaattttttgaagaaagccaacggtagcctgatggaaatagcattgaatctataaattactttgggcagtatggccattttcataatattgagcctttctatccatgaacatggaattttttttccattcgtttgtgtcctttcttatttccttgagcagtggtttgtagttctccttgaagaggtccttcacatcccttgtaagttggattcctaagtattttattctctttgtagcaattgtgaatgggagttcactcatgatttgactctctgcttgtctatttcaggtgtatagaaatgcttgcgatttttgcacattgattttggttcctgagactttgctgaagttgcttatcagcttaaggagtttttgggctgagatgatggggttttctaaatatacaatcatgtcatctgcaaacagaaacaatttgacttcctctcttcctatttgaataccttttatttctttctcttgtctgatagccctggccagaacttccaatattacgttgaataggaatggtgtgagagggcatccttgtcttgtgctggttttcaaagggaatgcttccagcttttgcccattcagtatgatactggctctggatttgtcataaatagctcttattattttgagatatgttccatcaatacctagtttatggagagttttttgcatgaaagggtgttgcattttatcgaaggcattttctgcatctattgagataatcatgtgttttttgtcatttgtcctgtttatgtgatgcactacatttattaatttgtgtatgttgaagcaaccttgcatcccagggctaaagccaacttgattgtggaggataagctttttgatgtgctgttggattcagtttgccagtattttgttgagtatttttgcatcaatattcatctggaatattggcctgaagttttctttttttgtagtgtctttgccaggtttaggtatctggatgatgctggtctcataaaacgagttagggaggagtccttcttttgcattgtttggaatagtgtcagaagggatggtaccagctcctctttgtacctctggaagaattcggctgtgaatctgtctggccctgagctttttttggttggtaggctattaattactgcctcaatttcagaactttttattggtctattcagggatttgacttcttactggattagtcttgggatggtatatgtgtccagaaataacacaggaataacttctaggttttctagtttatttgtgtagaagtgtttatagtattctctagtggtagtttgtatttctgtgggataaatggtgatatcccctttatcattttttattgtctctatttaattcttctctcttttcttctttatcagtctggctagtggtctattttgttaatctttaaaaaaaaaacagctcctggattcattgagttttttatttttttgtgtgtatctccttcagttctgctctgatcttagttatttcttgtcctctgctagcttttgaaattgtttgctcttgcttctgtagttcttttaattgtgatgttagggtgtcaattttagatctcttcagctttctgatgtgggcatttagtgctaaaaatttccctcttaacactgcttaagctgtgtccagagattctggtatgttatctctttgttctctttggtttcaaagaacttatttatttctgccttaatttctctatttacccggcagtcattcaggagcacattgttcagtttccatgtaattgtgcagttttgagtgaatttcttaatcttgagttctaatttgactgcactgtggtctgagataaggttttttattaagtctgttcttttgcattcgctgaggagtgttttagttacaattatatggtcgattttagaataagtgctatgtggtgtagagaagaatgtatattctgttgatttggagtagagagctctgtagatgtctattatgtctgcttggtctggagctgagttcaagtactaaatatccttgttaattttctatctcatagatctgtctactattgacagtggggtgttaaagtctcccactattattgtgtgggagtccaagtctctttgtagctctgagaacttgttttatgaatctgggtgctcttgtatggattgcatatatatttagttagttcgtcttgctgcattgatccctttatgattatgtaatgccttctttgtcttttttgatctttgttggtttaaagtctgttttatcagagactaggattgcaaaccctgcttttttctgctttccatttacttggtaaatattccttcatccttttattttgagcctatgtgtgtctttgcacatgagatgagtttcctgaatacagcacaccaatgggtcttgactctttatccaaattgccagtctgtgtcttttaattgggggcatttagcccatttgcatttaacgttaatattgttatgtgtaaatttgatcttgtcatgatgatgctagctagttattttgcacattagttgatgcagtttcttcatagtgttgttggtctttatattttggtatgtttttacaggggctggtaccagatttttccttccatatttagtgcttccttcaggagctcttgctgccagcacagcagtctgaagtggacctgggacaattgagcttggtcgggggaagggcatccaacattgctgaggcttcagtaggcggttttcccctgacagtcttaaggagcgggggaaattcggactgggtggaactcaccacagtgcagcaaagtggctgtggccagactgcctttctagattcctcctcactgggcagggcatctctgaaagaaaggcagcagccccagccagggggcttatagataaaactcccaacatcctgggacagagcacctgggggaaggggaggcagtgggcacagcttcagtggacttaaacattcctgcctgccatctctgaagagagcagcgaatccagacaaggaggattcttccagcacagtgctcgagctctgctaaaggacagactgcctcctcaagtgagtccctgaccgccatgcctcctgactgggagagacttcccagcaggggtcaacagacacctcatacaggggagctctggttggcatcagactggtgcccttctgggataaagcttctagaggaaggtgcaggcagcaatctttgctgttctgcagcctctgctggtgatacccaggcaaacagagtctggagtggacctccagcaaactccagcagacctgccataagagaggactgactgttagaagaaaaaataacaaacagaaagcaataacatcagcttcaacaaaaaggacacccacacaaaaaccccatccacaggtcatcagcctcaaagatcaaaggtagataaatccacgaagatgaggaaaaaacagcacaaaaatcccgaaaaatttcaaaaaccagaatgcctcttctccaagtgattgtaactcctctccaagggcacaaaactggattgagaatgagtttgacgaattgacagaagtaggcttcagaaggtggataataacactcctctgagataaaggagcatgttctaacccaatgcaaggaaattaagaacctttataaaaggttacaagaactgctaactagaataaccagtttagagaagaacatagatgatctgatagagctgaaaaacacagcacgagaacttcatgaagcatacacaagtatcaatagcagaatcgatcaagtggaagaaagtgtatcagagattgaagatcaacttgctgaaataagttgtgaagacaagattagagataaaagaatgaaaaggaatgaacaaaacctccaagaaatatgggacaatgtgaaaagaccaaacctacgattgactggggtccctgaaggtgacagcgagaatggaaccaagttgcagaagacacaccaggatattatccaggagaacttcccaacatagcaatactggccaacattcaaattcaggaaatacagagaacaccactaagatgctcctcgagaagagcaacaccaagacacatactcgtcagattttccaaggttaaaactaaggaaaaaatgttaagggcagccagagagaaaggtcaggttacctacaaagggaatgcccatcagaatagcagatctctctgcagaaacactacaagccagaagagagtggggtcaatattcaacactcttaataaaaaaaagaattttcaacccggaatttcataaccagccaaactaagcttcataagcgaaggagaaataaaattctttccagacaagcaaatgttgagggattttgtcaccaccaggcctgtcttacaagagctcctgaaggaagcattaaatatggaaaggaaattccagtaccagcccctgcaaaaacacaccaaaatatgaagactaacaacactttgaagaaactgcatcaactaatgtgcaaaataaccagctagcgtcatgatgacaggatcaaattcacacagatttagttgtgttttatttatttcacttatctgatttatctggctagaatttcaggtactatgtgaataggagtggtgaaagtgagcatccttgtcttattgatgaatagtttgattccattattgttcaagaacaacattctgtatggtttcaatacttttaaatttaagtgttttttttatttcaattatttgaagtttaagacttttttttttttggtaattactcagactatggtctattggggtgaatgtcccatggacatttgatatatattctgctattgttgggtggaatgctcaatgtgattttgtttatatgttctatatgctttctgacatttttgtgtaatagttctatcaattaccaagaaaataatgttgtagacgtaaacataattgtgaattcagcttttacctttcagctctatcagctttcgcttcatgtatgttaaagctccattgtttggcacacacacacatttaggttttgtttaacttcttgatgtattgatcttcttatcataactgaatatacctctttgtctctattaattttctgtgatttaatattcctgttatacatattaatgtagtcagttctgttgtcatttgataaatgtgtccatggtatataatttttaatcattttacttttaattgctcaatgtcattctatttggagtgagtttcttctagacaccataagtttgggctatgttgtttttattctctctaaaaatccagtttggttttttatttttggtatagaccatttgcatgttaaataattattgatatgttaggcttaattatattattttattattaattttctgtttgtttcctgttcctttcttttttctcttgcttatctgtgagtttcatgaacgtatttttaggattccatcttgatatatttatagtatttttgagtatatccctttgtctacttttcttaatggttgttctgtgtattagaaaatacatatataaacgtagtggactgaatatttgtatccctctaaaattcatatattaaaatcttaacccaaaaatgatagtattaagagtttgaactttaggtattaattatctcatgagggttccatccttattaatgggattaaattgaattagtaataaaatatctacaaccaaaaaaaaatagcccaggactagatatattcataggcaaattctacaagacatacaaagagctactacccatcttcctgaaactattccaaaaatttgagaagggactcctccctaactcattctacaattccagcatcactctgatacaaaaacttggcaaggtacaacaaagaaaactacaggccaatatctctcatgaatatagacacaaaaattattgacaaggtactagtaaaataaatcaaatagcacattgaaaagttaatttaccatgatcaagtaggcttcatacctgtcatgcaatcttggttcaccatgctcaaatcaataaatgagattcaccacaggaacagaattaaaaagccaaacaatatgattacctcaaaagacagagagaaagctttcaatagaatctaacatcccttcatgattaaaaccctaaaataatcctaggcatcaaaagaacatacttcaaaatagtaagaaccatctattacaaacccacagcaaaccttatattggaaaggcaaaagttgaaaacattccccttggtaactggaacaagacaactatgcctactctcaccactcctgtttaacatagtactggaagtactagccagaacagtctctcaagagaaagaaataaaaggcatgcaaacatgaaaaaagagtcaaactatgttttcatggatgatatgattttattcccccagtattctgaaagctctgccaaatggctcctggaactgataaatgtcttcagtaaaatttcagaatacaaatcatactaaaatgtgtagcaattgtatacagaaataacattcaagctgagtgccaagtcacgaatgcaaacccattcgtaatagccacacaaaatataaaatacccaggaatacatctaaccaaggaggtgtaaaatctctacaagaagaaccaagaaacactgctcaaagaaatcagaaatgacacaaatggaaaacatccatgcacatggattagaagaatcaatattattaaaatgcccataatgccaaaagcaatctatagattcaatgcaattcctatcaagaaccaacatcatttttcctagaactagaaataactattctaacattcaaattttagagtatttcataatttgaatattttatatttcataattagaatatttcatgattagaatattcataatttgaatagccaaagtaattctaagcaaaaagaacaaagccagagatatcacattacctgacttcgaactatacaccaagactacagtaccataacagcatggtactcatacagaaacagacacatagaacagaggaacagaatagtaaacccagaaataaagccacacacaaccatctgatcttcaacaaagtcaataaaaacaagtaaatgagaaaggattcctgatctgataaatgctgttgatgtatctagctagccatatgtagattaatgaaactggacacctaccttccgccatatacaaaaattaactcaatgtgtattagatatataaatgtaagacctcaaactatgaaaatcctagaagaaaacctagaagaaaattctggacataagagttgggaaagagtattaagacctcaaaagcaattgcaataaaaacaaaaattcacaagtggaaactaattatactaaagagattttgcacagcaaaataatcaacagattaaatagacaacatacagaatgggggaaagtattcaaaactatacatatggcaatggtctactatccagaatctataaggaacttaatttgataagcaaaaaacaaccccattaaaaagtgggaaaaggaaaccaagagacgtgtcgcaaaagaaaacttgagtggccaataaacatatgaacaaattgccaattgtcaattattaaaatttcaaaaaacaacagattctcacgaggctgtgcagaaaagagaatgctcattacactgttggtggaaatgtaatttagttcagccactgtgtaaagaagttgggagatttctcaaagaattaaaaaggaactaccattagacctgacaattctagtaatgggtatatacccaaagaaaaataaataattctaccaaaatgacacattcactcatatgtacattgcagcactaatcacaatagcaaagatatggaatcaacctaggtgtccatcaacagtgaattggataacttttgtattgttgattttagttttgttgtttcaagatagtagattggaattattgttagcatgcttcttgcacttggaaagaaaaatagtgtgtagagattcatgctgtgaacttttttttccaagaaggaacatggatacttaggaaaactgaaagaaaccacagaccctttgaaagaagtgacaggctacatacaccatgacccatgctggaaaactgtgagtccccagagtatgacagggagagggtttccctctgtgttataaactcacactggggaatctgcaatccaggccatggtggaatgccttaactacctaccactggagctgagttagtgggcagcgggaaaaatatgtaaagcagtggcatcgggatgtgctttacatgcacttccagactccagtagggatgtaggaaagccatttgtgattctacctcacaggggacctcacagagattagctgctaactcaagcagtggtcacaggttgagagaagtttcttattgatattcgtaatacaatcttcagtggtgacaacctcccttggccagaactaaggactgaatgagaagtgtgctataatcacaggcacaggagctgggcaccggtgcttcattggtagaccttgaggggcatggcctgaaagctatggtttctgtctcagtgggggaaggcttacagcctgtggaagtttggagttctgagtgcaggctggctggaacccagctaactgctcctagtaagtttgagacctgcctagccaagttcatgggagttaggtgggacttactgccacctgctaccctctgctgcctatgcagactcttatgtgcagcagaatcatctacaatcctacctggaacattactctagcattgagagaacagaccttcgattctcattggagctgctgttcgtgcccacatgtgggtagccagagcatgtactcacctgacccagcccacatctggctttaccccttcaccctgctcagtagcttaacagaaaagtcagggacttttggaatttccatggccctgtccactgcctgaaacaccagaatacctcccctgaataacataaggcaagcacaaaactcaccattatcaccacagcaagcgctcatttgcaagtgccacctctcagctggaggacaacaggcacagtccattacaacatctgcaggcacaataacacagtgcccagaaaagataaatcttttgtgtgacctcagttattaccattgcctgcatcaccctggctaaccaggaggttttgagtcagtcctcttgacaaatgcagtactactacagctggcattttagaaagtcaacaaaccttataaccaaggaaatgtcacagagtatacatcactcccttgccacttccatcagagttggtgctggtacctgctgctgggagactagagaactagtcacataactgcatcccttgcatatgttctccagcaccagcatggtgtgtggcagccttactgggcaactagacccagagtatcagcaggattcacaacagtctggccctcaggaaggggaaagggggagtacatcaagggagcaccctgtgggacaaaagaatccagagtgcagggcataagtaccaggactttctgcttgtgagaagtctctttcagcacaggcacaggttcagaatggaaaggctgaggctatagcccaacaatcaggccaccctggtgctagagaagggtcttggagaaaggaacttcccctcactcaccagtgcagacaaggtggggcttctcccatgagaggtcagcatgagggaacccttagacagcctttctggaacacttcagggtgactgcatccccacagaagggcctttcaggttcagtcttgcatgaggtatagagtcacagtccctctctacatggaacatcagcattcctgcagatgaagaggttgcctgcctgaatagctgaaacactgggtcaggagcgtgactggtaggtggattgatttcctgctggtctgctaggggagctgaggtagcttcctcctgcccccctgaaaagacttcagtgtgtttcactgagagcttcctcagccacctctatcaatgctggaacctctgcccactattcgggtacagtatttacccacatgctttggccacagatggtttttacccacagatatttcctactagcctgaagcctgaactgtttaacacagtgaataaaatactgagagagaaaataaataaataaatacacatggctagaaaacaaaataaactttaggagaccactgccattccagagccacaggaaacagtaaaactgttcacacactaagcacattgctactgcaaccagcacccgagaaagtcgtcatacaaagactctctataatcaagacactcaaataaattcatcaccactcaaagcacccagagccaagttaagttacaatgaacaataaacattaaacacgtgtcctcaaaaagtagaaaaagaaatacaaataaaagtagaatcaaatataaaataaaaataattggaagaaatagtcttcctaaatgaaaataaaccagaaaaataattcaagcaatatgataaaaacagagtctgagaacaccaccagaagatcacactagctctccagcaattgtttcaaaccaaaatgaaatattttaaatcccagataaagaattcaaagggttgtttatgaagttactcaagaaaacacaagagaagtgaaagtgaacatgaattaagaatttaggatatgaataaaacattttctaaggtgatagatattttaatgaaaattcaatcacaatttctggaaatgaaagacacacttagggaattacaatatgcagtgaacagttttaacaatagactagtcccactataagaaataatttcagttctcaaagacaaggcttttgagttaacccaatcagacaaaaataaagaaaacagaattaaaagaaatgaaaaatgtctccaagaaatatggtattataaaatggccaagcctaaaaatcactggtgttcctgagggagaagaaaaggcaaaaagttttgaaaacttatttgaggaaataattgaataaaacttccctgaccttgctagacattaatacatccaaacacaagaagctcaaagaactacttggagattcatggcaaaaataatgacatcatcaagacatataatcatcaggctatctaaaggtaacatgtaggaaaaaattctaagagcaatgagacaaaagcatgaggtaacctataaaggaaaacattaaacttctcagcagaaaccttagaaaccaacaatatttagtctccttaaatggaataaatattaataataatttctatccagcaaaactgagtttcataaatgtaggagaaatagtctttttcagacagacaaatgctgagggaatttgtcactaccagaccatctctacaagaaatgtttaagtgagttataaatattgaaacaaaaggttgatatgcagtagaaagaaactcttgaaagcaaaaaatttacagggcctataaaacaataacataatgtggaaaacaaagtaggcaataatcaacatgatgactggaacattatgtgacatctcaatattaatattgaagtaagtggtcttaatgctccacacttaaaagatacagattggcagaatgaatacaaaattacaaccaaatatctgctgtcttcaagagacatccctatcatgtaaggattcttatagactctaagaggtagaaaaagatattccatgcaaatggaaaccaaaagtcagaaggagtagcaactcttatattagagaaaacaaactgtaaacaacaacacttaaaaagagaaagaaggccattatatcatgataaaaagtttaacaagaaggtataacaatttaaaatacatacatccctaattttggagccctcatatttataaaacagttattactagacctactaaaatagacagcaaaaacactaatagttggagatttcaacagtccatacatagcactagacagattatcaagggagaaaataaaaaaagagacactggacttaagctgcactctagaacaaatggacctaatgtatatttacagaacattctacctaagaactgcagaataaacgttcttttcctcagcacatggaccattctccaaaatagaccatatgaaaaaccaccaaaaagtctcaataaattttaaatagtcaaaatcatatgcagtatctttttatatcacagtggactaaaactataaatcattttcaaaagtaaccatgaaaactatgtatatacatggaaattaaacaatctggtcctgagtaatttgggggttaaaaatgaaatcacaatggaagtttaaaaattatttgtaatgaatgataacagtgacacaagttatcaaaaactctgggatacagcaaaagcaatgctatgattaatgtttatactgataaatatatacaccaaaaagtctgaaagatcacatattgacaacctaccatcatacctcgaggaactagaaaaataatggcaaatcaaacccaaagctagtagaagaaaagaaataacaaaactctgagaagaactaaatgaaattgaaatagaaaatagaaattatcaatgaaatgaaaagtcggttccttgaaaagacaaaaaattgatagaccattaactacattaaccagaaaagtagagaaatgattcaaataatctcagttagaaataaaaatggagacattacaactgaaagcacagaaataaaaaagataatcggaaactactataaatacctctatgcaggaaaactagaaaatttagagaaatgggtaaattctaggaaacattaaatcctcttagttgaatcaggaagaaacaaaaaccctgggcagactaataagcagtgagtttaagtcagtaataataataatagtaataatttaccaccaccaccaacaacaaaaaagcccaggatcagacagattcaaagtcaaattctgtgagacattcaaacaacaattggaaccaatcctactgaaacaatttcaaaatatctaggaggagggaatccttaactgattctatgaatccagtaacaccttgacaaaaaatagaaaagaacattaaaaattaaaactacataccaatatcactgatgaaaatagatgcaaaattcctcaaaaatatactagcaaactgaatcaaacagcacattaaaagacaattccccgtgatcaagtgggtttcatcccaggtatgcagggatggttaaacatatgcaagtcaatatacattattcatcacataaacataattataaacaaaaatcatatgatcatttcaatagatgcagaaaaatcatttgaaaaaatccaccaacgctttatgataaaaatcctcaacaacctaactatagaaggaacatacatgaaagtaataaaagacatataggacaaacccacagccaacattatactgattgagaaagagttgaaagcattctccctaagaactggagcaagacaaagatgcccactttcaccacttctattaaacataatactggaagctctacccagagcaattaggcaaaagacatgaataaagggcacccagatgggaaaaaaggaagtcagactatttccatttgccaatgataaaatcttatacctaacaaaccctaaatgctactccaaaagactcccacatctgataagtgaacccagtaaagtctcaggttataaaatcattgtacacaaatcagtagtactgatatacaccaacaatgaccaagctaagaataaaatccagaataaaatccaatttcttttacagtagctgaaaaataaaataaaatatctagaaatatatgtaaccaagaaggtgaaagatctctacaaggagaactacaaagcactgttgaaataaaacaatagatgaatggataaagaaaatgtggtatgtatacacaacagagtactattcattcttaaaaaagaatgagatccagtcaatttcaaaaacatggatagaactgaagattattatgttaagtgaaataagctgggcacacaaagacaaacatcgcatgttcccacttgtctgtggtatctaaaaatcaaatcaactgaattcatggacatagagagttgaaggatgtttaccagaggctgggaagggcagtgggtggttggtgggggtggggaagtggggatggttaatgggtacaaaaaatagaataaataagacctactatttgatagcataattgggtgattatagtcaataataacttaattgtatcattttaaataacataaataatgtaatcagattgattgtaatgcaaaggataaatgcttgagggaatagacaccccattctttatcatgtgcttatttcacattgcatacctgtatcaaaacatctcatgtaaccccataaatacatacacctactatgcacccacaaaaacatttaaaaataatttaaaaattaaagaaagaaatcacaggacacaaacaaatggaaatatataccattctcacagattggaagaagcaatattgtgaaaatgaccatactgcccaaagctatttacagatttgataaaattcctatcaaaacactaacatcatttttcacaaaattagagaaaacaatcctaaaattcatatggaacaaaaaaaaaaccatatagccaaagcaatcctaagtaaaaagaataaatctggaggcatcaaattacctgactcaaattatactataaggctatgggaactaaaccagtatgctactagcataaaagtagatacataaaccaatggaacagaatagagtacggacaaataaagccaaatacttacaaccatctgatcttcaacaaagcatgcagacacatgaactcgggaaaggacacccgatttaataaatggtgctggggaaaatagatagccatgtgtagaaaaacgaagttagatacctattgctcatctcatataacaatcaactcaagttggattaaagacttaagtctaagaactgaaatcataaaggttctggaagaaaacctaggaaaaactcttctggacaatgacgtaggcaaataatttatgactaagacctcaaaaccaaatgagacaaaaaacccataaattaataaatgaagcttaaaccaaaaagcttttgcacagtaaaagaaataatcatcagagtagtcaacccaaagaatgagagaaattagttgcaatctatgcatccaacaaagaattaaggtgctgattctacaaggaatgcaaacagatcagcaagaacaaaacaaattatcccatttaaatgtgggcaagtgacatgaatggacattctcagaagatatacaaatggccaaaaaacgtatgagaaatgctcaacatgactaataatcagggaaatgcaaattaaaaccacaatgagataccaccttaccccaaccagaatgatcatcattaaaaagtcaaaaaacagtagatgttgacatggatgtggtgaaaagggaatatttacacactgctggttggaatgtaaacttgtacacctcctatggaagaaagtatggagttttctcaaagaactacaagtagatctaccattcaatccagcgatctcactactgggtatctatctaaaggaaaagtaattatatcaaaacaacatctgcttgcatatgtttactgcagcacaattcacaattgcaaagatatggagccaatcctaagtgcccatcagctgatgatggataaagaatatctgccatatatgtgtgtaacatatacatatatgtgtaatatatacatattgtaatatatacatatatatgtatatattacacacgcacaacccatggaatactactcagccataaaaaacaatgaaagtatgtttgttgcagcaacgtacatagaaccagaagccattattctaagtgatataattcagaaataaaaaaccagatatcctatgttctcacttgtaagtgagagctaagctacgggtgcataaaggcatacaaagtggtgaaatggacaatggagactcaggaaagtgtatggtggaaggaggctgagggataaaaaacttcatattgggtacaatgtacactactgaagtgatgagtgcgctaaaatttcagacttcaccactctacagtttatccatgtgaaaaaaaaatgcttgtacccctaaaactattaaaatagattttcagataagaaaacaaaacaaaacaaaaaaacccagtgaattggataaagaaaatgtggtaaatataccatggaatattacatagccataaaaaagaatgaaatcattttctttacatttcctttgcagaaacacaggtatgcacagacataaagatggcaacaatagacactggggactactagagcaggagagatggagtgaggcaagagctgcaaactaattattgggtactgtgctcagtacctgggtaatgggattcattgtactaaacctcagcatcacacaatataccagttaacaaacctgcacatgtatcccctcagtctaaaataaaagttgaaattttaataaataataaaataagaaataaaaaagttaaaaatcatgccagaaactttgagaaattatctctaaatacatatgatttataagatcttagtataaaaatctatatataattcctaaagatagacaatcaaccctagaataacatacaaaatgaatatgaataatacattaattaaaaaacattcctgaatgtcttacaaacatatggaaagatgctatttctcactattagtcaaggaaatatatgttaaaaataatgagatctcatattaaataatttggcaaatgttatggacatcatcacaagtgttgacaaacataaaaaaaaaaccgactggccagaactaacagtagtactacgttaaataggaatggtgagagagggcaaacttgtcttgtgccagttttcaagggaaatgcttccagcttttgcctgttcagtatgatattggctgtgggtttgtcatatatggatcttattattttgaggtatgtgccttcaatacctagtttattgagaatttttaacatgaagagatactgaattttattgaaggcattttctgtatctattgagatgatcatgtggtttttgtctttagttctgtttatgtgatgaatgacatttattgatttgcacatgttgaacaaaccttgcatcccggggatgaagccaactgcattgtggtgtataagctttttgatgtgctgctagattcggtttgccagtatttcattgaagttttctgcatggatgttcattaggtatattgtcctaaagttttctatttttgttgtattatgaaaatggccatactgcccaaagtaatttagaaattcaatgccattcccattaaactaccatggacattcttcacagaattagaaaaaaactattttaaaattcatatggaacccataaagagcacatatagccaagaaaatcctaagcaaaaagaaaaaagctggaggcatcatgctataagagttcaaactatactacaagagtacagtaaccaaaacagcacaatactggtacacaaacagacacattgagttaataattggtgttaagtgaactggcttgccatatgcagaaaattgaaattggacctttgtcttacaccttatacgaaaattaacttgagatggattgaagacttaaacgtaaaacccaaaactataaaaaccctaaaagaaaatctaggcactaccattcaggacatagcacaggcaaagatttcatgatgaaaacaccaaaaataattgcaacaaaagcaaaaattgacaaatgggatctaattaaactaaagagtttctgcatagcaaaagaaactatcagcagagtgaacggacaccctatagagtgaaagaaaatttttgcaatctgcatctggcaaaggtctaatatccagaatctacaagaagcttaagcaaatttacaagaaaaataacaaacagccccattaaaaagggggcaaaggacaggaacagacacttctcaaaagaagacattcatgcagccaacaaacatgtgaaaaaacatatgtaaaaaaagttcaacatctctgattatttgagaaatgcaaatcaaaaccacaatgagaatgccaactattaaaaagtgaagaaacagtagatgctggcaaggctgcagagaaaaaggaacacttttacactgttggtgggaatgtaatttagttcaaccattgtggaagacagtgtgctgattcctcaaagatctagaagcagaaataccatttggcccagcaatcccattactggatatatactcaaaggagtataaatcattctattagaaagatacgtgcatgcatatgtcaactgtagcactattcacaatagcagtgacacatggaaacaacctaaattcccatcaatgatagattggttaaagaaaatgtggtacgtgttcatcatggaatactacacagccattaaaggaatgagatcatgtcccttgcagagacatggatggagttgaaaaccattatcctcagcaaacgaatgcaggaacagaaaaccaaacactgcatgttctcacttataagtgggagctcaacgatgataacacatggacccatgatggggaacaacacacactggggcttgtcagggggagagtggggagggagagcatcaggaaggatagctagcgaataacgggcttactacctaagtaatgggttaatctgtgcagcaaaccagcatggtacatgtatacccatgtgacaaacctgcccatcctgcacatgtacactggaacttaaaataaaagttaatggaaaaaaaagagaaacagactcatacactgcttgtgggtatataaattataacaaggtattagaaagcaaatcagcaagcaaatttacttaggatggcatacttaacaattacagttctaggagtataacttagattaaggttttttatcctaagcactattgagattttcggctagaaaagtgcttgatgtggggacttttttttacacaggtatatttagcagaatccctgaacactacccacttgatgccattagcacgtgccaccaccagttgtgacaaccctaaatagccctagatattgccaaatgtcctcaagagggaaggggagcaaaataatctctgtgtgagaagcactgaactagagaaacttgaaaaactctcacatacacaaagagatataccattatgtgttgaattgtgtctcccaccaatttacatgttaaagtcctaatgttcagtacatcagcatgtgaccttatgcggaaatagggtaattgcagatgcaattagataatatgaggtcattagggtaggctgtagtccaatatgactggtgttgttacaagaagagaaaatttggatataggcataaagagaagacaatgtcacgagataaaggggaaaaaatggccatctacaatccaaaaacagaggaccaaacggatctttctctcaatgccctcaaaatggaccaagtctaccaacacctttattttggacttttagactccaaatttttacttttgaaaagtaaaaaaaattaaaattagtttgctttaatttgtaaattctcttcatagactaatggtaagacaatacaccacccagtttgtggtattttgtcagaaacagtgacaaagtaaattacaagcactccttagtaaattaatactaacgtgtaagaatgtttattgcatcattatttataaaatttggcatctatacaaaatctaagagagaataaaataattacttgtagcttattcatacttttgaaaagtatgcagaaattataaatgaaatggcactacatatattaaaatgtctgcatgtaaataatattgagtaaaactataatgtgcaaaataacttttacattattacatcatttatataaagcagagaaacatgcaaagcctcacacaagcaaaaacaaattgaaatggtaaacaacaaattccagacagtggctaatgtgtgtaaagaaggaagggaatgaaattataaaggcacagatattgaatgaaagccatctttatttttcctatattaaaaagtttgtagcaagtgtggtgaaacgttgagatttgttaaggctatgtgttgattccatatgtgttcatttatttttcttcatattttaaattatcaacatctcacataaatgtttctcatattaatccttaatcaaaatttctataattattatagctgagtcaaaactgatgaatatatttaagacttttgatacacattttcaaattgtcatctttaagtttgcatcaacttacattttcaataacagtgcatgggagagatggttttatttactcttaaccataatggtattaccattatgtttagatttcataatttaattaatgcaaatggaacctcaaagtttttatcaatttatatttttatgttactttgacttctggtaatatttgatgtgtttgttttaacagatgtcacttgtatattttgtaagttgtgagtatatagtttggtagtttagtaaactttattgaggtttggtttatgtttaaggaattgccttattttcagtttatagttctatgagttttgataaatgtgtttacacatatgatcatcacaacacttaaaatatagactatatctaccaccctataaaattccctcatatccctttgcacttatttccttcaccccagccccagcaatccttgatcttatatcactatcaatttgttttgcctcttcttgaactttgtataatcggatcatactctgtgtgctctctagtttctgacttttttctctcattctaatgcaccaatttttaaaatcttggtgttaatttttgctttaatttgtaaatgctcttcatagactaaaatattaatctttttcatgttatatgtgttacaaaatttatccaaatttgcccttgccctcttatatttacttaagaatactttaagtgtttagatgtttataatgtatacctaataaattatgtcaacattttctattagagattctgccttttcatagaatgtgcttagatgcttttcaaaacctgaaatcagagttttatcagtgtgaaaaggtgtgagtagggagaatgactctggtgcactgtgtctcaccatacgtgaatagtgctttctgaagatcacctttttgaagaggtgatcttgtatagggggtgctcttttctcactttaatgtcaatggaagagtcttcgacgtcaccagggtacccaatatgaattatctgtcacttagggaaacacaggggactgatgcttgattcatacctaagaaatataaaggaagagaatttggctaaaaggcttgtggcagcagaatagagggcttcaaattaggagggaatgatgcacctaccaacaacaaatcaaacaaatacctgttagtgacaagataccaaacatgtatgagaaaaccccataaacctaaggagccctaatgccggtggaatataaatgtcttatatgtgactggtgctatattgcaccggcattaggactccttaggtttatggggttttctcatacatgtttgttatgtgaggacttcaacactagaatagtcagaaaccacagtttgttagctataagagaagcattaagggctcaaagcataaaaataggaaagaattaattaatcatgcttcggcatctgtcaggacaagccaacttatattaaactacccccaaatctcagtggcttaccacaatcaaagtttattttccactcacacaaagtctaatgcagtgggtgctggtttggatgttctcctgctcaactgtctttcaggtgaggaactcaggaacctgggtccctgcagccctgttgttctgacatattgaggttctttacttccaggcttatctatagttccatttatattcctatattaactgtatctatattcatatataaataaaatcctacacattttcaagagtctgagtttttaaaattctaaaagaaaagctaaatctcaacaatttttctctcaagataatataaaaaatacagatttttatttgcaggcatttctttgcaatgatcagaggaagtgtccagttactacaaccagaattcactgagagttatatagaggttaatgattataaccagaaaacaataaatcagccagcatttgaggaaagtgaacactatgaaagagaagtagtgacctcaatagaaaactaaagaattaacctccaggaaataaagttaatacaggaaatggaagaaagcttacagtaagtccattttatatccatagaaaaattttagtatattttatccatttaaacagggtactataaaataaaatgtaaaaattaatagtaaaaatcagatacatgaaattactgaaattataaaatttcatatatataattacagaaattataaaattatagacactgaaattataaaaacacttcaatacatgtagatgaataacagaagagactcagctaaggatgtataaagttatctaaaagacataaaagaggtattctccaagaacgcagtacaaatggacagggatcatataagaggagagctcttattccaacatgtatctaatcagacttccataaagatagaataaaaagaaataacttaaatgatgactagcaatctgccattactatggatatgtacaagtcacatgttctactcatctctcatatccagtttatcaatgaatatcttatttccaactagtaatcagagtggacttttaaagtataaatgagagcactttatccttctttagtcatccattgcttctcattgcatgtagaaaaaataataatctgctccaagtctcccattatcctactcttcctttccgtacaatatatccattacaatgaccacttgttatttcccagaaaatctcaagatgcattctgtctcttggcctttggtcttactgttccttttgcctagactactctccccaactcatacccaagcttttcacaaatcttcctcctaggtattcttcagactaatattacataccaacttcttagggatgtttacacacataacaataagtatttaatttctgtggctattctttatcatagcttactgtgtatcttctttacaaatttatcaggatatgtaggttaagaaattttgcatacttgttgtctaacacaatgaaatataatttccaagagaatagaggtcttttctatccagttccccattgcatttccatcattcttatagtgcctagtctagcacaggataagtgcttactatatttgctaaatgaatatatgtactatttcatttgaaaggatccactaagattttaaagcaattcattaaaaatagtgtgcatttttacctacatagttatggtaaaatttcagaattcaaaggataaagagaacatattaaaaaaaataagagagcaaattaacaatgagctgtcaaagactggacactttcacaactctaaaatctaattcaaaacacagcaaataggaatatgcttaataaaggaaaggataactgaatttcagtaagacagcactgtgacatttttgataaccatcttataacccccattcttcagcatggtgccagtggctatgaatatgatggcctacatttttgatgtggctaacttgagacaagaggttaataataaagaacttgttcttaaaatactgtgttcatgtgttttgacctgtctggtggttccctgaggaatcacacagagactcacatttgttttgccctaatctcagggctcgaataaatttccaggttgcagaggtatctgtcaaaatattttaaaacattcatttccataactaccagagaagtgggtgacagatggggcaaacagataacaaatccaaaatcctggaaacgagaaggctgagaaggctcagaatgaagatacaagtattaagtcacttaagaaaaccttttaggtcactgatgatcactgacacaatggaaaacacagaatttagttaatatacacaaaagatagtcatcacaaaaagttttaaaaagttgctacaaaatggatgactgcaggcctcaacaatcaaaaatagcaaaccctgaggaaaggagatttaagttccaaaatactcttcaggatgccgagcttaagtagaaaatttcaagacatacaaacagaaaaataaatcccatccagaggtaaaaaaaaaaaaaaatgacttaagctgttctttggggaacctagatattcaattaactacacaaagattataaattaactttctgaaatatgctgaaagagcttaaggaaactggacaaataactaaagaaaagcaggaaaattatgtacgaacaaataagaatatcaatagaaacagagactataaaaaggtatcaaagtaaaattctgaagatgtaaagtataataactccaatgtaaatatcactgaaggattcaagaaatttaaataggtagtagaaaatatctgtgaacttgaaggtaaaaaatggaaattctcccctctgataagcagaaagtaaaaagaatgaagagaagcgaacatagcctaaggcttttgtgggacaccatcaaaaataccaacatacacatgggagtctcagaaaaagaagagataaagaaatgggaataaaacagatttgaggacctaaaagtcaaaaacaatttaaatgttgttaaagacttgcatctacacatccaagaagttcaattaacttcaaataggataaattcaaagtgatcaacacaaaggcacattataataaaattgtcataagccaagaaggagagaatcttgagcaccagaagtgactccttatgtacaaagaattgtcagaaatattaacagcacatttctcatcagaaaatatggaagccagaaggcaatggaatgacatattaaaagtgatgtaagaaaaaaacctgtcaactaagaattctgtatcttgcaaagttgtttgtcaaaaataagagatattagaacattccctataaacaaaagctgagaaagtttgttacttgaatacctgccttacaataattatttatttgagttcttaagactgaaagaaacactggacagtaaatcaaaagaatacagagaaatgaagaaatttggtaaaagtaaatacataagaaaatatgaaagccagtattattatatttctggtttgtaactttttattttatatgtgattttaaaaagtaatatgttaaaagattattataaatatatattaataggaaaacaatgtacaaagatgtaatttatgacaacttaaaagggtggtagggctctataagatcagggttttgtaggttatttaaactaagttaatatcaaataaattagattgttatatacttaggatgctaactgtaacttccatagtaactattacaaaaatatctaaaactacatacataaaaagaaattagaagagaatccaaaaaaatgacttaaagacaaataagacagtaatggaggaaatgaagtaaaaaagagttatgacacacagaaaacaaatagcagacaggtgacataagcaagatgactgaataggaacacttggactctcccacgtggacacaccaattgaaaagcaacacacaaattatttccctttgtgagaaatccaggaactagatgatatgttcctgcagcttcatcttcatggatgagtatgaaactgtccacattgaaaccagttggaaaaataaatacatcctctagccataattcccactacctggcacagtaacatatgttcagaatggaacccccagctcccagcttctctgtgagagtgaaagagatagaccgactacatgtagcatactaacacttccaggcgctgcctgaggatctggcttctctctcatctgttttggaaagctgatagaatctgacatatgtgtatcttctggggactacagagaacaaagaagtggtttgaactagtgtgtgggcacttgccacagctcttctacttggctcagcatagaattagagtgtgaaaactaccaactctctgcatctccctgaggagggaaagagttgtattgcatatgttatgtcttaacttttccaagtgctatatgagaggctggcttctaccccacctatctctgagagtttatgaggcttgacatattcaaataccctggggactacaaagacaaaattattagtttgagctggcatattaagcacttgccacaactcctcccttaaacttcacacagagcgagtgggtaataaagtcacccaagattgcagcttcaaccagggggagaaaagagattgaacatgcactcaaatgccctaaattttctgaggactgccaaaataactggtttattcctttttttttcttttttttagtgctaatgtgacccgttatgctctagtcatctgagggccaatgagaacaaagagggcagtttgaactagaataaaactgctgcaatcaccttcccccagatcaacatagagataaaaggcacaatttcccagttctcagcttcttcctggagatggaaagattggagcagagtgtctaatgatgcaccttctctgaagccttcctgagaaactggcttcattcttgcttgtcttgaagcactgaggggacctgcaatactctagatgctaggaacaaagaaagtggtgtggcctagcattaaggtttgagagacctccagaatgtctgaatagggtaattggtaagagttttctcctgtgaaaggccagtgcttgaagactgagagaggtgactcttttgtctaatgtgttaacagcaacacagagaatcaaaaaaatgaggaaacaagaaaatttgttccaaacgaaggaaaaagataaatttcaagcaaccaatcgtaatgaaatgaggatatatgatacacatgacagaattgaaaatggctgttataaaactgttcacaaatggaaaacactatatttaaagaagtacagctaatatgctgagaagaagagaaaagaggatcatattaatttttcactaaaaccataaaagactgaatgagaaaaataggaactaagaacaagggaaacaaatagaaaacagtaacaaatatgggggcttgacatattctagtctcctgggggctagaaagaacaagtggttggtttaaactagcataggatacttgccacaacttttcccccaagcttagtacagatattaatacaactatactagtaatcacattggatgtcaatggtctaaatgcaccaattcatacacagagattgtcaaaatagaacaaaaatcaagagctaaatacgggttgtgtgtaaggagcccactttaaatataaagatacatatagagtcaaagaaagtggatggagaaagatatgctatgccaacactaaataaaataaattgggagtagctatgttaatttcagaaagagcagactttaaggaaagttatcaggggaaaacagggagattacattttttacaacttttattttaggttctgggttatgcgtgcagatttgttatatacataaactgcatgtctcagaggtttggtgtacacagtatatctgcacccaggtaataagcatagtgcccaataggcagttttttgatcctctcctttctcccagtcctctactctcaagttatccctggggtctcttgtatccctctttgcatccatgtgttctcaaattttagcttccatgtataaatgagaacatgcaatatttgtttttctgttcctgtgtgattttaattagattaatggcctccagctccatccatgttgctgcgaagggtataatcttgtgtttttatgacggcttagtttatacaccacatttttaaaatccagtctgctgttgatgggcatttagtttgattctatgtctttgccacggtgaataatattgtgatggacatatgtgtgcatgtgtctttatggtagaactaccataaagacatgagtagatgcccaatatgggtaaatacccagtaattgaattgctgggtgaaatggtaaataagccctagtatttgagagcactgaaaggggattctagtcaataattatttaattgtacatttaaaaataactaaaagagtataatggaattgtttgtaacacaaaggataaatacttggggtggatacccaattttccatgatgtgattattatgcattgtatggctgtaacaaatatctcatgtatctcataaatatatacatctaatatgtaccaacaaaatttaaaaataaaataaattaataaaatgagacattacataatggtaaagagatcagtgctccaaagagatgtaacaatcctaacatgtgtgagtctaaaaacagagcatcaaaatacataagacaaaatctaacagaacttcaaggaaaaatggatgaatctactattatttggagattttaacatccatctttcagaaatgaacaagccaaaccagcagaaaattggaaagagcatagttaaactcaaaaactctatcaatcaacagaatgaaatgtaaatatctaagctacttcatccaacatcagaatacacattcttctcaacctcacgtgaaacattcaccaggatagataagattctggacaatgaaacacatatttaaacagttaaaatatgagatattatacaatgtctcctcttagaccacaatgaaatgcaattagacatcaatgacaagtgctcactgaagtcaggtaaaaaatgcatgcacaaatttaaagcagtaagacatggcatgagaacataagagattttttaaaaacattttaaaaggtatcaaacagaaatcgtggagcctaattgaactgaactgaaaatttcactagagatgttcaagagcagactagattaagtataagaaaaaattagcaaactcaaagacagtttattggaaataattaagtcagagaaatgaaaataaaaaaatgagtaaagaaagcttaaaggatttatgggacggtataaagtggactaatatacacagcatggagtcccagaaggagaaaggaccagaaattttattcaaacaaataatggttgataactttccaaatctggggaagaaaacggacatacaaatccaggaagccagaggacttgatataaaaagaatacagtgaaatttatacccagatatataatcaaattgccaaaaattaaagacataaaaagttttgaaagaagcaagagaaaagtgacttatcacatacctctataagtttataagaaggattttctgcagaaatcttataggccagaagagagtgggatgatataaaaagtgaaaaaaaaaaaccttgcatatcaagaatactgtacttgggagaactatccctcaaaaatgaaggaagagagaatttccctgaccaaaaaaaaagttaagtttgttcaccacaactaaacctgccttgcaagatatactaaagtaacttcccaatcaaaagatataggatggctgaacagatttttaaaaaataagatttaactatatactgtctataagagatttactttggatttaagaagacacataggctgaaaataaaagaatgagaaaagatattacatgcaaataaaaaccaaaagagaatgagggtggctatattgatatctgaaaaaatatattgcaagtccaaaactttagcaatagacaaagaagaacattacataataaaaatggatagttcaccagaaatagttgacaattataaataaatatgcaccaatcatcagagaacataaatatataaagcgaacattgatgggactgacaagagaaatagcaatacaatgataggaggagatttcaatactccatttcaaaaatggaaaaaaaaatccagacagatgatccatatggaagcagaggacttgaataacactataaaacaagtggacctaacagaaatataaataatataacacagaacagtagcagaatgcacattcttctcaagttcatatgaatctttccccaggatagattacacgttaggtgacaaaataagtttaacaaacttaagaagagtaaaatcataacaagtatattttatataaaaaatgaaaaaaaatcatggccatgtggatttttaaatttttattgttttatttttatgggtacagagtagttgtatatattttaggtgatatagggtttggatttgtgtccctgctcaaatctcatgtcaaattggaggagggatgtggtgggaggtgattggattatggggtcagatatcccccttgctcttcttgtgatagtgagtgagttttcatgagacgtgatggtttaaaagtgtgtaacacgtcccccctcactcactctctctcctgccaacatgtgaagatggtcattgcttcctgttcacctcctgccatgattgtaagtttcctgatgcctgcaagtcatgcttcctgttaagcctgtggaactgtgagtcaattaaatctcttttctttataaattactcagtctcaggtagttctttatagcagtgtgaacacagagtaacacaaaaaattggtaccaggatttgggcactactataaagatacctgaaaatgtgaaagtgactttggaactgtgtaacagacactggggttggaatattttggagggctcagaagaagacaggaaaatgagagaatgtttggaacttcctagagacttgttgaatggttttgattaaaacgctgatagtgatataaacaatgaagtccaggctgaggtgctctcagatagagatgaggaacttattggaaaatggaataaaggtcacgcttgttatgctttagcaaagagactggtggcattttgcccctgccctagagatctgtggaaccttgaacttgagggagatgatttagagtatctggtgaaagaaatttctaagtagcaaagaattcaagatgtgacttcactgtttctgaaagtgtatactcgtgtgtgtgtgaacaaagagattatctgctactggaacttgtacttacaagggaagtataacgtaacagtttgggaaatttgcagctgagtcgtggaaaaatgaaaaatcaattttctgggtaaaaattcaagcctgctgcagaaatgtgcataagtagagtagccaaatgtgaatagccaagacagtggggaaaatgtctccagaacatttcagagacattcaaggcaggccccctccccatcccaggtctgaaggtctaggagggaaaagttatttcccaggctaggcccagggacctgctgctctgtgcagccttgggacatggtactctgtgtcccagcagctccagctccaaagatggctaaaatgggccaaggtacagctcaagtcatggcttcagaggatgcaagctccaagccttggtggcttccatgtggtattgggcctgtgggtgcacagaaagcaagagttgagatttgggaatctctgtctagatttcagaggatgcatggaaatgcctagatgtccaggcagaagtctactgccatggcagagccctcacggagaacctctattagggaagtgcacaggggaagtgtggggttgaagcccccatgcagagtcctcactggggcactgcctagtagagctgtgagaagaaggccaccaccatcctcgagaaccttgaatgatagatccaccaacagcttgcaccatgcacctggaaaagctgcagacaataccagcccaccaaagcagccatggagcttgtaccctgcagagccacaggggtggaactgcccaagtccatgggagcctgccccttgtgtcgatgtggcctgggtgtgagacaaagagtcaaatgaaatcattttggaattttacaatttatgactgttctgctgtatatcttggaagcaactattagcctgtaaaatcaataacttgtttttaattttacaggctcataggcagaaggggcttgccttgtctcagaggagactttgaacttgaacttttgggttaatgatggaatatgttaagaccttgggaaactgttgggaaggcatgattgtggtttgaaatgtgagaaggacaagagatttaggaggggccaaaggtggaatgttacggttcagatgtgtgtccccactcaaatcttatgttgaattgaaggggggggggtctgcagggaggtaattggattatgagaatagatttcctccttgctgttctcatgatagtaaattctcatgagatgtaatggtttaaaattgtgtggcacttgtcccctcggtcactctctctcctgtaaacctgtgaagaaagtccttgcttctctgtcaccttctgccatgattttaagtttcctgaggcctcccagtcatgcttcctgttaagcctgtggaactgagtcaattaaatctgttttcttaataaattgcccagtctcaggtagttctttatagcagtgtgaaaatagactagtacaataggttacatgagatattttgatgcagacatacaatgcataataatcacatcagggcaaatggaaaatcaatgtactcaaacatttatcctttctttgtgttataatcaatccagttatactcttttagttattttaaaatgtacaataaattattgttgactgtagtcaccctgttgtgctatcgaatagtaagtcttattcactctatctattgttttttgtacacattaaccatccacatttccccctccttactacccttcctagcctctggtaacctttcctctacctctgtcaccaggagtttaattattttagcttttagatcccacagataagtgagaatgtgtggtttgtctttctgtgcctggcttattttacttaacataatggccttcaatttcatccaagttgttgcaaatgacagtatttcatttttttatagctaaatagttctctatggtgtatatgtaccacattttcttatccattcatttgttgatggacacttatgttgctttcaaatcttggctggaaaaaacatgagaatgcagatatgtctttgatatatcaagttcctttgttttggtttcatacctagcaatggaattgctggatcacatgatagccctatttttagttttttgaggaacctccaaactgttctccttagtggttttactaatgtgcattcccaccaacaatgtatgagggcttcctctactctgcatcctcaccagtatttgttattgactctcttttggatttaagccattttaattgttgtgaggtaatatctcatcataatgttgatttgcatttatcttatcattaatgatattgacctccttttcatatacctattttccatttgtatgtcttcttttgagaaatgtctattcagatcttttgaccatttttaattgaattattagatttttttcatatagaattgtttatgctttttatgtgttctggttattaatcccttgttagatagagagactgcaaatattttccccccttctgtgggttttctcttcattttgttgattgctttgctatgtggaaactttttcagttgatgtgataccatttgtccatttttgcattggctccctgtgcttgtaaagtagtactcaaaaactctttgcccagtccaatgtactggagagctgcctcaaagttttcttgtagtagtttcagaggtccagcccttagatttgtttttaatccattttaatttgatttttgtaaatggcaacagataggactccagttttattcttctgcgtatggatatccatttttcctagcaccgtttaatgaagagacttccctttccccagtgatttttcttgacatctttattggaaatgagttcactgtagatgtatggatttgtttctgcattctatgttgtgctccactgatctgtgtgtgtgtgtgtgtgtgtgtgtgtgtgtgtgtgtgtgtgtttatgccagtaccatgttgtattggttactgtagcttatagtagaagccaggtaatgtgattacttcagttgtttttatttttgctctggatagctttggctattcttggccttctgtgtttccatataaatttaagattacgttttctagttctgtgaagaatatcatcaatattttcatatcatcatccaactctatgctctgctacaagagacttccttggatacaaataaacaaattggttgaaattagaagtaacgaaaagagagctagcttggctaacgcaaatatgagataaaatacaattaaaaaagaaataggtctacaataatagttgaacacttcagtacttcactttgaataatagataaaacacttaagcagaaaatcaataaggaaatagagaacctgagcactataaatgaagtagacccaagagacaaatataaaatggtataccccaaaccagctgaatccacatttttctcagctgcacatggaaaatcatcaaggacacaaaacaaatcttaataaacttaaaaaatgatattatagaaagaaacacaagaaaggaaactatagacaaatatcccgtatgaaaatagatccccaaatcctgaatgttatactagcaaaccaaacccaacagtataataaaaggcttatacaccatgactaagtaggatttatctcaggaatgcaaagttggttcaacacaaaagtatcaatcaatgaaatcaatcacagtaataaattgtagggaagaaaaacacatatttatttcaattaatgtaaaaatcattcaaaaaagaaaatacaacaatataataagaagtgaagcactcagaaaactagaaacagaatgaaactcacaccatgataaagaacacttagagaaacccagaactaacatcatattcaatagctaaagactaaagtctaccctcatgagatcaggaataagacaaggatgctcactttcaagattgcttttcaacattgatctggcagttctaactagagtaataaagaaatatatatatatatatatatatatatatctgtgtgtgtgtgtataatccaaattggaatgaaagaaggaaaattacttatatttgcagatgacataactctataaatagaacctaaaaaaacctattagtgatagttaataaattcagcaaaatttcaaggcacaatatcaacatgaaaaattagattgtgttttaatacaccagcaactaaccatgctgaatggaaattaagaaagcaatttcattaacaagagcacttaaagaataaaacatcttgaaataagcttaaccaatgagacaaaagatttgtgtaccaaaagccacaaaatactgctgaaaaacaagagctaaataaattgaaagatatcctatgtttatttactggaagacttaatattattaaaatggcactactacccaaagtgacaaagatattcaataaaatccttatcaaaattccaacggcctgttttgaagaaataaaataaataaatcttcaaatgaatatgtaagtgcaagaagcctcaagtagtcaaaaaaatttagtaaaagcaaatgtaggagaactcacacttactgatttcaaaacttattataagtctacagtagtcaatacagtgtgatacttgcataaaaatggacatatagacccatggaatagcaaaagcattcagaaacaaacccacttacctatggaagattttcagcaaagtccaaagaaaattaaacagaaaaaataatagtcccttcaaaacaggatgctggaacaactaaatatccacatacaaagggatgaacttggacccctacttcacacaacgtacaaaaaagtaactcaaataaacccatgacatagatcgcagagcaaaaaccacaaatctcttagaagaaaagatagagataagttttcataacttttaatttggcattaatttcttaaatatgacacagaaagcatgagcagtgaaagaaaaaaattgataaatttgactttatcaaaattaaaaacttcgtgcatgaaagaacattatcaagacaatctaatgaatggcagaaaatggccgggcacggtgtctcacgcctgtaataacagcactttgggaggccgaggcgggcagatcacaaggtcggaagatcgagaccatcctggttaacacggtgaaaccctgtctctactaaaaaatacaaaaaaattagctgggcctggtggtgggtgcctgtagtcccagctactcgggaggctgaggcaggagaatggcgtgaacccgggaggcggagcttgcagtgagccaagatcaagccactgcactccagcctgggcgacagagcaagactccgtttcaaaagaaaaaaaaaaaaaaaggcagaaaatatttccaaatcgtatatctaagagtctagtatccacaaaataaaagtaatgtttacaagtcagtaacaaaaaggcaataaattccacttaaaaatgggcgaaataattcaatagacatctctccaaagaagatacacaaatgaccagcaaacacatgaaaatatgctcaacatatttagtcatgagggaagtgtgaaggaacaccaaaatgaaacaccactttgtacctactagtatggccttaatatatttaaaaatggaaaacaataagtgtttgtgaggatggaaacaaattggaacccttatatcgatcaggttggtatataaaatgtttcagcttctatggaaaacaatttggcaaaaactagaagttaaatatcacattatttatattataccacaattccaatattaggtatatattccaaataattgaaacaggtaccaagcaaatatgtgaatacatatgttcatagcatattcacagaagcaaatgtacacattttatgaacaggtgaatggataaataaatcatggtatatacacatgatggaatattattcagccatcagaaagaatgaaatgctgagacatgttaaaagataaactgaggcacattaaaatattagagttatttgagcaaacatcaatttatgaattgagatctgtcagactgcaggtggtttgggggctccacagaaagggcacaaggtgaaggcttctatagattaagcatggaagcaaggcaaataaaatatttgattaaagtggagaaatatccttatttgtattattccagtagaaagtccccatttagaggttatttggtggtttctaattggttaaacttgaaaatttatttcactgtttacactgagttgggttgtggttttctttcatacaatcatgggatgttggatctgcctcagcctaaaggcttcccaattaattattctaacgggtattatatgatgtggacaaatttgaaagcatgctgtgtgaaagaattcacacacaaaaggctgcatatattaaatgactccatttatattaaatatttagaacaggcaaatccataggaacagaaagcagattgctgcatacctgaggctgggtagaaaagaagatgaatagcaactgcttaatgatatgaggatttgttttaggtgatggtgaaatattttgtaaatacaaattgtggttgcacaatattgctgatgtactaaatacatgtaactaaattgttcactttaaaatgtttcattttatgttatgtgaactccatctcaataaaaaagaacctcaagtaaaattaattatgcacaaaatatgacagcaatattgacatatgttttttcctatttctgtgggaaaattatttaaaatacgtagtgtaatacttagttagaccaccattcaattatgggagcaaaatttatagctcagaatatacaatatttgtaaagtatatgacaggtaatctctgaataagataatacctgtaaatttcttaaattagtgtctgacacataggttcaattagccactgtcattatttgaagggcattacgcaattacttcaaagtcatgactgaactagaaaacttatcttggtactacggtattggtgaaactcatgaaggtgggctccccaactacaggattaaaatcctagtcttagctctactttgcatgcgtacctaaatccttctatcactgtggaaataagggcctcaacccttgctctgatttccacatcctgaccagtcgtttggccatcatttgaacaaaaatcccaagataattctagaactttggaatgactgaaatttctgattttgaagacataattaggcacaacaatgcatatttatctagaggggagagaaaggaaatccatatgtacaaaaagaagcatcagatttcttaaacacttaaggaaaaaaaatacaacaatgaaaattagttcaacccaaccaaaatcaggctagagaagggtgtggaaaaagggatggagggggagagaaagagagaaaaaaacaatatatagggaagctattagaaagtgctcatattgatggataatctaaaattataaaatacagaaaatgattatcctgttccatgtcaaaggatggtaagcaaatttaggaagcattttctatttaaaataatataaatagagtaccaaggtgggcaaattaaaataaataatggataaataaatattcagaaacagtaacactgtggtgaaacttattaaagataaaaaatacaaatatttctataaagatggaagacagttcccaccaagaatatataaggaaaatgaaacctttttatctagcagcacagctttgaagtatatatcacatacgctattcaaaatacaagaaacagaaaatgtataatattttcagtcattattgaaataaattttagcagttctccattatgctaccaaaactctcaatttcaaaaagaataaaatgtagagggcacacctatgtatagccatgtgataatattataaatatacaacaatgtgaacatgtcctaaaataatccaatggaaaattaaagacaaaaaggttattttgcatggctcattcaataaaagggaattgaaacgtgaactcacattttcttgggacgtcaacaacaaagccactcataccaaaagctatgggttatggcaaaagtggtgctgatagaaaatttactaatatattcatttctcagatatccattcagcacctaccatgagccaggcattattcttggtgttaatatagatatatttagatgaatattattcaggtagaaagtaccaacaataaaatggacagattttaaatgttcaggtaaatgagttttgacagttatatacactcacgtaaccaccacttacaataataatatacaacatttccactgtggcaaaatgtcccgtcatgctccttctcactctgtcatatttttggacaaacaactgtggttctgatttctaacatcatagatgagttttacatgttctttgacttcacacgtatgttatcagataatacatattttttattattatacttttaagttctggggtacatgtgcagaatgtgcagatttgtcacatgggtataacacatgctatggtggtttgctacacccatcaacctgtcacctacattaggtatttctcctaatgctatccctcccctagccctccacctcccgacaggccctggtgtatggtgtactatgcagtcataaaaaaggatgagttcatgtcctatgcagggacatggatgaagctggaaaccatcattctcagcaaactatcacaagaacagaaaaccaaacacagtatgttctcactgataagtggaagttgaacaagggagttgaacgaggagaacacatgaacatagggaggggaatatgtactttttggatcagttttctttttcaaacaatgtctgtgacgttcacccatgttgttttatgtatcagctgcaattttttaagtttaaattctatttatttctttttttaagaatttattttttaaaaaattggagtcggggtacatgcacaggtttgttacaaggtgatattgctagatgctgaagtttgaggtggatggtcctgtcacccaagtagtgagcatagtacccaatatcttctctcgcttccccgtctaggacccagtggctattgtttccatcttcatgtccatgagtattcaatgtttagctcccacttacaagcgggaatatgcagtatttggttttctgttactataataatttgcttaggataatggcttccagctgcatctatgtggctgcaaaggacataattttattcttttatatagctgtatagtattccgtggtgtatatgtaccatattttatttatccaatccacctttgatgtgcacctaagttgaatccttgactttgttattgtgaacagtgctgcagtgaacatacgaatgcacgtgtctttttggctgaatagtttattttcctttaggtatatcctagtaatagaattgctgggtcaaaatgtagttttatgttctttgacagatctctgaactgtttttcacaatggctgaactaatttgcattctcaccaacagtgtataagcattccctttcctccacagcctcaccagcatctgttaaattttgactttttaacaaatgccattctgacaggcgtgaaattgtgtctcatactcattttgatttgcatttctccgatgattagtaatatggagcattttttcatattttggatgcttatacatcttcttttgagaagtgtctgttcatgtcctttgtcgatatttaaattgaattacttgctttatgcttgttgatttgtttaatcaattacaccaaaataaaaaattaacaaatggacctaatcaaactaaagagctactgcacagcaaaagaaattattaagagagcaaacaacctatagaaagtgagaaaatatttgcaaactgtgcatcaaacaaaggcctaatacccagaatttacaagatacttaaatcaacaagttctgtgtttttaattgctgagaataaagcatttatgattgcattgtgtggatatactacagtatgtttgtccattcacctgctaatatacatttggattgtttccagttggcgatgattaccaataaaactgctaggaacatttgtatacaggtattttagtggatagtatgcttttatttctcttgggtaaatgcctagaagtgaaattattgggttgtagggtaagttaatatataacttcatatgaaactgccaaattgttttactaagtaactgtaatgcatcttctttgttctaaatttggaaaacatacgaatatatatatatatatatatatatatatatatatatacacacacacatatatatatacacacacatatatatatatatgtgaaaaggagaaaagaaaatctttctgtgcccatatcagagataaaatctctacccatatccagagataactattagcattttggtgaatttccattcattcattctcagtctctccttttatctctccttcctctccctcctactcttgctttatcctcatttcctctctctctctctctctctccttacacacacacacacacacacacacacacacacacatatatgtgcgtgtgtgcatatcaactctaaatttagatcatattcatagaaacataacaaaaatttgatcatactctatatatgggtttaatattccatatttattgaatttattatgaatttcccacgttttaaatttacctttaaaagtatgaaactttagctcttccccctttatcaagtacccattttttaatattacatcattatacaacccccttacattgaatttttaacaaattttattatttgcctaatatttcctattagcttcatgagggttgccttgtcgctgttttcccagtacctaagggctagcaagtattaagtttgccattaataattatacaataatttcgacatttgtatttaaagaaacatcacctcaagtatattttattttaaaaaatttaagggaaccggccgggcgtgggggctcatgcctgtaatcccagcactatgggaggccaaagtgggtggatcacctgaggtcaggagtttgagacaagcctgaccaatatggtgaaaccatgtctctactaaaaaataaataaataaataaataaaattagccaggcatggtggtgggcgcctgtagtcccagctactcgggaggctgagacaggagaattgcctgaacctgggaggtggaggttgcaataagccaagatcgtgtcactgcactccagcctgggcgacagagtgagactctgtctcaaaaaaaaaaaaaaaaaaaaaaatatgagggaaccgtgtaatgtggtgtatcacatttatggatttgtgtatgctgaaccatctttggattccagggatatatatcacttgttagtggtgaatgatccttttaatgtgtccttgaatttgctttgctagtatgatgtttaggacttttgaatctatattcatcagggataatgaccctgtaattttcttttgtttggctttggtatcaggataatgctgtcctcataagatgagtttggaagtgttactgcctctgtagttttttgaaagagtttgatagggttgccataatattttttcttttgaactttaattttaggttcaaggggtacacgtgcaggtttgttacattggtaaattgcatattgtggaggtttgatatacagataaatttgtacccaggtgaacagcataatacctgataggtagttcagtcctcaccctccttccaacctccaccctcaactagtctcagtgtctgttgtttccttctttgagtccatgtgtgctcaatgtttagccctcacttataagtaaaaacacgttgtatttagctttctgttcctgcattaattctctcaggataatggcctccagcatttcatgtctttgctattgttttttaaatgcttggtagaattcataagtaaagccatcagctcctgagcttttctttgatgggagattagttcattattaattcaatgtcctttctcatttagaatctgttcacattttctattttttaaagattcagtcttggtaagtggtatgtttctaggaattcatccatttcttctaggttatccaatttgttgtgtacaattgtttttggaagtctcctgtcatccttcatatttctgtagtatcagttttaatgtaccactttttgtttctaattttatttattttaattttctctttttgtttcttagtctagctaaagaaggtttttctattttgtttatctttatttaaatagaaagctaaggtttttctattttgtttatctttaaaaaccaactcttaattttttgaacttttctattgttttttctagtcttcattttatttttttctgctctgattctttgttattttatttcttatactaactttgagtttagtgtgttctatttttttgcttctttaaccgttatagctaggttttttatttgaggtctttctgttttcttcatgtaggtttttatcactataaacttccctcttataactggttttgctgcatcccatacgttttgatatattgtatttccatcgctcttcatctcagtatatatttacatttttttaaatttcatgtttgatccattggttgttcaggagtgtgttgtttaattgccacatatttttagatttttaaaaattcctcttattattgatttctagtttcgtgccattgtggtcagaaaagatacttgacataatttcagtcttaagtttattaaagcttgtcttttgcctaatttttgatttatactggagaaagtttcaggtgcgcttgagaatgtatattctatggctattgaatggaatgttctgtatatgtctgttaggactgtttggtctacactgtagttcaaacccaatagtttttattgattctttttctggattatctatacattgttgaaaattaggcattgaaggtgattatttttgtattgttgtctatctctccattcagatcaattaatttttaatatatatttaggtactgtgatgttgggtgtgtatatatttacaattttatttcctcttgatgaattgacccttttatcattatcaaacaacttttgtctttttgtacagtttttgacataaattctattttatctgatataagtatagctatttctgctgtttgtttctatttgaatagaatatctctttttccatgctttcacaggtatgtctctaaatctggtgtgagtctcttgtaggcagtatatagacagctcaccttgttaatccatttagccactctgcattttgattggagaatataatctatgtgaattcaatgtaagttttgttagatacggacttattattgctattttgataattgtgtttggatgttttgttgacattccttatttttctctttctgcctccatatttctgtaatagtatgctttaatttcatttttgttatctttttttgcatctaccataggtttttgctttatggttaccctgaggtttacatatacaatattataagtcatttaagctgataacattctaattccaatggcacataagcattctagacttttacttttcccaattttatgtttttgatggcacaatgtgtatatttttatattgcatatttattcacaaattattgtagctatagttatttaatttgttttgtcttttaactttatactagagatctaagtgatttacataccaccattaaagtattagaatattctgtttttgactatttatctgtatttgaatatttatttactttcaccagtgatttttatacttttataagatttcatgttaccaattagcattctttcatttcagcttggaaaatttcctttagcatttcttgtaaggcagatctagtaatgatgaactacatcagctcttgtttgtctggaagtctttttctctccttcatttctgaacaatagctttgccagaaaaagtaatcttgtttggcagttttttgtttcagcacgttcttcctgtctcctgacctgcaaagtttctgccaagaaatccagatagccttatagtcatttccttgtatgtgaagaaccacttttctcttatctttttaatactctttgaagactatattttttctttttttaaagtttggttataatatattgtggtgtactttcatttggtttgaatcttattgcattcctttgagcttgatgtacatacacgtttgtatcttcttccagatttggggagttttcagtcaatattcgttaaatctttccctttatttatctgttctctttctggaacccctataatgcaaagttagctcttttgatggtgccctataaatcccctaggctttctttatttttattctttttttcttttttatccttcgcctagatattttacaattacatctcttaagagttcacagattcttccttctccttagtcaattctgctattgatgctttttatttgcatttttcatttcttatattgaattcttcaactgcagaatttcactctttttaaaattatttctatctctatattgaacttctcaattttgtgtgtattatatttctgattttgttcatttgtacatctgtgtttttttggaagttgctgaacttccttaaagcacttattctgaattctttgtcagacaattcatagatctccttgtccctggggccagttactggaaaattattgtattcctgtggtggtgtcatgtttccttgattttcatgttttgtgttgccttgattgagatctgtgcttttgattcatccattatctcttcttgactttgtggactgattttagtgggaaagactttcccctataggtgggtgcaagggaacttgttggatgaggtgttgtggtcatggctctggtgaaaccacagtagcataatccccatggagctctactctctgagactggcatcaaagaagattgtaggagtcctcagcagccaagcctatgggtgtctgcagcagcaacaaaggctgatgacgtcttcaatggtagtggcttctgagattctcctaataacattttctcccacagggaatgtagtggctgagtggatcccttttgtccccaaatcacgcttgcagatgtacttcagtggtgatggcactagtgtctgatgtacaatgcctgtggaatagcaacagagctaaggtatgaagtgtgggcatgcatagaaggatgatggctttggggtctgaggaagcagtggcaccccatttccatgtttttaacagtatgtgatgcatgggtgcttgcattgtggacatggagccagggtctggagtacaggttggtgcagagctactgctgctctgggaaccagagtaagaagacacttgctctagtagtggctctgatgtctgtggtgcaagtagttgcagcatggtttcagagccagtgtctaaaatgtaggaacttatgcatcaataatggggtcaggtgcacgtgctaagtcactctgcagctggcatagctgtccaaggcacatgtgctcacagagcagcagcagcagagacagggactatagcataggagaacacagagtaaccatgattctgaggcctggggcagtgctatttcacggtggcactagcatcagtttctgagccataggaatttgtggtgtagttatggactttgattctggagtgcacacacgtggagcagctgcggtcccatggtctgggtaatgcatgttgctgggacatgcattggggtgtgcaccattcattggtggtggccctggttctggggtagcacaacaatgtcttcttcttagggggcataatactgtgtctacttctctgtgggttccatagtggtaatggctgctggttacttcagcagagaatgctgctcttggcacatgccatatgattgatactgatagtctccaaactggctgtctccatatttctcacatatgctggtctccccagtgatcctttctgtgaagtactctctattttattgatccattgtgttgttgctgatccttaattgaatccttcatccctcccaaggctattatttttgttggatagctgtctaattgctcttctttgtgtgagaatgaaggcttgtatcttatgcttcaccatattgttgatattgctagctatacgtttttaaataaagtgtctaagcctcctctgaatcagttttactagctactctctcaatttattccctcttcagctgtattcttattctttcatattactatttttctagagaaagcatggcattaagaaaatgtacggaatgaaaaaaaatagcatacaagggcatggatttccacgtactcagaagagttgtagaatgatgcaggaaatatatacctagaattttaccctatgattctgagacagagtattacaacctcagcattatggtcattttcaactaggtaattgttgggtggaaattttctgttcattttagggtatttagcagcattcctggcctacattcactagatgcctgtagcaccctcccacaaggcatagaaataaaataatgacaattgccagatgttccctgtgaggaagataaaaattgtcctcagctgagaacaattgttctgatgtaacaccactctcagacaacagtgcaataaaaatagagatcaataccaagaatatctctgaaaactatacaattacatggaaatgtcataatcagtgcctgaatgacttttgggtaatcaatgaaattaaggggaaaaatcaagaaattattaaaacgaatgaaacaaaagaaacaacatgtctgaatttctgggacactgctaaagcagtaataggaaagtttatagttctaaatccctgcatcaaaaggaaagatctaaaattaacaacctaacattagacctagaggaattagaaaaacaagagaatatcaaccataaagctaccagatggaaatgaagaaccataatcagagctaaactgaatgaaattgagacatgaaaaactgtgcaaaagatcaatgaaactaaaagtttactattgtaaaggataaataagattgatagaccactagctatactaataaagaaaaaagagagaagattcaaataatcgcaagcagaaaaggcaaaggagtcattaccaccaaccctacagaaacacaaaataccctcaatgacagttatgaacacctccatccagataaattagaaaacctagaagaaatggagaaattcccggaaacatacaacctcctaagattgaatcagaaagaaaaggaaacccccaaaagaccaatgggttccaaaattgagtgagtgataaaaacctaccaaccagaaaaaagccaaaggccagacagattcacagcccaattctaccagatgtataacaaagagctggtaccaatccttctgaaactatactaaaagactgaggagaaaggactcctcccttactcattctgcaaggccagcatcattctgataatgaaacctggcagagacacagtgaaaaaggaaaatgtcaggtcaatatctctgatgaacatagaggcaaaaattcttaacaaaatactagtagaaccaaatttaaacagaactaaaaacaaaatacacatgattctcttaatagatgcacacaaagcttttgataaaattccatatccattcatgttaaaaaccctcaaccaactacatattgaaggaacatacctcaaaataataggagccttctatagcaaacccacagtcaatgtcatactgaacaggaaggaagcattctctttaagagttggaacaagacaatgatgaccactctcaccacacctactcagtatagttctggaagtcctagccagagcaatcaggcaagagaaagaaataaaaagcatcaacttagagaggaagtcaaattatttccctttttagacatatgattctatacctaggaaactcaatagtgtctatccaaaggctcctagaaattataagcaacttcagcaatgtttctggatacaaaatccacatacaaaaatcactagcatttctataagccaatgacattggctgatagccaaatcaagaacattatccaggtcagatgtggtggttcatgcctataatcccagcacttcaggaggccgaggcaggcagatcatctgaagcaggagttcaagatcagcctggccaacatggtgaaaccctgtgtctactaaaaatataaaaaagttagccaggcatggtggcaggctcctgtaatcccagttacttgggaggctgaggcaggagaattgctagaacctgggaggcagaggctgcagttagccaagattgcaccattgcactccagcctgggcaacaagagcaaaactccatctcaaaaaaaaaaaaaaaaaaaaaaagaatgttatccaattcataatagccaaaaaaagagtaaaatatctagggatacagctaaccagagagatgaaagatctctaccacaaaaattacaaaatactgctgaaagaattcagaggtcacacaaataaatagaaaaacattctatgttcatgaataaaaataattaatatctttaaaatgaccatacagcccaaagcaattggcttcaatgctatttttatcaaaataccaatgagatattgtcatggaataagaaaaactattgtaaaattcatatggaacaacaacaaaaaaactaaatagccaaagcaatcctcagcaaaaaaataaaaataaaaaaataaaataaataaaaaataaacaacccagagacatcacactacccaatatcaaactgtacttcaaagttagagtaatcaaaacagtatgatattagtacaaaaacagacatgtagagaccaatggaacagaatagagagcccaaaaacaatgccacacgcctacaaccacctgatcttggacagagttaacaacaacaagcaatggggaagggcctctctatttaataaacagtgctggaataaatggctgccaaaatgccaaagcttgaaaccaggctccttcctttcattatatctaaaaatcacatcaatattaatgaaagacttaaatgtaaaatttaaaactatagaaaccctagtagaaaacctaggaaataccattctggatataggccctggcaaaaattgtatgacaaagacttaaaaagcaattgcaacaaaggcaaaatttgacaagtgggacctaactaaactatagagcttctgcacaataaaagaaactatcaacagagcagagagacagcctaccgaatggaagaaaatatttacaaactttacatcttattaaagtctactatccagaatccctgaggaacttaaaccaatcagcaagcaaaaaacaaccacattaaaaaatgggcaaaggacatcaacaaacatttttgaaaagaagacgtacatgtggacaacaagcataggaaaaaaatgctcaagattactaatcattagagaaatgaaaatcaaaaccacaattagatattatctaacaccagtcagattcgtgattattaaaatgtcaaaaataacagatgatggcaacattgcagagaaacgggaatgcttatacactgctgataggaatgtaaattcgttcagccattgtggaaagcagcttgatgatttcacaaataacttaaaaccttaagtaccatttgacccagcaatcccattattgggtatttatccaaaataatataaatctttctaccattaggacacattaatgcgtatattcatcacagcattattcacaatggcaaaatcatggaatcaacataagtgaccatcaacaggagattggagaaagaaaatatgatacatatacaccatggaatactatgcagccatagaagagaacaagatcatgtcctttgcagcatcatggatggtgctggtggtcaagatcctaagcaaactaattcaggaacagaaaatcaaatactacgtcttctcacttataagtggaagctaaacattgagtacacatgaacacaaagaagggaaaaacagatactacggccttcttgaaggtggagggtgggagaaggcagaggattgaaaaaccttttgagtagtgtgcttattagcagtagtatgcttattgctagtataatacctatcaaatactatgcttattagtaaatactatactagtaataagcatactactggtaataagcatatgataagcatactattagcaatatacatatgatgaaataatgtgcataccaaatccttgtgacaggcaattcgtctatataaccatcttttatatgtacccctgaacctaaaataaaattttttaaaatgttttagctaaatagtgaatctcaggttattatatttaccaacgagaaaaaaataattatcttctcattaactaagaagcctttaaaagaaagtatggtcaattctaactggattctgcaaatgattctaaataattacatctaaggaaatagcataaaataagaaatgtacattttaaattcatatacatattcattcttactaatattatctgttgatatcctttatattttcagaacacagtagctggccactgctttcaattgtaaattcaaaattaagtataaaaataccatttgattcaaagtttataggttgagaaaggagtggtataattacatatagtgattatagtacaagttaatatatatttattagttaagagtttactatatagaatacatttcctttctcctttattcatgtacagtcatgcatcacttaacagggataaattttgagaaatgtgcccttaagcaattttgtggtgtaaacatcatagaatgtatttatacaaacctggatggtatagcctactacacacctaggccaggtggtacagcctattgctcccaggatgcaaacctgtatggcatgttccattattgaatactgtaggcaactgtaatacagtagtcagcatttgtgtatctaaacatatctaaacctagaaaaagtacagtagaaatatgacataaaagataaaaaacagtacacctgtatatggcacttaccatcagtggagcttgcaggattggaagttgctctgggtgagtcagtgagttagtggatgaaattgaaggcctagtacattactgtgcactactgtagactttataaacactatacacttagcctacagtaaacataaataatttattcaataataaattaaccttagcttaatttaactattttttactttataaaattttatctttttaactactggatgttttaatagcacttagtttaaaaaacacacacattgtatagctgtacaaaaacatttttctttatatccttattctataagctttttttagtagttttaaacttttatctttctacttttacaactttttgctaagaaggaagatacaaccacacacattagcctaggcctacagagggtcaggatcatcaatatcaccaactttcatctccacatcattttccactggcaggtcttcagggacaataggacacatggagttgtcatctccaatgataacaatgccttctggaatttcatgaagaacctgcctgagggagtcttagagttaacttcgtttttctaatataagtagaagaagtatactccaaaataatgataaaaggtatattagagtaagtactaagcaataggaatattttcactccattataatcttatgacatcatcatcttatatgtggtctgtcaatgaccaaaatattgctatgcagtgcatgactgtatttctttatccacttattagtataaatctatgagttgtttttttatgtagtgagttgtaatatcatattgtactagtttttttgactaatgatacaaattttttttttctgtgctcattgaaaatttggatatcttcttttatggagtaccttttcaatcttgtgccatttttgtatttgtggtttgtctttttactttttacatgtagaggttttttcagtatattttgcatgtgattcctttcattcatagtataaatgagaaaggaaaaatagtgctatgttgattcagaaaaagtagatttattctagctaggagaacatttagaaaactaaattcaaaataaaaaagcaccaatcaagaggattatttggtgtcactctttttccagaaggaaaagtggattatttaagaactttccatcttggatcttttcaaccttctcttcctaatatcaatctcttcattcctagtggctaatcctaggtctcattatctttcctccccctagtatttcaaaaacttgtagtgaaaagatttcagttgcttttcaattagtaatctaattgaaggctaggtatgatgaaccagatttataagtgacactaagagtagcttttcaaatcatattattagataaaaaagcaacttgtagagtactgcctgcaataagataccatttatgtaaagcaaacacatttatatattttaagtgtctatgaaacactcgtaataatgacagtggcatcttttaggaaaaggcagtatgctgatgaaagagaccaaggttagtgttgtagaacaaggtatttaaaattgattgtagtattttactatttcattaattataatggattaaaatgctttttatgtaactaataatgtatatgtaacgagagctacagagaggtggcatcatcaacatgacagaataggaaacatcaataaatggccactccactgaaaaaaaacattcagctggcaacaacggacaaaataatcttttttataactctggaatctaaacagatacagcaaacaggggagtgcttaatgaagaaagaagtagctaaattttggtaagaaagtgtggtaattttgtttatttacctacctaccactctctatgccctagctcagcaagctgcagttcttgtgtggcttcctggtgccacgggataatatggatctttttcttaaaatactgtggatgtgcattttgacttttctggagattccttgaatctgatcttagtttcacacaccacctcaggctagagtgctcgctggtaaatgtctgatgaaagcatttaaagacatatgctacttatagatgacttggacagttgatgcaagaaaaagcaagcattagacagactgaaaactgtgaagaaaaaggctaagaagaaagattcttggggaaatgaggtttagaaaggctaccatatatactagggaatgtggagtgcaattcatatacctagggacagatatatgctcagaaaagacatgagaggaatctaaactcagatttttggttgatctttaaggtctgaactaacaggaggtggagattaacgcagggttgcatgttgactggcttagcattgatggtgtacccagataaaagtcaatttgaaaagactgagagagctttttctctctgttagccccaggctctcacacgtatctctgacagatcactggctgaccagtgagatatataaaaagagacttcagtgaccacacctaaaaaataatataaattttgcaaacctacttagtaaaagctactaaacaactggatggtcacagccgtcaacaatcaatggcaataaaccctggggagggggcataatctgatttctagaggtactacattctaatatttaatatatgcagcttataaacaaaaataaaaggcatacaagtatggtatgtaaagtatagaaagtatgattaattcaccggggaagaaacccaaacctgacagaaataatccatgaagaagactataaattaaatatactaaactaacttttttttattattacactttaagttctgggatacatgtgcagaatgtgctggtttgttacataggtatacatgtgcaatggtggtttgcggcacccatcaacccgtaatctacattaggtatttctcctaatgctatctttcctctagcctcccactccctgagaggccctggtgtgtaatgttcccctccctgtgtccatgtgttctcattgttcaactcccacttatgagtgagaacatgcagtatttggttttctgttcgtgtgttagtttgctgagaatgatggtttctagtgtcatccatctccctgcaaaggacatgaactcatccttttttatggctacatagtattccatggtgtatatgtgccacattttctttatccagtctatcattgatgagcatttgggttggtccaagtctttgctatggtgaacagtgctgcaataaccatacgtgtgcatgtgtctttatagtagagtgattcataatccttctggtatatacccagtaatgggattgctgggtcaaatggtatttctggttctagatccttgaggaatcgccacactgtcttccacaatggttgaactaatttatgcttctaccaacagtttagtagcattcctattactccacatcctcgccagcatctgttgtctcctgactttttaatgatcgccattctaactggcatgagatggtatctcattgtggttttgatttgcatttgtctagtgaccagtgatgatgagctttttttcatatgtttgttggctacataaatgtcttcttttgagaagtgtctgttcatatccttcacccaatttttgatggggttgtttatttcttgtaaatttgtttacattctgtgtagattctggatattagcccttagtcagatggataaattgcaaaaattttctcccattttgtaggttgcctgttcactctgataatagtttcttttgctgtgcagaagctctttagtttagttagatctcatttgtcaattttggcttttattgccattgcatttcgtgtttaagttatgaagcctttgctcatgactatctcctgaatggtattgcctaggttttcttctagggtttttatggttttgggtcttacgtttaagtctttaacccatcttgagttaatttttgtatatggtgtaaggaagggatccagttttagttttctgcatatggctagccagctttcccaacaccatttattaagtagggaatcctttccccattgcttgtttttgtcaggtttttcaaaaatcagattgttgtagatgtgtggtgttatttcagaggcctttgttctgttccattggtttatatatctgttttggaaccagtaccatgctgttttggttactgtagccttgtagtatagtttgaagacaggtagtgtgatgcctccagctttgttctttttgctttggattgtcttggctatatggattcttttttgtttccatatgaaatttaaagtagttttttctagttctgtgaagaaagtcaatggtagcttgatgggaatagcattgaatctataaattactttgggcagtatggccattttcacaatattgattcttcctatccatgagcatataatatttttccatttgtttgtgtcttctcctatttccttgagcagtggtttgtagttctccttgaagaggtcattcacgtcccttgtaagttgtattcctaggtattttattctcttggtagcatttgtgaatatgagttcactcgtcatttggctctctgtttgtctactattggtttaaagaaatgcttgtaatttttgcacattaattttgtatcctgagactttgctgaagttgcttatcagcttaaagagttttggggctgagatgatgaggttctctaaataaaccatcatgtcatctgcaaagagagacaatttggctttctctcttcttatttgaatactcttcatttctttctcttgcctgattgcccgggccagaatttccaatactatgttgaatagaagtggtgagagaggatatccttttcttgtgctggttttcaaagggaatgcttccagcttttgcccattcagtatgatactggctataggtttgtcataaatagctcttatttttttgagatacgttccaccaatacctagtgtattgagagtttttcacatgaaggggtgttgaattttattgaaggccttttctgcatctgttgagatgattatgtggtttttgtcattgtttctgtttatgtgatgcattaaatttattaatttgtgtatgttgaagtagccttgcatcccaggtataaagtcgacctgattgtcatggataagctttgtgatgtgctgctagattcagtttgccagtgtttaattaaggttttttggcattgatgttcatcagggatattggcctgaaattttgttttttttgttgtgcccctgccaggatttgatataagaatgaagctgggctcataaaatgagttagggaggagtacctctttttatattgtttggaatagtttcagaagcaatggtaccggctcctctttgtacctctggtggaattcagctgtgaatccatctggtcctgggctttatttgtttggtaggctactacgtactgcatcaatttcagaactttttattagtctattcagggattcgacttcttcctggtttggatttgggagggtttatgtgtccaggaagttatccatttcttctagattttatagtttatttgcgtagaggtgtttatagtattctctgatgatagtttgtatttctgtgagatcagtggtgatatccccttcatcattttctgttgtgtctatttgattcttgtctcttttcttctttattagtctggctagtggtctattttactaatcttttaaaaaaaaaaacatctcctggatttgttaatttttgaagggtttttcgtgtctctctctccttcagttctgcttttatcttcatcatttcttgtcttctgctagcttttgaatttgtttgctcttgcttctctagttcttttaattgtcatgttagagtgttgattttagatcatttcccctttctcctgtgggcatttaatgctgtaaatttccctctacacactgctttagctgtgtcccagagattctggtacattgtgtctttgttctcattggtttcaaagagcttatttatttctgccttaatttcgttatttacccagtagtcattcaggagcaggttgttcattttccatgtagttttgcggttttgagtgagtttcttaatcctgagttctagtttgattgcactgtggtctgagagacagtttgttatttttttcaaaaatccagctggattcattcatttttggaagggttttttgtgcctctatattctttagttctgctctgatcttagttatttcttgtcttctgctagctttttaatttgtttgctcttgcttctctagttcttttaattgggacgttaaggtgtgaatttgagatagttcccactttctgatgtgagcatttagtgctatgaattttcctcttaacactgctttagctgtttcccagagattctggaatgttgtgtctttgttctcattgatttcaaataacttatttatttctgccttaattttgttatttacccagtagtcattcaggagcaggttgttcggtttccatgtaattgtgtggttttgagtgagttttttaatcctgagttctaatttgatcgcactgtggtctgagagactgcttgttttgatttctattcttttgcatttgctgaggagtgttttactcacaattatgtggtagattttagaataagtgctatgtggcactaagagtgtatattctgttgatttggggtggagagttctgtagaagtctattagttccacttgttccagagctgagttcaagtcctaaatatccttgttaattttctgtctcattgatctgtctaatattgacagatgggtgttaaagtctcccagtattattgtgtgagaggctgtctctttaaattcacctccccttgaggtcccaagataacttggggatcctggacctgtcagaaagtgaaactctttactcacaataggtcaggaatcctgtatggaaactctgtagacaaggtatgagggcagttttcccaaggggcttttattggctctttaagtcaagtgtgtttccttaaagaaaagcacaccattacagtcaaagagttggtaaaaataaccagttcctccaatggcttcctgttgcaaatgcaaacattcttactgctcttttgcaaataactatattgccataagttaagaatactcacaaatagtttgcaaattctggataagtcaggtagagagaaacaaatatgctccaaatctcgtgcacaggagtataatttactcaattgccacaagctgtaaatagctcaatggaaaagttgttttgactctgaaaaacaaaacaaaggatcagcaaaaaagtcaaaaagggttacttcagtcttctgttagtccagatcatgtaggtaacttctgttctgcttgatattcatgaacattacagcttgctatgcgagtcctgatagttttttcctctattttagtgttacaatcttcaaaattatcagagccctgcattcaagaacacctgctagatttttctagcttattataaaaccactttctaaagaggaccaaaacaagacagcaattgtatgtggttgacaaaatgttttaaggcagtcacagtcaaagtcacaattgacaaggaaatttgttatctctttggcacatagtaatttaatataacaattataagtattacttataacctacactaagtcatatcaggaattttccataattttgaaacatataccaataacatatttatacagatacagcccaaagaaagccaaatacaatttcatgtttgacaatgcttcctgtatgatttttgtaccaaatacaccaaatttgtcatttttggactttagggaacttaatatttaaaagattaattaggtcagaaaaggacataactgataatttgattttggaaaatttgtcaaatatcaaaggtttaaaatgcttgatatcacaaaatagaatcacaggtgattgtaaaataagtcatttatttaaccaaagtaataactcagaaatttcaaaacaaaagttgaaaacctttattctttgagaaaggagacttaatttttcaaacagcaattcctaatacaaacagcatgtgttcaactaaatttgcttttcacaattttataaacaatctataaatttttaatcatcttgaccataagatattacatcttataatataagccttttataagcctttccataagtcttttataacctttaaaacctctattaaagagtggtttaatgcctcaagaaaaccttgttagtgtgacacaggcgcccatatgctggtcttgcatcagtgtgtctttgacattaatgattaatttatagagaaatcaaacttattttgtctcttgaaatccacccttaaaatctcatgcacctacttcttctgcaatagtccctgagccttgaggagttgaatacctttaatttttggccccttgtctcacaaatgtaatttcttttgattggcatcttctactgggtctgaagatgaggctttaactactatcagtgtcaagatttatcaggagtttgtgtccttttttaattgtacaacgactttaaaagcacacacagaaagttaaacagttaactcaaaaaagaagttttaatctcagttttttctaaggaaactaaagttagtaatgatggtataggaattatttcgataaagcataatatctgtttattaggccagttacacaaaggcaaaagaaagggccttctgccatatgactgctgttccttatgggggatattatgttgggagggtacataagatacatttgcttcagacctctaagagaaaactttttttttttaagtgtgaggccacaacagttaaaacccagaggaaaaaaaaaacttgtagtatctgaaaatgagttgaataataaagttattatttcaggcctttcaagggggagagaaagctgaaaacagcaagatgtaataaaagttaaactttgtgtaaaaaattataatgtcttgtaatttattaagaatcaagcaataccttaagaaaattttatagtttgaaccaattgtttaaagtgtttttttaaataaaaacccaatctctagaaagaccatgataattttctttaattatagacaacttagtcctattaaagttgtttccataaatcctctcattatgacttacacagaccatttagagcatgcttagactttctggtttctcctgaacatacctttttttctttaaactttcctactaaaaatacctctttatttctacaactttctttacatttcttttatttcctggttccttttaccttgttttatacataacctttacctaagcttagaattagacaaatattattcaccttttgaaaaggacacatattttttagaatgtttttctacagtatttttattggaaaatactaaattaatgaaatgttcattatttgatttaatgtaactttagattctaaattatgacttgtttgtctacaagtacttatcccattacatttacctaattattttattttagtggtttatcaagattatttatgaaaactgagacagtcatcatttaaagttataaaactgccgttgaaaaattataattgagacagtgaaaaagatctcacctaacccactccatcttgcttctaacctccaaggtgtttttgttcattcctgggtgtaggtctaactaactttagaaggaagttagtttatagtttagctttgaaacaaagataataacagtcatttgccaaaacaaacccccttcctgcctggggactagacttcctaaagtcacatgattacaagtaacagttattttacaacataatgcaagattctgacaccttatagtacttggtagggataactatgaagctgcttgatcagtaactgcaaagaaaaatgtttgctggaaattcttaagacacttctaatattttatcaataattttaaagctagcttaataaaaaatttacttaagtcatgtgcacttaaaaagcatttgggtttattaatttatgagtactccttaagacatcttgtggccaaaatgcaacaaaatacatatacatacacacaaacacacatatacacactcatacaaccaaagatcctatagcttatagcttttacttcagaactctagccatgagatactaatacgaactcattggtttgcaaaaacaataacaaaaagaaatggttggatgcaaacagtggattttatcttagtagaaaagtaacatcagctttaaagcatggagaaaagaaaatagaaaaaaaaagaggacttaggaactttatagtttgttgttcgaccttaggatttttgtttaacacaaactctaacaagttgcactgccagaaaaccaacagagtgccagaaagggggtcattatccttgttttcttctcattcttagattatttcccactttttctgttttttgtttgtttgtttgtttttattattattattatactttaagttttagggtacatgtgcacaatgtgcaggttagttacatatgtatacatgtgccatgctggtgtgctgcacccgttaactcatcatttagcattaggtatatctcctaatgctatccctccctgtttttgttttttcttaaaaggagaaactgacctgtggcttaaggtttttgtggagtgggtcaaagtgtgtgctggttgtgaccaggactccacagtgtgttaccaatgagtcattgctgccctcttatgtgtctcagtttctctctctggaggtctagcacctccagtagggcacagattgtagattgacgagctcccatatgtgcttcctggatgagcctttttaaaactaattttcctgggggttccctgtaggacgactgcatgtcattgggggtcaacccactagacactcccatgaggcccctggtcacccatgggtgccttttagctgggaagagcaaaatgctttttctttttggagctgtggaaactcggtctctcatttacctattaaaacaacagtacagttcctcacacaaatgtgcacaggcaaacgaaattgagactctttggggagaaaaatcagtgggggaaacccttgagaatgcatccttgaactagaagtaagattcttaaacaacttcctaggagagagagagaggaaaaaaaaaagcaacaaccaagactacttcctgtaaactgtcctcagccactgctaactttgtagctctcatcctccattacacacaccaaagtcaagtcctctcacagtacaaggtaatttctggtactcccaaagacaaagaggtcaggtaatgccatacaggaaagcagagctttagacctaaagagaatctgcccatgatacttgaaaatccacaaagaaaacagaacaccggaacggggtgagtggtgcctttgttctgagttatttaaggggtttgagttattagaagacttatctctagatttttcttggtactgaagatggcaaagggggaaggaggttgatatggtttgtctatgtccttacccaaatctcatcttgaattgtagtttccacaatccccatgtgttgtgagagggaccttgtgggagaaaacctcttggtgttccccatgctgttctcatgaaaatgagtgatttttcatgagatctgatggttttataagtgtctggcatttcccctgctggcacacattttctctcctgccaccctgtgaagaggtgccttctgccatgattataagtttactgaggcctccccagccatgcggaaccatgagtcaattaaacctctttcctttatacattacccagtccagggtatttcttcatagcagtgtgagaatagactaatgcagtaaattggtattgaggttgtggggtgctgctgtggagataacaaaaaatgtgaaaacaactttggaactgggtaacagacataggttggaacagtttggagggctcagaagaagatagaaagatgtgggaaagtttgtaacttcttacagacttgttgaacggttttgaccaaaatgctgatagtgatattaacaataaattccaggctgaggtggtctccaaaagagataaggaacttcttgggaactggagcaaaagtgacttactatgatttaaccaaaagacttctggcattttgccactgctttagagatctgtggaccttagaacttgggagagatgatttagggtatgtggtggaagaaatttctaaagggcaaagcattcagaggaagcagagcataaaagttttgaaaatttgaagcctgacaatgcaatagaaaagaaaagcccattttcaggtgaggagttcaagcctgctgcagaaattttcataagtaacaagaagccaaatgttaatcaccaagacaatgggaaaaatatctccagggcatgtcagagaccttcacagcttctcccatcacaggcccagagacctaggagggaaaaattgtttcctgggctgtgtccagggccctcctgctctgtgcagccttgggagatggtggccagctgcttcagctccagcagtggctaaaaaaggctaagatacagcttgggacattgcttcagaggatgcaagtcccaggccttcgtgttttccatgtggtgttgagcatgtgggtacacacaggtcaggaattgaggtttgagaacctctgcctacatttcagaggatgtatgaaaatgcctggatgtccaggaagaaggttggtgcagggatggagcccgtatggagaacctctgctagggcagtgtaaaagggaaatttggggttggagcccccacacggagtccccactgaggcactccctagtggagctgtgaaaagagggccactgtcttccagactccagaaaggtagatcaacccacagattgcaccaagtgcctggaaaaccacagacacttaatgccagcctgtgaaagcagccaggaagggggctttaccctgaaaagccacaggggtagagctgctcaaggccatgggagcccacctcttgcatcagcgtgacctggatgtgagacatggagtcaaaggagatcattttggaactttaaggtttagtgactacctattggatttcatacttgcatggggcctatagcccctttgttttggtcagtttctcccatttgaaatgagtatatttacccaatacctgtaaccccattgtatgtaggaagtaactaacttgcttttgattttataggctcataggtaaaagggacttgccttgtctcagatgagactttggacttggatttttgtgttaatgttggaataagttaaaactttgagggactgttagtaaggcatgattctgctttgaaatgtaaagacatgagatttgagcggggccagggatggaatgatatggtctggctgtgtccccacccagatctcattttgaattgtagttcccataatttccatgtgtcatgggagggactcagtgggaggtaattgaatcatgggggcagtttccttcatgttgttctcataatagtgactgagttctcacaagatctgagggttttataagcatctggcatttcttatgctggcactcattctctctcctgccacctttgtgaagaggtgccttctgccatgactataagttttctgaggcctccccagccatgtggaactgtgagtcaataaaaactcttttctttataaattacccagtttcaggtatttcttcacagcagtgtgagaacagactaatacagaggtatagggtggaagaaaaattaaccaaagaacatattttttaagatgggaaggaaacacagaaaccaagcacatgctttttgttgttgttgttgttgttgttgttgtttgttgctgtagtttttcccacttttgcagctgcaaggaattttagccaattcagagaggccttgttcaagttgtcctgcctttctggacaaaatcaatttacatcttaggtatatcgattgatgtctcatgtctcacaacttggttgggaccgagctgtgtcctgacccccttgcacacatgtcatcaggacctcctgaggctgtgtcatgggtgaatatccttaactttggcaaggtaaacttcctaaattgactgagaccagtctcagatatttgtggttcacttttggtaaccatggagggaataatttgaaattctcattctgatttgaccaagtcattcagatttggtcaaatctgacagagaaagactggaacaaacaacaacagacccaaaaatatgattactgggcactctaatggtaaggagaaattaagaccaaatgattgttaatcatagctttagccaagacgaaaccttattgtagctacttatgtggggatgggtctcaggctgaagagtgttctctaccattctagaagcaggaaaaaactcaaattcaccttctctgttggaagcaagttcaaattccaggaaggagttccctgccttctattgtcatggaagcagaaaaacttgcttttcttactggaagcaggtaaaactccaaaaaaaaggagttatacagcaaaataaactttagatctttgccaaatttggggagatcaggtattctctggagggggtgtgtccaggcctcagcatattgtcctattggttggatccataaagatagctcaagctggtatcaagcactgataggatattagccaaagttcaggggcacctccactcagaatccctccatggttaccaaatgtgaaccccaaatatccgagacaggtctcagtcaatttagaaagtttattttgccaaagttaaaaatgtgcacccatgacacagcctcaggaggtcctgatgatatgtgcccaaggtggttgggacacagcttggttttatacattttagggatatatgagacatcaatcaatatatgtaagatgtaaattgatttgtttcagaaaggcaagacaacttgaagttggggcaggggtttcaggtcatagatagataagagacagatggttgtattcttttaagtttctgattagcctttccaaaggaggcagtcagatatgcatttatctcagtgagcagagggatgactttgaatagaataggaggcatgattgcactaaatacttcccagattgacctttttaattttagcttagtgatttttgggtcccaaaatatattttcctttcacttgactaatcaggatttatctcaggcaggaagagaaaaggaaatggagaacattttaattaagcactgtacaaatcttaataaaatcagtgcatgtaatacactgcattaataaaatgtaggaagaaacacatgacatctcagttgacacctaaagagtatctgacaaaatccaacatgctttcatgtcaaaaacactcattaaactagtaaaaagaaaaaaaaaactggctcaacgtgacaaaagacatttatgaaaaacccagagctgacagtatactcaaaggttaaagaatgaatgctttcttcccaaaactaaaagaaagacaagaatatccatttttactacttctattcaacatagtactgtaaaatttagctagagctaattaggcaaggaaaggaaataaaatttatccaaataggataagatgaagtataactatctatattcagaggcggcgtgttttcatgtattaaataaaaacaaaaaaaaaatccaccaaaaatctactggccctagtaaacacattctgcaaagttacagggtacaaaatcaacacacgaaaaacatttgtgtttctatatactaaacattccaaatgaaaattaagaaaattctattacaatagcatgaagcagaaaaaaatagctagcaataaatttaatcaagatgttcaaagactcatttattaaaaatttcaaaacattgctaaagaaaattaatgaattgtaaataaacagaaaatattacgtatcataaaatgacaaacgtggtattgtcaaggtgtgaatactaccataaatgatctacaaattcaatgcaatctgtatcaaaatcttaatgaccattttagcagaaatgaaaaagctgattctcaaattcatatggaatttcaagagccccaaatagtcaaatcaatcctgcaaagaacaaagttggagaatttatacttcgttattccaaaacttactgtaaagttacaataatcaagtgttgtgcagttataaggatacacatatagtacaatgcgatagaactgaatcgccagaagtaaacccataaatctatggtcaattgactttcatcaagggtaccaagaccattcagtgaggaaagaattttttcttcaacagatgacactgagaaaattttatatctacataaaaacataaatttggatgcctatatcatacaatatacacaaaatacctcaaaacaaattgataacataaatattacagctatgattttataaaactcttagaagaaaccatagggataaatatttacgattttgaattttgcattggactcagatataacaccaaaagtatgaaaaacaatgaaaaatagataaatttgaacccatcaaaattaaatacatttgtgcatcaaaagatgttatcaagaaagtaaaaacacaatatagacaatgaaaaggaatatttccaaattttatatctgataatgttccagtatccagaatatataaagaatttttgtaattcagcaacaaaaaccaaacaacccaattaaaaaattagaaaagcattcgaatggaaatttttccaaaaacgatagataaatgggcaataagcacatggaaagaagtgtaacatcactagacattagaggatataaagccaaaccacaattagtcacttcacatctataagaatggctataataataataatactttttacatttttaatttatatggatacataatagttttacatatttgtggggcacatgtgatgttttgatacaaacacataatgtctaatgatcaaatcagggtgattgggatattctttacctcaaaaatatatcttttttttgtgctaggaacattccaattccactcctctagttattttgaaatatacaacaaattattgttaactacagtcaccctattgtccaaatagtggatcctatttaacctatctaactgtatttttttactcatcaatcattccccactttttccccccatctcctcgtgacccttcacaaactctagcaactatcattctactctctatctccacgagttcaatttttcttcagctcctatctatgagtgagaaaatgtgatatttttctttctgtgcctggcttatttcacttatgtcctgtagttcaatctgtgttgttgcaaatgtcatgattgtattatttttatggctgaatatttcatggggtagcacatttttttaatccattcatctgttgatacacacaggtagattctataacttggctattgtgaatagtgctgtaaaaaacatgggagtgtatatatctattcaatatgcttatttcctttctttacatatatactcttagtgtctgtattaccatctacagtgtaaaagggctcccttttctccatatcctcaccagcatttgttgtttctgttttctttttgagaaaagccattttaactggggtgacatgatatttcattgtacatttctgtgataatttgtgattttcaacatttttaagacacctgttagcgacttgtatatcaccttttgataaatgtttattcatatattttgttcatttgataccaggattatttggtttctgctatgttttgattttgtttttgtttttttgtttttgtttttgttttgatattgagttgagtttctcgtatattctggtcattattcctttgtaagttgaacagtcagcaagtattttttcttattctgtagattatctcttcatttattaattatttccgtggctatgcaaaagcttattagcttgatgtgatcccatttgtccattttaagtttggttgcctatgcttttgcagtcttactcaagcaatatttgcccagaccaatgtccccatgtatttgccctatgtattgtctcactagtttcatagtttcatgtcttacagttaagtacttaatcaagtatttctttgatttttgcatgtggtgagagataggcatctagtttcattctttggcaaatatatatccaggttcctataacaatttattgaaaagtctattccttcccaaatatatgcttttggcatctttgtcaagaatgagttgattctaaatgtgtgaatttatttatgtattctatattttcttctgctggattatatgtctgtttctaatggcagtaacacgatgttttagttactatagttttgtactacaatttggtttttattttttttccataggttttttaggaacaggtgctatttggttacatgagtaagttctttagtggtgatttgtgagattttggtgcacccatcacccgaacagtatactctgaacccaatttgtagtcttttatccctcaccctccgcccaccctttccctcaagtccccgaagtccgttgtatcattcttttgacatttcatcctcatagcttagctcccacatatgagtgagaacatacgatgtttcgttttccattcctgagttacttcacttagaataatagtttccagtttcatccaggttgctgtgaatgccattaattcattaatgtttatggctgagtagtacttgattttatatatatatatatatatatatatatatatatatatatatatgccataatttctttatctactcattgatggatgggcatttgggctggttccatatttttgcagttgcgaattgtgctgctataaacatgggtgtgcaagtatcttttttgtgtaatgacttattttcctttgggtagatacccagtagtgggattgctggatcaaatggtagttatatgtttagttctttaaggaatctccacactgctttccatcgtggttgtactagtttacattcccaacagcagcacagtgtagaagtgttcccttttcaccacatccatccacgtcagcatctattattttttaattttttgattatggccattcttgcaggagtaaggtggtattgcattgtggttctgatttgcatttacctgatcattagtgatgtcgagcattttttcatatgtttgttggccatttgtatgtcttcttttgagaattgtctattcatatccttagcccactttttgatgggattgcttgttcttttcttgctaatttgtttgagttcctgtagattctggatattagtctcttgtcggatgtagagattgtgaagctattctctcactctgtgggttctccgtttactctgctgactgtttctttttctgtgcagtatctctttagtttaataaagtcccacctatttatctttgttattgtttcatttccttttgggttcttggttatgaaatcattggctaagccaatgtctagaagggttttatcaatgttatattctagaattttcagagtttctgatcttagatttcagtctttgatccaccttgatttttgtgtaaggtgagagatgaacatccagttttattctcctacatgtggcttgccaattatcccagcatcatttgttgaatagggtgtccttttcccacttcatgtttttgtttgctttgtcaaagatcagtcagctgtaaggatttgggtttatttctgggttctctattctgttccattggtctgtgtgcctatttttataccagtaccatgccgctttggtgactatggccttctggtatagtttgaagccagataatgtgatgcctccacatttgtttttttttttttttgcttgatcttgctttggctttctgtgctcttttttgtttccatatgaattttacgattgttttttctagttctgtgaagaacgatgatggtgttttgatgggaattgcactgaatttgcttttgacagaatggtcattttcaaaatattgattctacccatccatgatcataggatgtgtttccatttgtttgtgtcatctatgatttccttcagcagtgttttgtagttttccttgtagagctctttcacctctctggttaggtacattcctaagtattttatttatttattttttgcagctatcgtaaaagaggtagaattcttgatttgattctcagcttgatcactgctggtgtatagcagaactactgatttgtgtaaattatttttttgtatccagtagctttgctgaatttatttatcagttctgggagctttttggaggagtttttagtgttttctaggcacacgatcatatcatcagcaaacagtgacagtttgacttcctcttcactgattgggatgccctttctttctttctcttgtctgacttctgtggttagaacttcaagtactatgttgaagaggagtagtgagagtgggcatccttgtcttgttccagttctcagagagaatgctgtcaactttttcccattcagtattatgttggctttgggtttgccatagatcgcttttattacattgaggtatgtcccttgcatgctgattttgctgagtgttttaatcatacagagatgctggactttgtcaaatgctttttctgcatctattgagatgatcatgtgattttttgtttttaattctgtttatgtgatgtatcacattattgacttgtatatgttaaaacatccctgcatttctgatatgaggagtcttcaaaaccatgcgaatacatggaaattaaataacctgctcctgtacgatctttgggtcaacaatgaaatcaagatggatattaaaaaattatttgaactgaatgataatagtgacaaaacctatcaaaacctctgggatacagcaaaggcggtgctaggaggaaagtttatagccttaaatgtctacatcaagaaatttgaaagagcacaaatagacaatctaaggtcctcaaggaactagagaaacaataacaaacagaatccaaacccagcagaggaaaagaaatacccaagctcagattagaactaaaatggaaaaaaaaagtataaaagataaatgaaacaaaagattatttgaaaagataaataaaattgatataccatttgcaagatttaccaaaaaaaaagaaagaagatccaaaatactcaattagaaacaaaatggcggactgtcagaaacaactgacactgcagaaatgcagatgatcattcaaggattctgtgaatatctttacgtgtataaaccagaaaacctggaggagatgaataaaatcccagaaatatgcaaccctcccagattaagtcaggaagaattagaaaccctgaaaggaccaataacatgcagcaagattgaaatggtaataaaaatttgccaacaaaagaaaagtccaggaccagagagattcacagctgaattctatcagacattcaaagaagaaatggtaccaatcctattgacactattccacaagaaagagaaagaggaaatcctctctaaatcattctatgaatccggtatcaccctaataccaaaactaggaacggacataacaaaaacagaaaactacaggccaatattcctggtgaacacagatgcaaaatttcttaacaaaataccaactaaccgaatctaacagcatatcaaaacgataatcctcatgattgagtggatttcataccatgcaagcaaagatggttagacatacgcccgttgataaatgtgatacaccccataaacagaattaaaaacaaatatcacctgatcatccaaatagatgcagaaaaagcttttgacaaagtccagtatctcttcgtgattaaaacagcaaaatcggcatataagggacataccttaatataataaaagccatctatgacagacccacagccaacataatactgagtagaaaaacgttgaaagcattccctttgataactgcaacaagacagtgatgtccactcttaccacttttattcaacatattactgtaagtcctagccagagctatcagacaacagtaagaaatttagtataatttgaagtcagttagtgtgatgtgtccaggtttgttctatttgattaggattcctttgactactctaggtcttttgtggttatacatcaattttgaggttattttttctatttctgtcatgaatgtcattggtattttgataggggttgcaaggaatgtgtaaattgctttcgtaacatggacattttaacaattttgatttttctaatccagaaaattacaggtatttatgagaattagagaaatgttagtctttgtataagatgatgggaatgtaaaatgttttacatgctgtgaagcaattttgtgtgtgatatggctgtatccccacaaaaatcccatctttattgccgctcccgtaattcccacgtgttgtagaagggatgtggtgggaggtaattgaatcatgggggcaggtttttctcatgttcttcccatgatagtgaataagtttcacgagatttgatggttttataaagggcagttcccctgcacatgctcccttgcctgccaccacgcaagtcatacctttttccctcctttgccttccgccatgattatgaggcctcccaaaccatgtggaactgttagtccattaaacctcttttttctttataaattacccagtcttaggtatttcttcatggcagtatgaaaatggactaatacaatgtgctttatggtgattcttcaaaaagttaaacatagaattatcatatgacccaacagttctccttttgaatgtatatctctaagaattgaaaacaaatactgaaagaaattcttatacgtaaatgttcaataaaactctgcacaagagcaaagaggtgaaaacaatccatccatcaatgggtgaatggataaacaacttgtagcatatttatgcaatgaaatattttgtcataaaaaggaatgaattactggcacataccacaacatggatgaaactcaaaaacattatgctatttgaaagaatccagacacaaataagcacacgttttatgatttgatttatataaattatccagaataggtaaaaccataacagaagacagattgatagttgccaggggttgggggcagaggataataagtaataactgttcaatgaatatgacattttctttggaagattagttaaccatctaatagcgttgtgagtgtactatatgccattgaattttttatttcattatatttactgttgcagcaagcaaaaattgttcactttaaaataattaatttaatgtcgtgaatttcttcttaataaaaatgacacatatgttcataaatggccatttatgatgaactatctctgggaaaagtgacggtaagcagcatttgcctttcagtatcaaacaaggaggaaggaatcataaggacaatgtttctgcttgaactatttaccatgtgcatgtattatctttatagtaaaacattaaatcgattgttaaaaataaatgacaatgagaggtattctaaagttgtagtagcaaagtttgctggtaaacttcgtctttggataaaggaaagaggagtaagaggaagcaaaagaccatttatagtggtagtagaaaataggagaatggaatatattaaacagacttttaaaaaagcttaggaaatgagactgggatgggaaaacaaattggccactgtgaagtataggagctataaggaagttaggaaggtcacatcactgtacatcctttacaggtccatagcccagtaatgctaaataaataaataaacaataatagtgcgtctctcacacagcaaattgaatatacatgattaattttagcaaacatttttcagcaactactagaaacaaggcattatggaccactaaataaagcaatcacagtttcccaagagtatagggcatcaagtgttgcagggtgagccaatactaaaaaagagtgtggatgctaaatttttaccatcaaaagcttattcatggtgcgtcatggaaatgtatctcttaagggaacttcagtaggactggatcattctgtaaggcaaataatcttgtataatgggtcccctgccttatggacataataagagtgtaaagcttctcttcagagagagttcactaattctccatgattagaaactgtttcttaactatgtacctatttgtactgtgcaatatcagcagaagcttctcttattccccaaaataagcatcttgcagctataagcttgaaaaactgtgcagtgcacacacagagtaatcataaattcttcaacctcactctttggtgcaaaaagactgtgttagactagaacaaactaagtgaccttaaatttaaaaaatagaaacccaacaacagagattgtaaaagagcaaaatattttagaatcaaatgaagaaaaaacaaaaatcaattggattctttcaaaagaattcattttcagcttggataacatccatctaaagattttttcccctagaaattaatgctataaaagtcttaggctgtgataactctaattcagagctgttttgtgtctgctaaatggaatgtgacggggatctaaaacagtgctatgttatagaaaataattagttgagaacaaacttgataatttcaccacagagaagaatggactgaaaacaactttcactttaattatgtgtaaagaaaaagcataattacctgcatagatagtaatcaggaaaaatgaaaatacatttctctgttatctggtagatagcaaggtagctttttaaatctgttcacctcttgtataataaagataacaaactggttattgtaatgccatcaaaatctcaccccagagtaaaactaggaaaaaaaaatacaaactatgtttctaatgtaataatattcttatttttcctgttggtatttatccttaccaggaacatttgaggaatatacttataagaattcttcccaggatattaagataatgacatcaaagcaaagtggtaatttactggaggcttcaattaaggcacaaaaaacatttgaaccattagaataatactatgttttttcatcctcatttaaattcattagcttttgcctttttaatgctcaaggaacaggactcctctgaattgtagatatcagtatccgccatggacatttggaatgcatctacacactcaacagcaatatagcattcacaaaaatttgggtcggtccaatcagcttcagtgtgcatacataaaggcagaattggcagacatccttggctctcagcagctgatatcacaggctggccagttgagatgcaagttagagccaagtttttgagccacagatacttcaggctgaataattctacattgctgtgtgaagcaacttgaaatttggatatagcaatctaaatttcaccacctatctaaagcgctagggaaagtggccactttcagtaatttcacatttcatctgtaagccttttctgtaactcagggaagccaagagcatggtggcctagttgggcagtaaagatgccaagtaagaagtttcttcacttcctgccacaacaccacctttggagtgtgattacatcatgttgttttcatttaatttcttttacctatgtctctaattgctccagattatgagagttgacaagtccatagtttgataagaactagtttgagatgataaaccacgttattatttcattctttatagttccttgtggtctgccttgtatgacagctactgtagaaaataaaactgtgccacataataaaaattactaagacttaaagttgcatgcagaaatggagtgaaacttaagaatccataagatttaagtagcaattagatgaattgacacttggcttaatctacttcccaattaggaccaaaaccattgtcgagggaaaaaaaaatagaaaaaggagagtgctttccactccggatacaatctaacatctaagacatgttaaagaaagtgtgcaaagagaaaagaagaaatggaggttattagaacaatgaatagtataaaggaacaaaaggaagcggagggttatgaaggtggctagaatccaaaaaaaccacagtggataatattatctaacttatgtgttacaccaacctacaatctcaaaagacctgatagaggagtttaatgctttaatcatggaaatgtggaatttcttaatgactccttagagaaacagaagtatttattgagacacaagacaaatttaaaacaaaaaaaaatgtgaaatgaaactcagggatctaaaagtatgcatcacttttccctccgggaggtagaaaaaaaaactccagaaatatgaataaagaatgaaatcacagaggtttcaggaaatgagaaacttgtcaaagtaaccaatgaatattcagaaaggccattcttagtcatatacaatggtagagattcaggccagaagcaaagaagatcagagatgaagctgtcagaggtgaaacagctctctacatatgctctaaatattatatatattccaattgatcattgtgcattatcatcttgatatgctgttggattcggctagttggtattttgttaggaaattttgcatctctgttcaccaggaatattggcctgtggttttctgtttttgttatgtccattcctagttttggtattagggtgataccggattcatagaatgatttagagaggatttcctctttctctttcttgtggaatagtgtcaataggattggtaccatttcttctttgaatgtctgatagaattcagctgtgaatctctctggtcctggacttttcttttgttggcaaatttttattaccatttcaatcttgctgcatgttattggtcctttcagggtttctaattcttcctgacttaatctgggagggttgcatatttccgggattttattcatctcctcgaggttttctaatttatacacgtaatgatattcatagaatccttgaatgatcatttgtatttctgcagtgtcagttgtaatatccgccattttgtttctaattgagcgtatttggatcttctttcttcttcttttagttaatcttgtaaatggtctatcaattttatttatcttttcaaagaatcagcattttgtttcatttatcttttatacttttttttcattttatttagttctgctctgatcttgggtatttcttttcctctgctgggtttggattctgtttgttcttgttttcctagttccttgaggaccttacattgtccatttgtgctctttcaaattttttgatgtagacatttaaggctataaactttcctcctagcaccgcctttgctgtatcccagaggttttgatagattttgtcactattatcgttcagttcaagtaatttttaaatttccatcttgatttcattgttgatccaatgatcatacaggagcaggttatttaatttccatgtatttgcatggttttgaagactcctcatatcagaaatgcagggatggtttaacatacgcaagtcaataatgtgataaaccacataaacagaattaaaaataaaaatcacatgatcatctcaatagatgcagaaaaagcatttgacaaagtccagcatctctgtatgattaaaacactcagcaaaatcagcatgcaagggacatacctcaatgtaataaaagcgatctatggcaaacccaaagccaacataatactgaatgggaaaaagttgacagcattctctctgagaactggaacaagacaaggatgcccactctcactactcctcttcaacatagtacttgaagttctaaccacagaagtcagacaagagaaagaaagaaagggcatcccaatcagtgaagaggaagtcaaactgtcactgtttgctgatgatatgatcgtgtacctagaaaacactaaaaactcctccaaaaagctcccagaactgataaataaattcagcaaagctactggatacaaaaaataatttacacaaatcagtagttctgctatacaccagcagcgatcaagctgagaatcaaatcaagaattctacctcttttacgatagctgcaaaaaataaataaataaaatacttaggaatgtacctaaccaaagaggtgaaagagctctacaaggaaaactacaaaacactgctgagggaaatcatatatgacacaaacagatggaaatacatcccatgatcatggatgggtagaatcaatattttgaaaatgaccattctgtcaaaagtaatctgcaaattcagtgcaattcccatcaaaacaccgtcattcttcacagaactagaaaaaacaatcgtaaaattcatatggaaacaaaaaaagaggccagaaagccaaagcaagatcgagcaaaaaaaaacaaatgtggaggcatcacattatctggcttcaaactataccagaaggccatagtcaccaaagcggcatggtactggtataaaaataggcacacagaccaatggaacagaatagagaacccagaaataaacccaaatccttacagctgactgatctttgacaaagcaaacaaaaacatgaagtgggaaaaggacaccctattcaacaaatgatgctgggataattggcaagccacatgtaggagaataaaactggatgttcatctctcaccttacacaaaaatcaaggtggatcaaagactgaaatctaagatcagaaactctgaaaattctagaatataacattgataaaacccttctagacattggcttagccaatgatttcataaccaagaacccaaaaggtaatgccacaataacaaagataaataggtgggacttcattaaactaaagagatactgcacagaaaaagaaacagtcagcagagtaaacggagaacccagagagtgagagaatagcttcacaatctctacatccgacaagagactaatatccagaatctacaggaactcaaacaaattagcaagaaaagaacaagcaatcccatcaaaaagtgggctagggacatgaataggtaattctcaaaagaagacatacaaatggccaacaaacatatgaaaaaatgctcgacatcactaatgatcaggtaaatgcaaatcagaaccacaatgcaataccaccctactcctgcaagaatggccataatcaaaaaattaaaaaataatagatgctgacgtggatggatgtggtgaaaagggaacacttctacactgcgctgctgttgggaatgtaaactagtacaaccacgatggaaagcagtgtggagattccttaaagaactaaacataaaactaccatttgatccagcaatccctctactgggtatctacccaaaggaaaataagtcattatacaaaaaagatacttgcacacccatgtttatagcagcacaattcgcaactgcaaaaatatggaaccagcccaaatgcccatccatcgacgagtggataaagaaattatggcatatatatatatatatatatatatatatataaaatcaagtactactcagccataaacattaatgaattaatggcattcacagcaacctggatgaaactggaaactattattctaagtgaagtaactcaggaatggaaaacaaaacatcgtatgttctcactcatatgtgggagctaagctatgaggatgaaaaggcataagaatgatacaacggacttcggggacttgagggaaagggtgggcggggggtgcgggataaaagactacaaattgggttcagagtatactgttcggatgatgggtgcaccaaaatctcacaaatcaccactaaagaacttattcatgtaaccaaatatcacctgttccccaaaaacctataagaaaaaaaggtttttaaaaaagattatgtatttcccaaaattataggtagaatgagtgattggagaaagaaaattttggttatagagtattgcaagtacaggggcaataaagggactcagctcttcctactccatgagctgtattatgatccagagaaatgcaagcagttggtaatagtctcaggaaaagtaggagagcagatcaaaggtaaaggttagtacagaattctttccgtggcaggtcatatcggaacttttcttttttttgtttgttagtttgttttttattttattattattatactttaagttttagggtacatgtgcacaatgtgcaggttatgtatacatgtgccatgctggtgtgctgcaaccattaacttatcatttagcattagatatatctcctaatgctatcctttccccctccccccaccccacaacagtccccagagtgtgatgttccccttcctgggtccatgtgttttcattgttcaattcccacctatgagtgagaacaagcagtgtttggttttttgtccttgtgatagtttactgagaatgatgatttccaatttcatccatgtccccacaaaggacatgaactcatcattttttatggctgcatagtattgcatggtgtatatgtgccacattttcttaatccagtctatcattgttggacctttgggttggttccaagtctttgctatcgtgaatagtgccacaataaatatatgtgtgcatgtctctttatagcagcatgatttatagtcctttgggtatatacccagtaatgagatggctgggtcaaatggtatttccagttctagatccctgaggaatggccacactgacttccacaatggttgaactagtttccagtcccaccaacagtgtaaaagtgttcctgtttctccacatcctctccagcacctgttgtttcctgactttttaatgactgccattctaactggtatgagatggtatctcattgtggttttgatttgcatttctctgatggccagtgatggtgagcattttttcatgtgttttttggctgcataaatgtcttcttttgagaagtgtctgttcatatcctttgcccactttttgatggggttgtttttttcttgtaaatttgtttgagttcattgtagattctggatattagccctttgtcagatgagtaggttgcgaaaattttctcccattttgtaggttgcctgttcactctgatggtagtttcttttgctatgcagaagctctttagtttaattagatcccatttgtcaatgttggcttttgttgccattgcttttggtgttttagacatgaagtccttgcccatgcctatgtcctgaatggtaatgcctaggttttcttctagggtttttatggttttaggtctaacatttaagtctttaattcatcttgaattaatttttgtataaggtgtaaggaagggatccagtttcagctttctacatatggctagccagttttcccagcacatttattaaatttattaaaaacagcacccattgctcgtttttctcaggtttgtgaaagatcagatagttgtagatatgcggtgttatttctgagggctctgttctgttccattgatctatatctctgttttggtaccggtaccatgctgttttggttactgtagcgttgtagtatagtttgaagtcaggtagcgtgatgcctccagctttgttcttttggcttaggattgacttggcgatgtgggctcttttttggttccatacgaactttaaagtagattttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcactgagcagtggtttgtagttctccttgaagaggtccttcatgtccattgtaagttggattcctaggtattttattctctttgaagcaatagtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttccagatatacaatcatgtcatctgcaaacagggacagtttgacttcctcttttcctaattgaataccctttatttccttctcctgcctaattgccctggccagaacttccaacactctgttgaataggagtggtgagagagggcatccctgtcttgtgccagttttcaaagggaatgcttccagtttttgcccattcagtatgatattggctgtgggtttgtcatagatagctcttattattttgaaatacgtcccatcaataactaatttcttgagagtttttagcatgaagcattgttgaattttgtcaaaggacttttctgcatctattgagataatcatgtggtttttgtctttggctgtgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttcttttgattggaatagtttcagaaggaatggtaccagttcctccttgtacctctggtagaattcagctgtgaatccatctggtcctggactctttttggttggtaagctattgattattgccacaatttcagatcctgttattggtctattcagagattcaacttcttcctcgtttagtcttgggagagtgtatgtgtcgaggaatttatccatttcttctagattttctagtttatttgtgtagaggtgtttatagtattctctgatggtagtttgtatttctgtgggatcggtggtgatatcccctttatcattttttattgcgtctatttgattcttctctcttttttcctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgttcttgcttttctagttcttttaattgtgatgttagggtgtcaactttggatctttcctgctttctcttgtgggcatttagtgctataaatttccctctacacactgctttgaatgcatcccagagattctggtatgttgtgtcttcattctcgttgatttcaaagaacatctttatttctgccttcattttcttatgtatccagtagtcattcaggagcaggttgttcagtttccatgtagttgagcggttttgagtgagtttcttaatcctgagttctagtttgattgcactgtggtctgagagacagtttgttataatttctgttcttttaaatttgctgaggagagctttacttccaagtatgtggtcaattttggaataggtgtggtgtggtgctgaaaaaaatgtatattctgttgatttagggtggagagttctgtagatgtctattaggtccacttggtgcagagctgagttcaattcctggatatccttgttaactttctgtctcattgatctgtctaatgttgacagcggggtgttaaagtctcccattattattctgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaactcctgccttgttttgttttccatttgcttggtagatcttcctccatccttttattttgagcctatgtgtgtctctgcacgtgagatgggtttcctgaatacagcccactgatgggtcttgactctttatctaatttgccagtccgtgtcttttaattggagcatttagtccatttacatttgaagttaatattgttatgtgtgaatttgatcctgtcattatgatgttagctggtgattttgctcgttagttgatgcagtttcttcctagcctcgatgatctttacaatttggcatgattttgcagtggctggtactggttgttcctttccatgtttagtgcttccttcaggagctcttgtagggcaggcctggtggtgaaaaaatctctcagcatttgcttgtctgtaaagtattttatttctccttcacttatgaagcttagtttggctggatatgaaattctgggttgaaaattcttttctttaagaatgttgaatattggcccccactcttttctggcttgtagagtttctgacgagagatccgctgttagtctgatgggcttccctttgtgggtaacctgacctttctctctggctgcccttaacattttgtccttcatttcaactttggtgaatctgacaattatgtgtcttggagttgctcttcttgaggagtatctttgtggcgttctctgtatttcctgaatctgaattttggcctgccttgctagactggggaagttctcctggataacatcctgcagagtgttttccaacttggttccattctccccgtcactttcaggtacaccaatcagatgtagatttggtcttttcacatcgtcccatatttcttggaggctttgttcatttatttttattcttttttctctaaacttcccttcttgcttcatttcattcatttcatcagtgatggaagatatcagaacttttcaaactcaaagaccaaaaaaaaaaatctgtgtctcaaatgtttgaagtcaaatgtattcttatgtacttatttacttgcaacattctctgctgattatagtttttccttcttaattctgagtctttttccccaatgtctgttattgatcactatctgatattaaattgatactctaccagcctaaatagatgaatatttcagtgaactatttggggaaaatccaaagatatgtgatgaaaagttaggttacaatttcatatatagaccagagagagaataaagccaagtacgcctgctggattctagacaacagtttatgtttttgaattaaatgtgacagcttacatataggatgacatcacagataattccaaacccaaatacatgaaaaaaaagttaaaaaagagacctgcatttatttcccccctgtaaaaagtgagtgtcaaaaaaacataattagttatgagaatatgtgaaattaataggaccattaattttacatctggacatctaagataacattattttgcacttagatttatgtcaactgcaagatgaagaaaaatatatgtttctatcacataagtgttataagaaacaataaatatgtgcaaaatttatataaaaacctaagtgctataaacaaaaatattattggtgacaaaagtttattcactaaaaatattcataggttacttatgtcagagattgcttttaacaaatataatgggagggggaagagttgtttctctaccctataaactttccattgttttttatattttaaaaaatgtaaataattttaaactgatagataagtaacacgaatggtaaagaaaactcggacatatatgcaacccgaatttccaaacatttaaattttgtttcagttgcatttgttgtctctgtctctctctctctctatgtatgtgtgtgtgtgtgtgtgtgtgtgtgtgtgtgtgtgtgtgtgtgtttatatggaggaatcatcagtggattcaaaattaatagggaggattgatgaagagcagggtaatggtatggtctcaaagtgtcttgcacatagagggattattaattgcaaagtaaaagctagtaactacacaatggagaaacctgagaatggagaaactacaatgtagtaactatagaaaagagaaatcttgcaactagttttatatatatatatatatatatatatatatatatgcatatataatatatagtaatttatatatatatatttaatatacaacatataatgtatattataggaatatatgatatatactatatatttactatatatgtagagagaaggaaccttcaacattacataatataacatatgattagttgcaattattataatatatttttagttgcaattattatatattattagtttcaattattataattactttattattagttgcaattatattacacattaattagttgtcatgtattattagctgcaagatttcttcattgtatagttactatgttgtatagtttctccattctcaggtttttctattgtgcagttaccagcttttaccttgcaatcaataatccctctatgtgcaagatcctttgaggccataccattaccctgctcctaatcaattctcctcactcagttttgaatccattgatgattcttgcatctttatgatgatgatcatgcaatggttatccccaccttcaattccaccacttctttcatgtttatgacagcattatactgtagggaagcatcttctcatccctcttaatttatgcatttattaatcatttatatttttatgatcagcataaactcatggattccactttttaaaaatcaatgggttataatacattgctcttattttttattttgatgctacaattgtctaagatttgaccagtggggaccccttcaagccgtattttggatatgcttcatgccaccttttgaatactttcttactttttggcaaaagatgtttcaggctcattttgtgctttacctatgctaatgctggcattagacatttatctaagaagctgtgcttctgtagtgtggattgatatttagaaaccataatctgagagctaagtgggatatatttacttgcaggacctttcctctgtcaaagctggaaaatcatgagtttatactaatatctccaattccagtttacccccgtatagtttgcactactctgttccatagtcatattccccatcttccataagaactcaagctcttcctccaaaagaaagcacatatttacatattttcttgatcctgcagtatataaaaacttgtcagtatatccatcatctatctatgtctatatgtgtttctatgtatcatcaatcaaaaagagttcaagagttacagttccatttgcaatccttttttatatagtcaacgtactgtttttaaatgttgcatggattagttccctttttccttccttaagtttgattatgtaatctatgtgaaatacatttgggtacatttgtttctatctgcatgtagttttagagagttttttcccattctggtttacttcattttattccctgtatatgtagagcatcacaacaattgttacttaccttcccaacccttccatgctgtccaccccaacacacacatgatttgtaggtaaccaatttcatagtttctgatttatccacgtatgttatattttgcagataagtgcatgatttcaatttctcttataggcaagtacctctgtgtattatatataaagagagagacatttaacctaccctgtgatgagttttctgtaagctacagtaatcatgacaatcgaagtgacataattgttagatttatatacggtgtaagtattagatgaggttaaaatactgtttaaacataactatttgtatgcatgataatgtcataatacaaaaggaggagtgggataattcagatgtaggcaacatttggccttccttacttagactttttttctattccaatctgaagataaactaaaagcattaccatgaatgataaggtatttccatgattatattagatttactaggctgtaatcccagctactcgggaggctcaggcaggagaatcgcttgaacccagagaacccaggagcagagttcgtgccacttcactccagcttgggcgacaaagcaagactctgtctcaataaataattaattaattaattaataaaactaggtacactattattacaacaaaattatatactgtattttattgcagccatatagataaccctctggaaagtacagtaaatacataaaattaaaactactggattttaataccaaaggaatctcaaattttcaatggttcttaatactcctgaagttacaactttaaaaatctctttaaagttatagagtctcaccaagaaaaaaatgtacatataccataccaaaatatgcttctaattttgaggtttcacaaacactccagagtaagaagtacaggtgtccttgatcactactgctaactgttgtgggtttcttcagaacttattttaagtcttgctggatatgtatttcattctacaagatgtaacacatgactatcattggttactttgttacttaagctgttcaaacattggccatttgaagatccttcaagttggaccctatgtcatttgaataagttcccatatatattttttaacattttcttaatttcttacacagcaatatgtcccaggcttgttgtgtactttccatgacctaatcctggaatcgactatttctccaagtaatattgcttccttgtagtgaagaagaggagagaggggaggatgaaaagaagtgggttaaagggtacaaacatacagtaagacagaaggaataaattcaaagtttaatagcaggatagggttaatatacttaaaattgtatcatacttggattgtggacaccctaaataccctgacttgatcattgtgcatcttatacatgtaacaaaatttcataggtaaccttaagtttgtacaaatgaaaaataaaccatccattactactattagcaaagaagagcccacaccttcttctgacaactggtatttaaggaaaattgacaaaatgaccactttaataataattcattatactcttcaattttcccaacactttcttttcattagatcaaaaaatataatattgtagagtccaatcactttgaactaattttgataatcacattgtttcttcttacaaaactctataagcatgtaagtttctaatcagcaaagaatacatgcactgttcaaaagttattttttcctacaaaggagattgtctgtttcatctaaaatagacttactattgtgtgtgcaatatatagtttaaggattttgaaggagatataataaatcgtagcatgtttcattacttactttgtcacctacagaattctctacatttttttctttatgagaactaatccccaacccccttcacagctctttttacaacggatgtagagttctgcattaccacaacaaaagaaaaccatgtagaaaaaaaaaggaagaacagaaaagaaaatgtttacagagggaaaaagtttcctttccttctttgtggttttctgtgtaaaatcttagtttggcaatcttgatatcatccattaatttattgatgaataaaatgtgtcactcataaacacttccagaagtgtcttaatagttgtcagaaaagtatttgccagctattcaaataaagacagattacttggatagcaaagacaatctggtattcaataccagcatctggccacttactaatatctttatctccctgaaatctcaagaagattaaagtttttctgaagtctcaggtgttcatttttgtaagcttgcccagattccaagccttcattttcccagcccagggtactatgaaaaagagtgtctgctatgttcatcagagctcactggacatgctcacaaatacatggcgtttcaactgagcataaacttccaattttatgttaaatttaagcaatctcccttttcataaaagaaaaaaaagttgtttttttttttttttttttttttttttttttgagacagagtctcgctttgttgccaagctggagtgcagtggtgcatctgggctcactgtagcctccgcctcccaggttcaagccattctcctccctcagcctcccgagtagctgggactacaggtgcacgccaccacacccagctaatttttgtgtttttaatggagacggggcttcaccatgtttgacaggatggtctcgatctcttgacttcgtgatccacctgcctcggcctccgaaagtgctgggattacaggcgtgagccaccgctcctggccaagaaaacatatattatttttataacactaaaatatgtggcctacacacaggctttaaaagaatttctctaatgctctaattaatgggtttatttttcatgcaggatgtgtgtaaggaaaccaccatgtttctccttcatccagctccatactgcactgtttgggatccggtgtgatcctatctaaaattaacactttccttttgaaaatgtattgggtttcttaatgcaatttctctctcttcaaagtataacatggggtgatttcctggtcaatacatttaggaatggtggagaaggagaggaaggagtgagctatggtctttgcttactttgaaacttgatttttaatgtttactttctcttatttttgtctttatgacactggatcactgcttctactagtgtgtctccttctttcacaaacagacaattgccttaatataaacaaacctctctagtggctgacaaaatcttccaaaactgttcatatattttaactgtgatgcagattataagtgtcaacactacataaacaaagagaacaagaacatagacaccaatttatctttatagtggggatgcatacttgctatagcattatattgtttagactttaacaaattccactataattataggttaataactatcaggtgttttgtagagttaatacatacatttatccatttcttaatgtggaagataaaaagtagttgagattgtgttggttgaccaattatacatgccttactaaataatatatgagaactttgcactagatttggaaggatggaagacatccaattaactgtcccttttccctcaagctgcaagggtctgatcataagaataattgggaacctccagtagtgtggtacaaatgcctgaggctgtagtgccaaccacgagaaacccctcctttagaagtgcctggagagggtgaaaagcaagtgtgagaatgtgaatccagactgtgaaagaccttttactgtcaattcccgctctgttttgccaaagggaagggacaggcactaaaaaaatcttcaacttgcaaaggatacagaaaatgctcagaccttgttaaaaacaagaagccacattagtggttcttcatgaaatatctgagtcctaagtcattctatatacattaaaagcaccttcttagcattacagaacatactgctgtcacttctggaggcattgaaaagttttctcggggaaggcattgctatgttccactatttttcagtaacattccttattgggttcttcttttccatccgtccctccgtcccttccgtccgtccgtccgtccttccttccttccttccttccttccttccgtcagtccttccctttctatcttttgtctcttttctccctaggttaatacctgtttaaaaagccatgaagctaataatgaaggaaatcaaaaataatagcagatacataagtgcatgcttgcaataataaattacatgagtactaaagaattagagcagcaagaaattttacagtttaggattgtggaagagggtaattgtctcatttttctaagagctgaaaccttgaaagagaatacaaaatcaactactactggttctgttactccaggattttcactaataatatggctctctgccctttcttcctacagcatctgatttacgcctcttgttttattttgtagttcaatatttttctttcctcagtggaatgttggtggtggtggtgtttattaagggtgcagtgttatttaaccattttgatcctttccattttataagaatcactgaaaggaacgtctttgaaagccctaggggggtggaagttgatacaaatacctgaagccaatttcttacaagcaaagcagcctacactggaaaataaataaataaataaataaataaaaacctttattccaaaaagttattttttctttaccattaatctctatttaccacaccagatacatcttttaaatatgtgtgtatgtcaggggaggagagagatcaaggtacatagattcaaaataaatacgtaaataatatgtgaaggagaaatctatcaactgagatagtcaaactaggagataggcaggtctccatagttccaaggtacatttattcttcacaaaacctataaacagaggagaacgatgttgactatggatactataatgctatcattgaaaatcacaaaagtcaagaagtacacagagacacagaatgtgattgttgtagacttcataatttcaatgttttcttgttctcttttctagaactaaacattctcatatttaaccaaatctctgacctgaactaaaatatcaatataaatagtaatcttcagaatagcattaaatgaaaatggtttcacacccttccattgacaggtctcagaacctgagacagtataaaagaatcactattttttaatcatataaatgtccaaataaaattataaaagggaactcagatctttcaattttgtgaacagcattcttccttgtatcttttctgttaaggatggggtttttttcctatggtacatttttcaatgcattatctaattttaaatgtctctagaactgagacatccactttttcacaatcagaaatatgaaatctttatttaaaatcgtatccatcctaaaatcccccttgtttgcctttgagtcttagttatattttgaagacttcctaactgcttttacttttctcttgcttatttttctgtatctttcatagatgtgatggaaatactatattccaatgttttatgcttaatatcaatagtaatgctgcagagctgtgtgttatcagaagtgggaatatgctgtagaggtgaaaaaaaagttcaggttccagaatcagtctacctggctttgagtcccaactttgccacttgcatttctgtatctcaatttgtttatctgtaacaatcatagcatatataaagtccatagaaaaatatttaacacatacatgctcacttaatatccacttttttattatgatcttaagagtatgcaacaaatatcgatttctcaaaggaaattggttatatatatgatatacatataattgactttaaataaaattttaataatctataaatcgtttacataactggaattgtttacgactacttctcattaaacagaaaattaccccaatcacttcaagctacgattgaggcattatgataaaatgagaaggcagtatggtaaaaggaaaagagcaggcttttgatttagaaaacctgtattgaaattacagctctaacatttacttgttgcatgatcatagacaagtttcttaccttctctgagcctttatttgtaaaataaggataaaatagtactaacctcataaatttgttgtgagcattaattagcacattggaaatacttattgaatgccagacattcacatattatatactcaaaattgttaagagatcttcagtcagactttctgggcttacatctgtgatggttaattttgtgtcaacttgaaggtgtgtgtttctgggtgatattaacatttaaattggtgaactttgaataagcagattgccctccataatgtggatgggctttatcctggatagaacagaaaagaagaacctccctaaacaatagggtattctccaaaagactgcctttaaactttatctgcacattagctcttctgggtctccaggaagcctggctttggactggatttgcaccacttggatctcctgggtctcaaacctacactgcaaatttggacttgctagccttcataatcatgtgaaccaactccatataataaatatttgtctataaatatatgcttcctattggttttatttctctggagcatcctgactacacagtatcacagctctgcaacttagttcttaggtgaccttgtacaagtttcttaaccactctgagactcttttcttcatctacccattagaaatagcaatgcctaccctcttttgattattgggagaattaaatgagttaaagtctataaagtgcctagcagactatttggcacccacctaggaagctctcagaaatgagcttcatagagtacctaaaaacaggaggcactgactatttccccagatgaggatatggctgattttagttctttgttttgttaaagaactaagagagcacaaggtttgtaaacattctctttaaagcaaaatgtaaagatttccagtgtaaattatttcaacaggtgaattaggtccaaaatataaaatatgtggggtatacaaaaaaactttactattgtgtcagatccagttatttctcagctctagcagggcccatcatgtgtggacaatgtaacctataagcacacattccctcagggaactggaaccatgagaaagctatcccaagatatgttgcatcttgttttgccttgtggggttccctgcttctgacaaaatttgtatatgaccactgtgtgggtgtggtcatacggtgtcttctcaccaacttgcaaccattcttaaaacactgtatagattgatgacaaaaaaactgtttactcctctgttactctgccataaattgggcaatgtgttttcttctcggtttcattctctgaacatgcttatgaaatgggtgcaattttaagccatatttgataaatatggaaactggggctttttaagattatgcattttgtcagagtgcagaccctgcacagagcaagatctttccttaaaaaaaaaaaaaaaaaagaaagaaaattactgctctactccagtagttctcaaacttcactgcaatcagaatcacctgtggatttttcaaaactataatcatatccaatctccagaaatttcaattaatttttggtggagtcaaggaaccagtaatacgtaattaaaaattcttttcaactttttctactgtgcaaatttgagaagcctttttctaaaccattacactatatcagtgttttccaaaattgtttgactgaaatcttcagtaaaaaacatttaacatcatcaaccaatatacatataaatataaaactgaaacaaaagttttacaaaacaatgcacttactacctgcaagcattctgttaatttatcttctattctattatatactatatcttttattttaattgcaaccttctcaattgatttcataacccactggttggttaccaagcacagtttgaaaaatcactgctcagggccaagtgtggtggctcacgcctgtaatcccagcaatttggaagacagaggcaggtggctcacttgagcccaggagttcaagaccagcctgggaaacatggcaaaaccctgcctctacaaaaaatacaaaaattagccaggcgtgatggcacacacctgtattcccagctacccagctacttagcaggctgatgtgggaggacagctgagcctgggaggtcaaagctgcagtgagatatgattgcaccactgaactccagagtagatgacctttccttaaaaaagaaaacaaaagaaaggcaaataaaagacaggaaaatcactgctctgtacaatgcttaataaaaatatgctccatttccctaccctttcctgatatatattctattttagcctcctctccaaattggagaccatttattcctgagtgctgagagatcattccactgcactcccttcttggcaacactccgctcgctctatatcctctttctacagctgaatacctatgcatgacaactgttctgacatactttcttcaaatatatgattcttaaaacaagtagtgctatggttcaagaaagatgaccccttttaggtccaagaaagggtgacaagtccatacattttattccattctgaagtagaatgaccaattgcatttgtagtattttattgctgtgtaacaaattaccacaaatttagtggcttgaaacaacacagtgtccatggatcagatagccaggaacaggatggcttggtcctctgctcagggtctcaccaggctgaaatcaaggtgttggctggggctgtgatctcatctgaggctcgggatccttttctcagctcactggttgttggcagagttcagttctttgtggctattgaaaactaaaataaaaccataaagcaccccaaactgactggaccctctcttgaccaaggggatcccagagaaactttggaagctgtgtttctggccatgacaggaagggaggtcagacacaccttattatatcccctccattttgtggtttagacacaaaaactgacaagcattaatgttaaaacagaaatcataagacaaatagaacagactctttatagcagtaagatatcaaattatatacaagacctaaggccacaccaggaagaggttaagtcacacaccctgcacttaagaatcagctgtgttctaattgttataagattttcttaatttatttctctcgagcagctaaacaatcactggccttgagataagcaatgtgtaagcagttgcagcatacccaccaccagtcgctgactaactgagccccccattccacaagccataactataactttgactggacaagagactgagttctgtaacttttcctgataaaagaccactggccatggattggttctggccagtttacagaggctacacacttgagtgcttctgtgtccctacttcacgtttttatgtgtaggtccaaactgtaatacatttaaatcttaagtctccaccccaaaatgaacatggatcacatgtaacatgcatgtttgcttatgacacataggcacgaccccttgtcatgaatattcatagtttctcctatatactcttaaatatggccattcagcttaaatgcctgatttactcctcactccctcaaagtgcttgcctttcaggctctaccacaggctacatttctcaacatgtcagaatggctaccttgaggtctgtagccctttataagaaataaagctcttctttctaactttataaattgtgtaatttctaagctaatgctgtaagactcatggtaatttttaagctaatgctataaaacttaagtcagcaggagaatctctttttaggaatggcttggtgccttttataaagcatcacccgattaggtcacactcacatagaataattaccttcgtgataagtctcaatccacagattagtagcctaatcacaagagtggtaccccattcacaattcctacccacattcaagggatgagaatcatacagatatacagaatcatacagatatagatatacagaatcatacagatatgtacatcaaagttttaaggaccatcacagatgtcagcctaccacatcagccatctcaattttcttcagtatgttctggttttaccactgaaagttccacaacccaagggaaaatcctaggcaaactggtacagtggtccccttaccagtggaaagcaaaatctctcacctagcatcctttatgtcacacacctaacgaaagtccaattacagaaaacctgaacatagagtttattcctattctcctctgatacaatgcttgtaaagatgagttaagtcatgtgcttatagtcagagatgccttagcgtgagcaccatagaaacacttgaccaataacttatttttcttctagagcatatcccatccactatacccaaaaaaaagttcatgaataaaactatgatgcaaagggaaaagtactgcattttcaaatttccttcatgtcacatgctatgtgtgtctgttaataaatacagtataatcccaatggtgtgatataaaactctaagtgcaggcaccaatgctaaagttagcagtgctttcagaacaagcctaatttaaacatcaaacctcactaattagcatatttttccctggcaaattttgttttacaaactccggcctaaatctgaaaatcatggtagcttaataatcatagaattgtagaataataaacacggtactgagcacaacattgaattgcagttaagaagaaaacctgaattatatatgttatgcaattttctttcttcccatgattgaaaaattcttcttctaaactaaaaactgaaataaagacagttgcctgttttctatcaatttatttctactcagattattttaaagcatttagaaatggaaattccaagggagaaaaatcaggaatatctcttcccacagtctaatataagtttccagcttctataaatattaggtccctggagttcttgacattgaaatgtgatactttgtattacttttgtctatttcaaaggatagatcaatggctttttttattattattatttgattctagcttgaatttttctttttctctttcctctgcttggaacaaattcagttgcataaaaagacagtccttaggcacctactcattataaatcacttctcattctactttactaacgttgtaccatcagtttaaaaaggttcttcagaatattaaaagacttagaacaatacctctgaaaatggaattgggttttctttgaaatttcagatggttttctttttcatatggatatttgttgcccacatcccattccatttcttttcctaaggtctgcttcagtgtagaggtgataatcattccttgattcactcgaaacatttccgatataatgggcttctacattggttgtttacatctgtgtacgaagaatctcttcagctttctagtttgactagtaagcaaacatcagcaagacaatacttcactgtcttacttccttggcatcataaggaaaaaggccatttcagcatccgaaacctgggaagtcttttatctcctttccatttttataggtttaaggtgatttatttgaagaagcacttaggagaaaagagggcaagaatttaatacacatcacaggattctgcactacatgcctcactatatcttagtaaaacatattttggcataattggtggtgctggaatctttcccagaagcacagaattgcctacaatgggggtaaaactgaactgcctatgctaaatctagacagtcatttcagactgttaattccaccatatgaaaatgtcttttcaggccttaaaaatgaaaaaaaaaagcttcattcagaatgtttaagtatatcaaagagtactgtttcatggctagtgccaatgttcactgttaaacataggggcctcaaaggaaaaacagactgcttagaaatagaatattcatcaagttataatggttgataattatattgctacattccccagttgttttctaaagaagacggaaagcaacatttacatgttggcatcatatcaccaccaactggccaagagtgtttactaggaatgtttactaggaagaaaataatcaacttctaaaaacaaaacaaacaggaatagacaaacacagtatttgataagctcatggggaagctaaatactcctcaacttgcttttctttttttaattggcaattgagattgaatttcaacatcaaatctgagaaatactggcagctgagattctgtcaattctgtgagtccaccacttgtcaatctatattttagccttgaaaaatgttcaagagttggttcactaagtctgttttctgctttatgaacctggtccaaataaactattttatgcaattatttggtgacaacattagctgaatattcagtattttaaaaggtgatactgcttcctggtggttaaactttatttagaacaaccagatataaaactggaaacctgactggatttattgttaacctaagtgcagttctgacaatattcaggagcttctagtacttatccaggaagaatatatttctagttcttatcaaaccctcaaattcaccttctcaattgcagaactcatattatgacagagtacatatcttgtagatgtttgtatgtggtcaaaggtgattggactctattcaatacatatgtatttggaaaactatagtccgttctacagtgatgatccttgtagctttgtttagatgattatgtcagctctttccccttaatatttacctcatcaccaatacaattatttggctataggcaggggaaatgaggcttctgagtggctaactcttcagtatagatacattcctgataattatatacactatttgaccacatcactatgtcccttttaacattattatttctcattcaccactaaggaagcgtggtatctaatagcattcgagtttggcgctttgtctcaactctggctgccactactcttatctaaacctccttatttacaataccacaacaatttccaaactaatttcctagtctcaagtctctttgctctcaaatccattttctgcaccattgcccagctcaccattttcaaggatcacttgcaacttgtagtcttataattacaagctactggaaaggtaccctgttgtctactggatcaaatctaaattcatcaattggcaaagcaaacaacctataatctaacacaacactccctcacactagccaccaatattgaccttcagttctggccaggtgactcctcttgtcatcctatttcaactcccacaaaagtcatgacacatttttataatttaactattttttaagctgcaaaatgaatattataataatagaaaaatacaacagaattctcacaatttcataacaaatatttttcttttgtctatataataatagcaaatagtaatagtgatatattgtttgctatggattgaatgtttgtgtccccctaaattttatactgtgaaatcataatgtccagtgtgatagtcttagtaagtggggcctttgggagataattagatcatgaagttgaagccctcattaatgagattagtgccttttaagaagaggcatgaaagcttgctctttgtctctgctctctgccacttgaggatacaacaagatggccagttgcaaaacaggaagcatatcctcatgagacactggatctgctaatgccttaatgctgtacttctcaatctccagtactatgataaacaaatttctgttgttcaagccatctaattgatgatattctgttatagaagcctgaactgattaagacagctcttatcaggtttcatgccctattctaacgtctttaaaaatgtgacctctatacacagcatctattttgattggttggtgccagtgtcatactgcttctaaatacctgtatggtgaatatcattctggggagcagaagtggtcagagaggtttacatctatgctgaattagaagcaggagtactgaataacatttcaggcagaggaagtgacaggccaaggggcaccagggtccaataaaacatagcaaatttgggaaattgcaagagtcccagtatgcttggggtgaagagagagtatggaactgagaaagaatgcttgaaagaaacactagagtctgattactaagagccttaaaagtcatgaaagcaaagaagggactaaagttaggaaattgcctgttcagactagtatttcggaaactacttgatatgatttggatttatgtctccgcccaaatctcatgtcaaattgtaatttccagtgttggagatggggcctggtgcagggtgattggatcatgagggtggacttacccttgctgttctcttgataacgagtgagttctcatgaaatctggttgtttaaaagtgtgtagcacctccctttcactctctttctcctactcccaccatgtaagacagggctgcttcctctttgcattccaccataattgtaagcttcctgaggcttccgcagccatgcttcctgtacaacctgcggaactgtgagtcagttaaacctcttttctttacaaattatccagtctcaggtagttctttataacaatgtgagaatggaccaatacacaactactgcagcaatgtgggaaatagatttcagagattaggttgcaggcgtaaatagttgtatggggaaactctcttctgactttgtcacatttggctcactcaaactgtattctgtgaacagttttaagctttaaacatctttctcaagcacaaatggactacaccattttttttttttatcttttcagaactagctcgtgtgtgtccaacaggagcatccatttctgttctgtcacctggtcaccttttagcttaatgctttctaaggactggcaatcaaagttaaaataaaatccaaagtccttcctttggcttacaagggccaatatgatcttcttctctgcacatgtccatgtgttcatctcatatcactttcacactcacttaccatactccagtgacactggttttattactattatttgaataaatgaagtatttggcaatagttgttttcttctgcttgaaatgtacccacactctccccttctcaatctccagtgttactcagctggatcctttcgtgctcttcagatctcagtttaaatattacctttacaaaaaggtcttccctaactactaaatctaaataaccaaaacacttacatatccaaggtaaaattccatgcatagcacatattattctctgccacttttcttgtaatttgtttgttgatttcttagcaagttattgtctatatttcttcaacactaaaatgtacattatgagaagacaagaaacatgtctatctcattcattgttgaatttccaagtataggatataatatatgttcaataaatatttgttgacggaatagatgaaccaagcgagcactaaccatactgattcaagaaagctagaaatctgtttactatatatcaataaacaagtattaaaaataatacttatggtattgtttatgctgtgtttttctgcatattaaaacacaactgatgaacatacatggtgtgaacctcaaagaataacacagttattctgtattttgcaagcccttaaggaaatgtattctgtggagtttctcagtttgagagaagtctagtattgtactaataatatatgagcaaaaaatatagtgaagatgtggatgcaaaatataagagaccttgatccatacttaccagaatttcttgaatgtacacatgctgctattcacactacttttatcacacaaacatatcatctaggaggttcactggtggatatgactaaatgaatccatttctagtaactttttgttataaaacagacctatttattcaggagattatgttgttttgttgaggctttacatttacatatacatgtagtgaagataaacctttcatgcactcatttgttaaataataaattattgattactgcagacaaaaaaaaactgaccaccaagacagaagaaaaagtgcagtaataaatccatacatttttctttttaaaaaattttaatttaagttctaggatacagaacatgcaggtttgttacataggtatacatgtgccatggtgatttgctgcccctatcaacccgtcatctagcttttaagcccctcatgcattaggtatttgtccaaatgctctccctctccttgcactccaacccccaacaggccctggtgtgtgttgttcccctccctgtgtccatatgttctcattgtttaacttccacttatgagtgcgaacatgcagtatttggttttctgttcctgtgttattttgttgagaagatggcttacagcttcatccatgtcccagaaaagggcatgaactcattcttttttatgactacatagtattccatggtgtatttgtgtcacattttctttatccaggctataattaatgatcatttgggttggttccaagtctttgctattgtatatagtgctgcaataaacatacgtatgcaggtgtctttatagtagaatgatttctaatcctttgggtatatacccagtagtgagattgctgggtcaaatggtatttcttgttctagatccttgagaaatcaccacacttgtcttccacaatggttgaactaatttacattcccaccaacagtgtaaaagagttcctatttctccacagccttgccagcatctgttgcttgctgactttttaataatcaacattctgacttgcgtgagatggtatctcattctggtcttgatttgcgtttctctaatgaccagtaatgaggtttttttcatgtgtttgttggccgcataaatgtcttctttgagaagtgtctgttcatatccttaccccaatttttgatggtgttgtttctttattttttataaatttgtttaagttccttgtagattctggatattagacatttttcagatgggtagattgcaaaaattttctaccattctgtaggttgcctgttcacactgatgatagtttctgacctcttcaaggagaactacaaaccactggtcaaggaaataagagaggacacacacaaatggaaaaataaaaaactttcctgctcatggataggaagactcagtatcatgaaaatggccagactgcccaaagtaatttatagattcaatgctattcccatcaagctaccattggctttattcattgaattaggaaaaactactttaaatttcatatgaaaccgaaaaagagcccatatagccaagacaaacctaagcaaaaagaacaaagctggaggcatcacactacctgacttcaaactatactacaaggctacagtaaccaaaacagcttggtactggtgccaaaacagatatatagaccaatgaaacagaacagaggcctcagaaataacaccacacatctacaaccatctgatcttcagcaaacctgataaaaacaagcagtagggaaaggatttcctatttaacaaatggtgctgggaaaattggctaaccatatgcagaaaactgaaactggacccccttccttacaccttatacaaaaattcactcaagatggattaaagacttaaatgtaaaaccccaaaccataaaaaccctagaagaaaacctaggaaataccattcaggacataggcatgggcaaggacttcatgactaaaacacccaaagcaattggaacaaaagccaaaatagacaaatgggatctaattaaactaaagagcttctgcacagcaaaataaaccatatatttttctaaaatgctatttatgtcaatcaaatggaaatatcaggaaaactatttgagaagaattcacgaaagagagtatgcacgtgattaagaaatacgtgaaaagttgataaaccttattagttatcaagaaaatgcaaatgaaaccaccatgaaatatcctataaacccaccagaatgactaaaataaaaataccatattttggcaacgatatagagcaactataactctcttaccttgtgggtgggaatgtaaattggtgcaacaactttggaatactgttaagtagtatctactaaagctgaacatatgcctatcccatgactcaacaattccactttgacaattttgtatataaccagcacaaatgcctacattttgttcaccaagagacatgatttagaatgcttatgtcagcaccatttgtaagatcctcaaactggaagttttctattaacagtataatgaataaatattggtatattttacaaaagaaaatagtatatagtaatcataaagaaaaactgcaactgtatcaagtaacatagataaatcttactaacataatgctgagtgaaaatacccagaaacaaaaaaaaatgctactgtatttttcaataatataatgcagcaaacagacaaaactcatctatattagtagatattctgatagtggttacccttaggccatgagtaatgatgaaaaggaagcataaattagtttctagagtgctggtactcttttatgttttatctagatactgttttacattatagtgataagtcagcgattatttattagcccgtatacttacattatgttcatttttctgtatgtatatttaaaatgtaaacaaaaatttgaaaatgttgttttgagcacctcctatgctctaggattttttttttattgtggatgcatatacagatgaacaagctgatgtggttcctgctctcagagagcttactttttatttagagaaaatagacaagcagacaataagtatttacataataaaataataaaatatcagtgttataataaacatgacaaatatgttgcctaactacactgagtttactgttcactagaaaaactagaccattaaactgctaatttcaacaaaatgtgataaagttatacactctaaaataaagtgcactatgctagtctggagactgcagaaaagaagaagaatatgagttgagatctgaagcacgaggtagtagttagagaatggggaaggatatgtatgtttctaaataaatttaattccctgaaactctgaagctaagtttaaagagaatcactgaaacttgaagaccaaggggaaaatacagcagaatggggtacagtggtcatcaagaaccctattattaggccgtgtggacctagttcacaaacttggattttattctaagtgcaatgcaaagccaaattttaaggacaggggtcacaaaatatgatttacagtcttaaaaaatcattctggctgcaaggttaaaagaatacgtagctagatatcggttaaactattgtagttcaccaggatagatgataagttgggacaaaatgatagcaattggactggaaaaatggttaccagaggctagaattgatagtgggaaacttgggggaggtggggatggttaatagatacaacaagtagttggaaaaaatgaatacgatctactgcttgatagcacaacaaggtgactatagtcaataataacttatatgtacatttttaaatgactaaaagagtctaattggattgtttgtaacacaaggataaatgactgaagggatagaaaccccattctccatgatgtatttcacattgcatgtcttcataaaaaaatctcatatactccataaatatatatatatactatgtacccacaaagattaaatatttaaaaataaaaaataagtagactaatatgggatatattttgaagttaaagtgaactgacttagttcccatgttaaaaagtggtgagggactcaatcgtctttgattgacacttgtttggtacttaaatagctggatagtgcccattatgtaattcttacctatatataactggctcactctcttacttcatttaggtatctattcataaatcacctaatcagagagccttttcctgacttctctatctataatattagcaatttccatcactctttctctccttaccctttttattttccttcttaccatttataacctgacattttgttttttatttgttgacactttcatcagtagcagacatactccataaaatcatgaacattgtcagttttgttcattgttatagccgtcatctaaaatgatatctggcataatatatgtacaataaagttttgctgagtggatacatttttctgaatatatagaatactaatgagggtaaaagttagaagaaaatcaaagttttcattatttgaagtttgagctattacacatttcagtagagatcatgagtaggcagtggatctacaggtatgaaggtcaggaagaggtcaggaatagagatataaatttatcagaatatctatggcttctaaaatggttgaacatcataatgccatggtgctagtttgaggccttgcagttttgctcttgccctcttagaatgctgttctgagacttccatgtgaagaagctgtcttagcctattggaaaatgagagaccacatgaagacctgaggtggcacagccaatgctagcaccaactgcaaaatctatgagtgataccatcttgactcctacagccattatagctgccacctaaccatacaaataagatggatgagaacagaatagtcagctcacaagtttgtaagtaatagtaatttggtatgttttacaccaataaactttgtaatagtttgctaaatagcagtagctagctggagcagtcaacctgggtgaaactgaagaaaaacatgcagttagatgaataaattggagaaaaattgagacacattttgatgcatatatttgggtggtagaatggaacagaggggaatggaatgaatgtgttaaatgacaagaaatcctaaataacttcaatgttctatgagttgacagagaaagtaggaatagaaaaggagacttagaagaagtagccaaggggataggagaaaaagcagaaaaataaaatgtcacagaacaaaataaaatagttcacataaagagtagtaaattgtatgaaaaacttctgatagatgaaaagtacatgaacattctaaaataatcattatatttagggagatcacataaacaaaaataaatgtgatatatattataatgaactactgaatggatacataaattattcaaaaagtttaaactctacattatacaaacatcattgataattgatttaatatattggtaatcattttcatttttaaatgtattgttactgtgccctttactatgtaatctcctagtatgaaattgtttctaagagaaaacaatatttgcgtaaattatttcatcttgaaggtttttgtaggaaaaactaagttacaactttgaataatttatttgattaggaaaaaagtctggtactcaagaagggtagtatggcatttgccattgttgaaataattttagtctgacaaacatacctctcagaattctcttatgaaaatttacctttaaatgcaagaaatacttctttaaagctgaaatatattacctcattatttttctctgaaagtagacaacagaaaactcaattacttgagttttcaaaatttacttttaaatttattttatacatcttagcaattcataatgaattcaaagggtacaggaaatcaaatgcaactttataacaaaaacacctagaaaaagcaatctaagcatcttgcatatgcccatttgattattttacactgttgacacttgtgaacatcaatataagactataatggagactgacctacaaatatgctgcttcccttacctgtttacatttgagcattgttctgtgctacttctctacttactcactcttactgttttgatgtttaattgtcagaagcatacatgaatccagaaatatatagaccttttcaagttactaaattactgtacattgcctcactagtcaagtgaggttattgatgtaaagaaacttactgatgtagcagaaacattttatccttctgtgtgttgagcatttataattacttcaactgaaacccaaatagaaacacacacacacacacacacacacacacacacacacacaattgtcactacatcctcttcaaccctttaattctagcgcaagttgccataacaatctcaggtttcaatgaaaggtgtatggaaagatttatagttgaaaacgatgaagttaacttggcattttctctattttttctcataaatcactgaaaagcaaacagtatggaagaaaaaaatacaaactatatctgcaaagaaactaaaaggtgcctcaaatttcaaaggctaaaataagagaaagtctgcaaaagtattgatgggcaagtaaaattgaggggattcaaggagacggaatgcagaccttagtgaaatctggcaagtaaatggcatagcctgaaatacaaaatcaatgttcatttgtttgtcacatcaaaaagattgagtgatggtagtaactgaagcttttctgggccacattaaacataaagtcttgagaagctgtgaaaatgaggctgaatataatataaacatgcaacatttacaggaaattgactaccaataattcagggaaaaaaagaaagattctgcctacgctgattctagtttattgactctgaaaatagcacactcacaaccctttggcatcaggaaaatatccgagagtttagattatcatctttctcccaccctcatgcaggttttctaaataaacttatcttaggaaaaaatgtagctcattaagaactatgtaaaaaaaattaaattttggtttaaactctgacatatgaaatacttagaagttgtcactcctgtccttataagaaaaagctgaacacattgaaaaaaaaaaaagtaatttcaatgaatcgcaaaaggctgagtgtggaccaccattaagagtgacaaattcctggggatataatctttagggtgcatccagactattgtagattttgcctccaggaatttgatgaggttttcatagccagaagacaagaaagactcatcttcattctggtaaaagaggagaagagtaaccactttgaaatacacccacagaatttttttaaattacactttaagttctgggatacatgtgcagagcgtgcaggtttgttacataggtaacaatttatgaatttcttcataacaaaatcctaccaaactttagcagagccttaggccacctgggagaagggtatttctttcaatctagaaccacctattcttcctgttttatctaaggaaagaaaaagccaaggaatatttggaaagtcacagcctaaagacgcaggcccactaagagactgagatttaatcataatattatagaatacttctgctactctacatcttactaccacacaacagggatccagtatagtaacagtggattatagctgaaagaactacaagatacagactgtctgaggagaagtacctagggaagtccaaaggcaagaaggtatatgaaaacaaagacaccagaggattttgaagactttggcacctacagctacagcaaacattctaaaaagttcaactactagccaagttaacataaatcctaacactagaaggcatttatctcagatcctattacctgacacgtctggctttaaacagaaaatttcaaggcacaccaaaatacaagaacaaaacaaagtctaaagatacaaaccattcattagaaataaactcaaatattacaaagatgggattatcagacagtttaaaataacaatgattaataagttaaaagttctaatggaaaaagtagacaatttggaagaacagatgggtaccataagcagagagactgaaactctacaaaacaatcttaaggaagtattgaaaataaacactgttacagaaatgaagaatgtattggataaactaattagtagaatagacactgctgaggatagaatcagtgagttggaaacaggtcaataaaaacttccaaaacttaaattcaaagagaaaaaataactaaaaacaaattcagggctgggcgcagtggctcatgcctgtaatcccagcactttgggaggccgaggcaggtggatcacgaggtcaggagatccagaccatcctggctaacacggtgaaatcctgtctcttctaaaaatacaaaaaattagctgggcacggtagcaggcgcctgtagtcccagctactcgggaagctgaggctggagaatggcgtaaacccgggaggtggagctggcagtgagccgagatcgcgccactgcactctagcctgggagacagagcgagactctgtctcaaaaaaaaaaaaaaaaaaaaaaacaaacaacaacaacaacaacaaaaacaaaaacaaaaaaactcagaacattaataactatgggacaataacaatagatataacgtatgtataatgggaatatcaaaagcagaaaggaagaaaaaaattaattaatgataactgagaattttccagacaccaaaccacagatccaggaggccagagaatataaaacagaaaataaaatcaaagaaaaataagaaactacacttggggaaatcatattcaaacaaacaaacaaacaaaaaaagaccaagagaaaatcttgatgaaaaccaaataaataaagtgcattgccaatagatggacaaatgaaacaaattcaatggatttctcatctgaaatcatgcaagcaataagagagtgaaataaaatatttaatataatgaaagaaaaaagaaacagcaacccagaattatttactcagtgaacttgttcttccaaagtgaaggagaaataaaaactttttcaaacaaaaatgaggaacttcatcactaacagatctgtccagaaataaatgttaaaagtagctattcagagagcatgaaaatgatatagatcagaaaggttaatctacaaaagaaaagaaaacatcagaaaatgaataaaggagaataaaataaaatttttaaattaatcttattcttaattgagataacataactttcttgaaatcaataataataatgtattggatgattatagtaaatggataagtgaaacgaatgacagcaacattgcaagggatgggagggaggacttgggaatactctgttagaatgtatctaagtacatataaaatgatagagtgttatgtgatactgaacttagttaaaactacatactgctaactccagggcaaccactgaaaacagttttttaaaaagttgaaactgatacgcgaacagggagataaaatgagttcatctaagattttcattggaaacatagaaggcagaaaataagggaaaaaatgcaataaatagaaaatagttatacatatagtacatattaatacaaatctatcaatgataactttaaatgtgactagactaaaatataccaattgaaagacagacacaatcagagtgaataaaaaacaaggatcatgtatatatcatctacaagaatctcactttaaataaaaacaaataggttgaaagtaaagaaatggagaattatatactatgttaatactaatcaaaggaaagcctggatagctatattaatttcatataaagcagacatgagaacaaggatgataaacaggaatacaaagtgccattttacaatgaaaaaggggccaattatccaaaaagtctaaacaatgctatgtgtatgcatgtgaaaacagtgtcaaaatatgtgatgccaaaaaactgttagaaatgcaagaagaaataaataaatatactattatagttgcttggaaacatcaacatcctctctcagtaatcgatacatcaaacagaaagaaaacagtaattgacctaaacagaagtatcaaacgatttgatataatagacacaaagacataccccatccaaccacagtagaatgcacattcttctcaggtttgcttagaactttcactaaaaaacaatattcttgataataaaacacccctttacaaatttgttaaaaataaaaatcataaaattatgttctcagacaatggaattaagctagaaataaataccataaagagagctgaaaaatctgcaagtatctggagatttaacaacatatttctaaataacaaaaagaccaaagaagaaaactgaagaaaaaaataaaatattttgagtgacatgaatataaaattatagaccaaaaaaatttgagaggtgcagtaaaaatagtgcttaaatggaagtatatggcactaaattgatataatagaaaagaagaaagatacagaatcaaaaatctaagcttccaccttagaaaactcaagaggaagtcaaattatccctgttttcagaccacatgatcctgtatctaggaaatttcatagtctcagcccaaaagctccttaatctgataaacaacttcagcaaaatctcagaatacaagatcaacgtgcaaaaatcacaaacattcctatataccaacaacagtcaagccaagagccaaatcacaaattcaatcccattcaaaattgccacacacagaataaaataaaacaactaggaatacagctaaacagggaggtgaaagatttctacaaggagaactacaaaccatttctcaaagaaataagagatgacataaataaatgggaaaacattccgtgctcatggatagaagaaatcaatattgttaaaatggccatactgcccaaagcaatttatagattcaatgctatgcctattaaattaccactgacactcttcacagaactagaaaaaaatattttaaaatttatgtggaaccaaagaaaggctgaatagccaaggcactcctaaagcagcgggggcggaaagctggaggcatcatgctatcccactacccaacttcaaactatactgcagagcagtaagcaaaacagcatggtgctggtacaagaacagacacatagaccaatggaacagaatagacaacccagaaataagaccacacacctagagctatctgatcttcaacaaacttgacaaaaccaagcagtggggaaaggaatccctatgtaataaatggtgctcggaaaactggctagccatatgtggaagattgaaactggatcccttccttataccatatacaaagactaactcaagatggatgaaagacttaaatgtaaaaccaaaaactataaaatccctggaggaaaatctaggtgataccattctggacataagaattggcacagatttcatgccgaagacacaaaaggcaattgcaacaaaaacaaagattgacaaatgagatatcattaaattaaggagctcctgcacagcaaaggaaactatcaacagattaaatagagaacctacaggatgggagaaaatgtttgcaaactatgcatctgaaaaaggtctaatattcagcatctataaggaacttaaatttacaagaaaacaaaacaaaacaaaaaaattaaaaattggccaaaggacatgaacacttttcaaaagaagacataaatgtggctaacaatcatatgaaaaacagctcagcatcactgaccattagagaaattcaaatcaataccacaatgagataccatcttgcaccagtcagaaaggcttttattaaaaagtcaaaaaataacagatgctgctgaggcagtggagaaaaaggaacacttatacattgctggtgggagtgtaaatgaattcaaccattgtggaagacagtgtggtgattcctcaaggatgtaaaaagagaaatactattcagctatggaaataattataataattctctagtatgtctttcagacagtagaagcagagggaacatttctaatttattctttgctatcattactgtaataccaaaaccagataatgatattacaggaaagaaaaattataggacgaatttctcatgaacataaatacataaatgcaaaaatccccaacaaagtgttagtgaattaaatcccacaatgtatcaaaataattagacatcatgagcaagtgggatttattttaagtatgcaagactgggatttattttaagtatgcatgactgggacttactttaagtatgcaagactggttaaacatccaaaagtaaatcaatatattctaccatatcaataggccaaaggaataaaagtcatatgatcatatgaataagtgcagaaaacacatatgacaaaaaccaacactcatgattgcatctctgatgaagaaaattaaagaacgtctacataaatagaaaactatttcttcttgtaagagtgagaaatttaatattgttaaatgtcacctcttcccaactgtatatacagatttagtgcaatacaaatcaaaccaagctattttgtacatatggacaaactgattctagtagaagttttatagaacccgatatgggtaatttataaagaaaagaggttaaattgattcacagttccacaggctatacaggaggcatggttgtgggggcctcaggaaacttacagtcatggaagaagggcaaatgggaagcaaccatgtcttcacatggtgacaggagagagagagagagagagcgaaggggaaagcactacacacttttaaactacatgatcttatgagaactcattcactgtcacaagaatagggagggggaagcctgccccatgattcaatcaccttcttttaggcccctcctccaacacatgggattgcaactcaacatgtaatttgagtggggacacaaagccaaaccatattattccagcactggcccatcccaaatctcatgtctttcttacatttcaaaacacaattatgccttcccatcaaacccccaaaatcttaactcattccagtattaactcaaaagtccatgtccaaagtctcttgactttgacatggacttttgagttaatgctggaatccttcttgagacaagttgagacaagatgagttaatgctcatccttcttgagacaagccaagtcccttctgcctatgagcctgtaaaataaaaaacaagttagttactttcaagatacaatggggatacaggcattgggaaatggtcccattccaaaaggtagagattttccaacacaaaggggctacaagccacatgcaagtctgaagccagcagggcagtcattaaatcttaaagtcccaaaataatctcctttgatcccatgtctcacatccaggccacactgatgtgaggggtgggctcccaagttcttggggagcttagtccctgtggctttgcagcatacagcccccatggctaccttcattggctggcgttgagtgctagtggctttaccaggtgcaaagtgcaagctgttggtgggttctaccattctgggttctggaggatggtggccttcttctcacagctccactaggcagtgcctcagtggggactctatgtgggggctccaaccacacatttcccttctgcactgccctagtgaaggttctccatgagggctcaagccctgaagcagacctctgcctggacatctagatgtttttgtacattctctgaaatccaggtggaggctcccaaacctcacctcttgctttctgtgcacctgcaggctcagcaccacatggaagccatcaaggcttggggcttgcaccctctgaagcaatgatccaagctgtaccttggccccttttagccatggctggagctggagttgctgggacacaggatgccacgtcctaagggtgcacagagcaacagggcccatgaaaccactttttcctcttagaccactgggtctgtgatgggaggggctatctgaaatgccctggaggcattttccccattatcttggccattaacatttgactcctctttacttatgcaaacttctgcaaacttctgcagctggcttgaatttctccttggaaaattttttttttcttttttaccacatggtcaggctgcaaactttccaaacttttatgctctcctttccatttaaatacaagttccagtttcagatcatctctgttcatgtatatgaccgtgagaagcagccaggtcacaccttgaatgctttgctgcttagaaatttcttctgacagataccctaaatcatctctctcaatttcaaagttccacagatctctagagcagggacataatgcccccaggctctttgataaagcatagcaagagtgacctttactccagttcccaataagttcttcatctccatctgagaccaactcatcccggacttcgctgtccatgtcactaacagcatttttgtcacaacctttcaacaagtctctaggaagctccaaactttcccatcttccttcttcttatgagccctccaaactgttccaaactctgcccattacacaattccaaagtcacttccacattttcaggtatctttatagtaatgccccacttctctggtatcaattttctgtattagtctgttttcacactgctataaagagctacctgagactgggaaatttataaagaaaagaggtttaattgactcaaagttccatagactgactgtacaggaggtatggctggggacacatcctcagatggtggcaggcgagagagagagtgaagaaggaagtgctacacacttttaaacaaccagatttcataagaactcagtcactgtcataagaacagcaagggggaagtctgccccatgtttcaaccacctcacagcaggccactcctccaacacctggggattacaattcaacatgaggttttggtggggacacaaaaccaaagcatatcagagtcctgttcccattgcttattactgtcaactttgtcaaagatcagaaggctacaggtgtgtggctttacttctaagtttctctaacctgttccattggtttatatgtctgtttttgtataagtattatgccattttgatagctgtagccttgatgaatagtttgaagtttggtaatgtgatgcctccaccttgttctttttgcttagaattgctctgactattcaggcttttattgggtttcatgtaaatattagaatagttttttctaattctatgaaaaatgacattggtagtttgaaaggaatagcagcatggccattttaacaatattgattcttcctatccgttagcatgaaatgtttttccattttgtttgtgtcatctctgatttcttcaagtaatgttttgtaactctccttgtagggaactttcacctcctgggttagttgtattcctgtttttttgttttgttttgtttttggtttttttttttgttttttgatttttgtgtttttgtagcaattgtgaatgggattgcattcctgatttggccctcagcttggactatattggtgtatagaaatgcactgatttttgtacattgattttgtatcctgaaactgtactgaattttatcaattcaaggatcatttgggcagagaatggggtattctaggtatagaatcatatcatctgtgaagacatatttttactttctttctttctattttgatgccttttatttcattctcttgcctgattgctttggctatgacttctggtactatgttgaataagagtggtgagaattggcatccttgtcttgtcccagtacttaagggaaatgcttccacttttcacctgttcagtatgacattggatgtgggtttgtcaaggacatcacttattattttgaggtgtgatccttcaattcctagttttttgagagtttttaacatgaagaaattttgaatttttatcaaaagccttttctgcatctgttgagatggtcacgtggctattgtttttagttctgttcatttgatgaatcacatttattgagttgcacatgtttaaccaaccttgcctcccagaaataatgcctacttgattgtggtagattagctttttgatgtgctgctggatttggtttctagtattttattgagaatttttgcatctatattcaacaggtatattgatctgaagttttcttctttcattgtgtctctgccaggtttcagaggaaaactagctaaaatataaagacacaaataggttaaaagtgaaaataaagacaaagatattccatgcaaattataaacaaaagagatggctacactaatatcagacaaaatagactttatgtcaaaaacttttacaagacaaagaacaataataaaagtgttcatttttaagaagatataagaatataaatacataggcatcaaacattaaagctcaaaaaaataaagtgaaattaacaaaattgaagtgagaaatagatagctctgcaataatggtaaaagcctttaattctcaccttcaataatacatagaacaaccagagagaaaatcagtaagagaatagaggacttgaacagcactatagaccacttagatctaacaaacatatacagaacactttatgcaacggcaacagagtacaaatttttctcaagtgtacatgaaaaactctctagtatagatcatgttaggccacaaaacaagtctttctaaattttaaaagatttaaatcatacaaagtattttacccaatcactatgaattaaaactagaaatccatagcagaaagaaaactgagaaattcccaaatatgtgaaagttaagcagcataatcttaaatagcaaatggataaaagaaaaattcacaagggaaattggaaaatatcttgagacaattaaaaatgaaaacacaacataccaaaatttattggatgcagtaaaagcagtgctatgaaaaatatttatggctgcaaatacttagattaaaaaagaagaaatatctcaaataaacaacctttcgttccccaaggtactagaaaaagaggagcaaattaaacacaaggttaacagaacaaagaacataaaaaaattatataaataaaatagacaatatgaagccaatagagtaaattaatcactatgttctttgagaaaaaataataatatgacagatctatagacagattgagtgataaaaagaaacaattgtcaaataactaaaatcagaaatgaaacttgggtcattaatactaattttatataaataaaagtgattataaaagagtgctatgaagaattgtatatcaacaaattggattacctaaatgaaagtgacaaatttctagacacgcatggcctaccaaaactaaatatttttgtaaaagatagaaaatctgaatgcacctataactaataatgatatcaaatcagtgataaaaaaaaaaccttctaacaaataaaagtctaaaatctgatggcttcactggtcaattttatcaaacatttaaagaattaacaccaatatgtctcaaaatcttccccaaaattgaacaagaaggaatacttcttaactcattctatgagggcaaccttacctgataccaaatcaaggcaaagactgtaaaagaaaaccacagaccaacaatccttatgaattcaaaaactctaaaaaaactttgtaaaccaaattcaacagcacattacaagaatttattactgtgatgcaatgatggttcacaatacataaatcaatcaatgttaatataccacattaacagaatgaagaaaaacaaaatggtcatcttaattaatatataaaaagcatttgacaaaatttaacagattttcatgataaaaacactcaacatacttgaaattgaaagaaactacgttgacataataaaggtcatatataaaaactccacagctaacattttactcaaatgtaaaagcctggaagcctttcttctaagatcagaaacaagacaagcctgattttgtcacttctattcaatgtagtagtgagatttctaggcagagtaattaggcaagaaaataaaaggcatacaaaaagttgtgtaatctctgattacagatgacatgatcctctatgtctacataccctaaacattccacaaaaatgtattgcactaataaaacaattaggcaaacatgtagaacacaaaaataatacacaaaattagttgcttttctataaattaaaaataatcaatctgattagaaagttataaaaacaattccatttataacagcatcaaaaataataaaattcttaggaataaatttaaccacagacatgaaggtcttgtacactgaaaaccacaaaatattgtggaaaaaaaatagaaacaaaaaaatttaaaaattcaagtttattaatttgaggatataatcttgtgaagatgttaataccatccaaagagaggtgaaaaatcaacgtaatctctctcaaaatcccaatgacattatttcagaaatagaaaaataatcgtaaaattcatgtggatgcttaagggacctggaatagccgaaacaatgttgaaaaagaacaaagttggaggtctcatacttcctgatttcaaatactactatgaatgacattaatcaaaacagtatgttaccagcataaaaacagatatacaaaactccagaataatatagagagcccagacatacacccttgcatatatagtcaaatgatttttgataataattctaagaccattcaatggggaaataataagtttttcaacaaattgtgtgggggaaaactggacatccacgtgaaaaataatgaagttagacccttaacttataccatagacaaagaaaattgatcaaagacctacatttaaaagcagaaactatgatactcccagaaggaagtaatatggggaaaccttcatgatattgtgtttggcaataatttcttggctatgataccaaaagcacaggcaataacacaacaaaaataggtaagttggatttcatcaaaataaaatacatttgtgcatcaaatgacactatcaggagagtaaaatgtcaatgtacagaatagaagaaaatattcacaaatcatatatctggtacaggcttaacattcaggatatgtaaaggactcctacaagtcaacagtaacaaagcaagcaacccaattcaaaaatgggcaaatgattttaatagacatttctctaaataagatatacagatgaccaataagcatatggaaagatgctctacatcactacttgtcagaaaagtacaaattaaaactacaatgagatagaactttgcatccattagaatgtctattatcaaaaccacagaaaataataagtgttggcaaagatgagaaattggaactcatgaaatgcttgtgggcatgtaaaatggtgcagctactgtggaaaacagttcctcaaataattaaacataaaattaacaaagacaacagcaattccacttctgtctatataagcaaaagaaataaaagcagtgacttgaataaatactggcacacttatgtttatagcagtattattcacaatagtaaagaaatggaatcaacccaaatgcctataaatggatgattggataagcaaattatggcctatccatacaatcgaatattattgaaccttgactaggaaggaaatttggacaattgctacaacatggatggatcttgaaacattatgcaaagtgaaataaaccagacaaaaaaggacacatattgtatgattctacttatataaagcccccaaagtagtcaaattcatagaggcagaaaacagaatggtgttgccaagagccaagaagggggaacggaaagttattgtttaattggcacagagtttcagtttgagaagacaaaaaggttctggagttggatggtgtaatagttaatataaagtgttaacttgattggattgaaggatgagggtgttgccaaagggattaacatttgagtcagtttactgggagaggcagacccaccctcttatcagggtgggcaccatctaatcatctgctagtgcagctaaaataaagcaggcagaagaagttgaaaaagagcagacttgctgtcttctggccttcgtatttctcccgtgctatttgctttctattgtcaaacatcagactccaagttctccagcttgtggactcttggacttaaaccagtggtttgccagtggctcttgggcctttggccacagactgaaggctgcactgttgagttccctacttttcaggttttagagcttggactgatccatcactggcttccttcttcctcaacttgcagatggcctactgtgggactttaccttgtgatcatgtgactcagctatccttaataagctccctttcatatatacatatatcctattagttctgtccctctagagaaccctaatacagatggtgttcatgattgcacaaaaatgtgaatgtacttaatgtcattaattgaacgccatacttaaaatggttaaaattgttaattttatgttacgtatattttaaaaataacaaaacataactgcagatttgatattgcacagagcatgatacagcatgattaaataagaattcaataacaaaaaaataactgaagtgtccaaatgtacggaaattaagcaacacaattctaggcaattcataggttaatcaataaatcagcgtaaatcttaaaatattttaaagtaaatgattataaaaatatgacaggtcacaatgtgtgagatgcaacaaaagctgagagattatttatagcttttaatgcatattttagaaagaaaaaataaattatctctgtttccaactaaaaaaagcagaaaaagcacagcaaataacacttaagaaaaataaaggaaaaagtaatgtaaatctaatgtcagaaatgtaaaacagatatacaatagagaaaattcaacaaaagcaaacatttattattttataataaaattaataaacccataggaagattgaccaagaaatagacaatgcatggattaccaatatcagaaatgaaataagattcatctttaggatcctgaatacattaaaggataaaaagagcacattataagcaactttatgtaataaagttgacacattaaataaaataaaaaaattaaagagataatttgctaaaatgaatacaaaaagaaacaaagtttaaatagtaagatgatttattaaagaaattaaatctgcacttagacaaagaaaattctaatcctggatggtttcactggtaaactcttccaaacatgtaagaaagaaataatacaaatcttacacaaattcttatagacaagagaaattaaaaataaataccttccaacagtttgtatgaagctagtataaccataatatgaaaacctgacaaagatatttcaagaaaggaagactattggccatattaaacttggatgtaaaaattcaaaatattagcaaatataatccagtggtacatataaagcatagtgcatcatgaccaagtaaaatttattcagagaatgctaggttggtttaacatttgaaaatcaatcactataattctgcacattcacataataaaggagaaaacataagattatctccatagatgcagataaaatattgagaacattgaacagctatttatggtaaaatcctcagaaaattagaagaaagacatttctttaatgtggtaaataatgtccaatgaaatttaaagatattatccattttaatggtaaaatgttaaaactccctgaggttactactaatcaaagatgccaaccattatcccttctatttattattgaataaagattatagtcaatgcaataagacattgaaaaaataataaaagaatcacagataacttgtaagtatatgtataaaatctttaaaaatctggaaactattataattagtaaaataatacagccaagtcaatgagtacaagattaatacaaaatatcagcttttccatatactggccaaataaataggaaattatatttttaaaataccatttaaaatataaaatattaaatatcttgttaatatttctacagaaatatacacaagaattctacactaaaaactataaaatatcaccaagaaaaactgataacaacctgaataaatccaaggtcatggataagaggacttcatattgttataatgtcagttctccaaaaatttatctatagattccaatcaaaatctcaacaggctttttattgtgtccagtgagctgattttaaaatttatatagaaatgcaaatggcaaagaataaccaaggcaatctggaagaacaaagctggagaatttatactacaaaagtcatggcctcttactgaaatttaataaagtttaatattgacacaagaataaacaaatagaacaacggacaatctaagagggtccacaaatagatgcatacctgtattgatcatctagtatatgataaagttgaaactacatagcactgtggaaagtatcatttttcagtaaatgagtcacagggtcaatatgatatccaacatagggattaatttttgctcttacatgacatcataaaaaggccagataaacagaggacctaaatatcaaagaatttccataaaaatagaaatatcaaagaatttctttaaaaaatagaaaatttacgtgaaagtatataaagacacctttatgactttggagtagacacatattttcaaacaagacattaagattaccaatgataaatagaaaattgataaattggactatattatgacttaaacttctgttcatcagaagacgccaataggaagagtgaatagatagcccacaaagtgggaaaaggtatttacaaaacatattcccctcaaaaaaggtttagatccagaatatataaagagcttttatcaaataaataggaaaagagaaaatctttttttaaatgagcaaaaaactcaaataagtaccttacagaaatgatatttaaattgggagtgggtgctgagcttcattagtcatcaagagaaattaaaagtaaaaccagaactttataacactacataccctgtagaatggctaaattgaaaaagaaaaatgatgctgttgtaaacattcttctactaattgggtagaaatatacagtttatctgttgggtatatacttattagtgtaaagactgtctgaaaagtacacatatgttattttttgtataaacttccaaactgttttccagtgtttataccaacttgccttcccacagttgatgagagttctagtagctcttgaaatgtgtcttgatagcattcataataagcaagcagtagataaatggattctagtatgttcacaaaatggaatgctataaagcaaggaaaatgaacaaatttcaactacacacaaaaatatggttgaatcttataaacaatatgtaaaagaatctaggcacaaaagattacatattatattattttattaatataaagtttaaaacactaatctgcattttcagaagtcaggttagtgattaccttgatggtggagggagagaagtgtatagtgaccggaagtataaattttggtaagtgcaaagaaggatgggaaaggttaaaatattattggtgaaaagtgagcatgtgagcacagactttggtgtcacagagaggaaagagcccaggctttgggtttataccaaaagggatctaagtcttcactcttttactagctggttaaccctaagcaagttacttaacactctaatattcaagtattcacttattaacacagagatgaaaatccgtgctttacattgattttctgtgcattaaggaaaatagaacttaggtaaaaagaacttagtttcatggttggcatatgataaatcgtcaacaaatggtagcagttactatttttggtaacagaaattaacgtgtcacacagcgtacgataatgttaacctggtcctgtctgttgtaaatgatgtgtgctgtagagaaaagagctatatggatagataaactgcaactagagtgtaaagggcagggataaaacttgatattttaggcactggaaagccattgtagatttttaagcatgtggacaacataattcattcttgtgttttattgcaaggttgttttggcaatgaatatacagaggagactggaaagtaggcagtggcttctgaagtttaagttggtaaaagaaacttgcacggaaatccagattgactataatcaatcctaaaactaggattatgataaggtaaatacagtggtaagacaaatatatatttggaggaagaatcaacagagttccttgaaaagatgacagagattaaatctactgaggtgactctgtagttactaatgtggtagcataattttatcctttataaaaacgtagaaaataataggtaattttggaaaagatgctaattttattttggagcatatggaatttgaagtgattagccaggagtgggttttctataagctgtcaacaaaagaattttcacataaacctcctttatgtatgtgtgtgtcttatttttcactgttttgcattctgccaagttcttgctattattttccacagcttttactccagggttttttgctgaagattatttggaaggttaagctgtatagatttggtactttttggtgtggaaattagatctgaattaacatgaggaactacttagagaggaagccccaaagactgcttatttgtgcccaaccagccagctcctgcagagcaggtctttactatacttccacaggaattgtgtcaagacttgaagatcccactgtcacatcttacactcaacatgaataaagaaagctgcttccaattccagattgcacagtctgattccacaatcacgaatattttccccattagttgctgccaaggtaaacttcacttaaaattggtttatagactgacttcaagaaacataatgtaatgatgcatgatgagccaaacaaatagatagcagatattctcttcacataccactaatacttcttggtaaaaatttgcagtttcaggaaactgcaactcccctcaaccaagtctttttctttgtttctctgtctgcaaatcagagaaaaactaaatttctcataggagtgccaccaaaacaataagcctgattgatatcaagaattcatccagagtttatcctaccatgataatgtgctatgtgttgttcgagaagcttaaagtacaaagataactacttccagtttaaaaagtccttcaaccatttcatgaaatgagattccctgttgacagaacagaaccattattgacacgcaaagagagccatctatacatctaagtggtgcatgagtatgtataaaccctataatatatatactcatcagataggcatgcttacatctcagcaaaaattgacagtcatagtcattaaaatcagcttgggaggatttttttccttacctcttagtgagattttctgctctattggtgcaatggaaacaatgcttgtgctctccaattcaatctcttttacctactccatcaccaccaccagagaccactcattatctgtagcctaaaactatatgtttcccttggggcccaaggttctttgccaaattactttaaatgtttacgtttttttcctagtataaataactgattacaacatttgataatgagtattaatgttgaaataatttaaacaatgacataggattctaccctactccctttcaaaaggcagtaccactattttgttctatctgtacattttctttggatgagtctgtgtctgtgacaaaaccatccttcttctttctccaatacaattgctaacacaacatttatatttttttctggctttagcatagctacttacctgttataggataggatgaagaaaacttggaggactgggatctgaaacaaactctacacctggatgagaaacacacatttggaccaactcagtcaatggtgctgtgaacacaatccatcatccaacgtatagcattcaaagtgaataatagctgtactttgtaacctaggcaagcatgcctgtaggcagccatgtgcttcaactaatggatggataacagctatagggtagtgatactcaaagtctgggtaagcaagaggcagagtggaagatgtccaatggatagtagagctctagtcaccgtgctaaggttcagtaacaggaattaaggcaggaagatagaaatcaaagcaaaggcaagacccagatacaagagtattaggcagactacaaagccaaatgactcaagcacaagaatatgaactaaatcatatactttaaaaaaaatcagttacaatggaggaagttcacctgtagtaggggtaaactgactaagtctcagagtgctgaaaaacagctatttgtacatgttatcatctggatagaatttgtcctagagaaactgatagagatgaatgtacaggaaggctaattttttaagacaggggtcagaaaacttttctgtaaacagcccaacagccaatattttagacctaaggacaatgcagttacaactattacactctgccatcacaatgggaaagcaagcatagatgtaaacaaacaaacttctatgactttttttttaaattttaatttaattctggaatacatgtgcataacacgcagatttgttacataagtatacatgtgccatggaggtttgctgcacttatcaacccgtcatctaggttttaaccccacatgcattaggtatttgtcctaatcctcccctggtcccccactcccagacaggcccaggtgtgtgttgttcccctccttgtgtccatgtgttctcattattcaactccctcttatgagtgagaacatgcagtgtttggttttctgttcccatgttagttcgctgagaatgatggcttccagcttcatctatgtccctgcaaaggacatgatctcattccttttcatgcctgcgtagtattccgtggtgtgtatgtgccacattttttttttatccagtttaccattgatgggcatttggactggtccaatgtctttgatattgtaaatactacagcaacaaacatgcatattcatgagtctttatagtaggatgatttctaatcctgtgggtatatacccagtaatgggattactgggtcaaactgtatttctggttctagatccttgaggaatcaccacactgtcttccacaatggttgaactaatttacattcccaccaacagtgtaaaaacattcctatttctccacagcctcaccagcatctattgtttcttaaatttttaataatcaccattctgacttgtgtgagatgatatctcattgtggttttgatttgcatttctctaatggtcagtgataatgagctttttttcatatgtttcttgatcacgtacatatcttcttttgagaagtgtctgctcatatcctttgcccactttttgatggggttggttgttttttttcttgtaaatttgtttgagttctttgtagattctgggtattagacctttctcagatggatagattgcaaaaattttctcccattccataggctgtctgttcactctgatgctagtttcttttgctgtgcagaagctttttagtttaagtagatcccatttgtcagttttggcttttcttgcaattgtttttggtgttttagtcatgaagtctttgcccatgcctatgtcctgaatggtattgcctagtctttcttctagggttttatggtttggggttttacattttaagcgtttaatcaatcctgagttaatttttgtataaggtgtaaggaaggggcccagtttctgttttctgcatttggctagccagtgttcccagcaccgtttattaaatagggaatcctttacccattgcttgttttttgcaggtttgttgaagatcagatggttgtagatgtgtggtgttatttctgagatctctgttctgctccattggactataggtctgttttggtaccggtaccatattttattggttattgcacccttgtagtatagtttgaagtcaggtagtgtggtgcctccagctttgttcttttcgcttaggattgtcttggctatatgggccattttttgttccatatgaaatttaaagtaggttttctaattctgtgaagaatattaatggtacttgggcgggaatagcattgaatatataaattactttgggcaatatggccatttttacaatattgattctttctatccattgattctttctattctttttttccatttgtttgtgtcctcttctatttcattgagcagtggtttgtagttctccttgaagaggtccttcgcaacccatgtgagatgtatttctaggtattttattctctttgtagcaattgcgaatagacgttcattcatgatttggctctctgcttgtctattgttggtgtataggaatgcttgggatttttgcacattgattttgtatcctgagactttgctgaagttgcttatcagcttaaagagtttttgagctgagttttctaaatatagaatcatgtcatctgcatacagagacaattcacttcctttcttcctatttgaataccgtttatttatttctttatttctctctcctgattacccagaccagaacgtccagtactatgttgaataggggcagtgagagagggcattcttgtcttgtgccatttttctaagggaatgcttcccacttttgcccattcagtatgatactggctctgggtttgtcatcaatacctagtttatgttccatcaatacctagtttattgagagtttttatcataaagggatgttgaattttattgaagacctttactgcgtctattgagataatcatgtgatttttgtcattcgttctgtttatgtgatggattacgtttattaatttgtatgtgtcgaaccagccttgcatcccagggatgaagtcaattagatcatggtggataacctttttgatgtgctggtggattcagtttgcctgtattttattaaggattttcatattgatgttcatcagggatattggcctgaagttttcttttttcattgtgtctctgtcagcttttagtatcaggacaatgctggcctcattaaatgagttagggaggagatccttcttttcaattgtttggaatactttcagaaggaacggtaccagctcctccttgtacctctggtagaatttgtctgtgaatccatctgaccctgggctttcttttttttttttttttttttttttttggttgttaggctattaattactgcctctatttcagaacttgtttgtctattcagggatttgatttcttcctggtttagtagtgggaaggtgtttgtgtccaggaatttatccatttcttctagattttctagtttatttgcgtagaggtgtttatagtattctctgatgttagtttgtatttatgtggggtcagtggtgatatcccctttattattttttattgtgtctgtttgattcttctctcttttcttctttattagactagctagcagtctacctattttgttaattttttcaaaaaaccagctgctggattcattgattttttggaagcattctttgtgcctctatctccttcagttctgctatgatcttagttatttcgtgtcttctactagcttttggatttgtttgctcttgcctctctagttcttttatttttatctttattattatactttaagttctgagatacatgtgcagaacgtgcaggtttgttacatatgtatacacacaccgtggtggtttgctgcacccatcaacccgtcatctacattaggtatttctcttaatgctatacttccccaagctccccattccccaacaggcctcagtgtgtgatggtcccctccctgtgtccatgtgttctcattgttcaattcccacttatgagtgagaacatgtggtgtttggttttctgttcttgtgttagtttgcagagaacgatggtttccagcttcttccgtgtccctgcaaaggacatgaactctagttcttttaatagtgatgttacagtgtcgatttgagatctttcaagctctctgatgtggccatttggtgctataaatttccctcttaacactgctttagctgtgttgtctctttgttctcattggtttcaaagaacttcttgatttccagcttaatttcgtgatttacccaagagtcattcaggtgcaggtcattcaatttccatgtagttgtgcagttttgagtgaatttcttagttctgagttctaatttgattgcactgtggtatgagagactgttatgacttttttttttaatgttcaaaaaacaggtagtgggtctgatttggcccacaggctatagtttttaaaccctcttttagggtgacatttaatgatatcaggcgaaaggagaaataagcttaacaacagtggggcaaaggccaggccaaatactcttttcactttaaacaatgaattgggcttaagaccacagtcagccttttcttttttcattccttcctaactctaccaaaggactactctcaaatactcctgttgagtctttgtaattgaataggtctgttcatttatgtaacttagaataatataattaacttaaaaagataattatctaagaaaataattgagctaataaccaaaaagcacactagattccactattttacctatctctttatatacctgtgtttcctttctctagtttcatgattgcaatgtaacaaaatccttcttcaaagaaactgcataacctttgcctgtaaattctttacaacatagctatggcctagtcctttcagatgactgtataactaggaaaatgttcttacagaaaattaaggctacttcttattttgaagctttaagtaacgtaggtcagaagatataggtcagtaaaggacacacagaaactgcaaattctcagagagccctaaaatgttttctgaataatttatttgactgaaatcatgtggtgacctataggctgcaaaatataaatcatatgatcccactatactatctcctggtttggcttaaatgtggaaaatcctgactaatatagcacgcaatgatttttaaaaatacggaatttcccagaggaaaatataataataagctctttggcttggactaaataatattgaaaatatacattttcatgctttcctaacattatacagattgtgcagccagtcaatcgatgttattccattatctcagttgcatttacttctttggagtcaagacctttgaataaagtagttatacaataaaaagagtccatcccacgctttaagtgatactggtgcttatgggagaaagccattgtgagttgacaggtttgtacctagtctttcaaccaaacagcaaccactgggagttgacaggtttgtacctattctttcaaccaaactgcaggtatcatgttcaataaagctgccagccttttcactgaaagtgtacttataggcagaaaaataactattaaaatgactccatatggagtcttggggctccatgtttattctctttcagtgatttccagatcagatttgctcagtttataagtaaaaagattttcttcctagctctcggtccaggaaattcccattaggataaaaacatagctgtattcactcaacctctgacactatcacttggaatgacatttctgcaaactgagtttcagacaaaatcatattgaagtataaaccaaaagctgcatcagttttaccaacttccccgccacttgtaatacatttgttgccttctattattatggaaatacccaccctgtccctttaccccaagtaaaaataatattttaaatgacagtgaagagctcaaattcttaaatgtgatatcatatagatcatttatcccataactcttaacacatggtagaattcagattagattcttacacataatgtaactatatttctaggaagttcttaggctatatagcatacattgaagtaatcgccaccaaagattcagttaatagttgtattagtcagagttctctaaagggacagaagtaataagatatacgtatatatgaaggggagtttattaaggagaattgattcacacgatcacaaagtgaagtcccatgataggccatctgcaagctgaggagcaaagaagacagtctgagtcccaaaacctcaaaagcaggggacccgacattgcagctttcagtctgtgactgaaggccaagagcccctggcaaactactggtataggcccaagagtccaaaagcagaagaacttggagtatgttgttcgaggacaggaagtatccagcacaggataaagatgaagtcaagaagactcagcaagtctgctccttccaacttattctgcctgctttgttctagctgcactggcagctgattagatggtgcccacccagactgaggacaagtctgcctctcccagtccactgactcaaatgttaatctcctttggcaccacccttacagatacacccaggaataatactttgcatccttcaatccaatcaagttgacactcaatattaaccatcacaatagtgttatagctaaatgtctgattgaaacttttgaaaagacctatccaaaatatgctagaccagaattattaatggcattaaatacagaatccctgcttagtggtccatatctaaaaattcagcctgatccaactttacgttccttccaccattatcccatactcttagtatccattcccatgccggttctccagatttctgcttatataaattagaaaactgaaacagttgttttggagtatagcacactttctcatgggtcactaactagtatactctctctggtccctcttttatagccagtatattatgaaatttgatgagttaaaaaggaaaaaaagtatatgtgattctttcaaattgttgttgatcttagaatttttgggctattttcacacatttacaaatactagcaataaatactttccatagactgtgatactcactctgcataacattttaaaacactggctcaaccattttatataaaaagccaactgacaatcctttaaaaaatctcaaaataaggaccatatggctgcatatggctgtacagttacttaatataactggtgtattaattttctatcattgtgtaacaaattaccacaaaatagtagcttaaaacaccactcatttattagttcataattctgtagaagtctggcaaactatgattgggttctctgggtagaatttcacaaggctaaaatctaggtatttggcttgagtttttatctggaggtgctggggggaattttcattccaagctcatgaatgttattcacagtattcagttccttgtggttttagactgtggtccccaattctttttttatatgtactttaagttctggggtacatgtgcagaatgtgcccttttgttacataggtatgcatgtgccatggtgctttgctgcacccatcaaccagtcatctacattaggtatttctcctaatgttatccctcctctagccccccacccaccgacaggccccggtgtatgatgttcccctccctacgtccatgtgttctcattgttcaattcccacttatgagtgagaacatgcggtgtttgcttttctgttcttgtgatagtttgctgagaatgatggtttccagcttaatccatgttcctgcaaaggacacaaactcatccttttttatgaccgcatagtattccatggtgtatatgtgccacattttctttatccagtctagtattgatgggaggtccccatttatttactggctgtcagctgagtgtcactctcaactactaaaggtcatttacattttttgcatcatgtccctttccatattcaagctagcaatgacatgataagatgttctcatgtttcaaaccactgacatcttttatgactagccagagaaaatgctgctttaaagggtttatgtgattatgtcaggatctcccagataatttccctatcttaaggttgactatgccatataacataatctaatcacagaagtaagattcacaatatttacatcccaggtacagtgcaggatgcgtatatggtgggggaggaggaggttagtggtaaattgtgggtgccattttagatttccatctaccacacttaggaaaattggacttagtattattaattcatttaataaatagtttgtaatcccctactatgtataaggtgctgttctatttgaggagttattactttcaaccagaaattaaggtttaccttattttataattctgtaacaatatatgacagtgtcttagaacacaactttggtatgaaacagaccagagttgaatctcacttatatcattactggctacataatcttggatgcgttatctgagcttgtttctttgtacaaaaagtgagagtaataccagtatgtatttcacagggttgctgtaagaattaagtgagataatggctgcaaagaatttattaatagtacaatcttaatatatcaatcactgaataaatggtagtaagaagtgctgttacatgacttttgaaacacatatgacaatttggctgtggggtatttatatttttttctttgcaagatcaggcaaaatatactttatattcccagttttttctttcactgtaaactccactggaaggtatgttgatattcatgtttatggcaatgccttcaggcaccagttactataatatatatcaaaattacaattagctgaggccaataatactgaccctttatctgaaaagaatggcagctctgtagtgcttggattatctcagttcaacatttctttagctaagtggtctctgaaggatcattcttcctcttattataatagaaattagaaaaatgcacacacacacacatgcacacacacgtgctcactatgctcatcataattgtacctcaatatcaaagaaggaatgatgagaatctaaccactgaatttcactaatactgaaaacaccagtctctcattttagctgatagattagaaaacttttcagtacgttttaaaaatggctactttctaccactaagcacgtagtctatgagaaatcaaatttactaaaagataagtttaacaaagttcacatttgacgaagtacagggaaatgtacaaaaggcaaggcttggcagagcaatttatgagttttcactaatggagaactattctaaaatcaaagtaatacttatacttgtttaccgtctttatacagataggccaacaaccaactgccacatcttaaactcttgaaacaaatattttccatatggccttagagaaatagagttgttacataagttaggaaggatgatcctttatatttatcctgaaatttaataacgcagaatattgatcatctaatttaaaaactgacattaaaagaaggatggatcacattattgttctcattttcatcataattttgcttaaggctgaagttataatgacggagtgtctgcagcttacatttggtggcatcagggcctattacagttttaatttgctgattgcatttatttacaacagagctattccaataaacatgtgccaatggtttgttaccagggagatggttagttaccagggagattcaaagttgataaaagtctattgaagatgatgctccaatacaatggcattaaatacatttatacatatcaatactaatgtgcaatatttgaagtgtgagtattctattgatgatagccagtctctaccccaatatcctccagatactcatagcccacttggagtcttcagataggcactgaggcgcatagacagtcaactccatatcttagtcatcaaattaaagatttggtgaataacaacagcactgcaagctatttcttgagataactctatagaatttgaggcagttcaaagcagtccctacccagtgggttagccaatctaattaagcacctaattttgaaaatcgagccctcgattttattgcatactaagcagatggcttattgcaaaatgggggtgggaagaggtgggaatgaaaacttaaaaacttaacaaaagttacttgataagtcactctgacagtaaaaactagcagaaatcagataacaatataaactatgacttaatgctgacctttgagagtggccagcacactaaaaataagtcattttaattaaatacagatgatttaagagaaatcatatgcttctggcctaacataggtggattaggaaaagggaatattattagtcattagtacttttcattaataatttctggttctccttctggacaaatggcagaattatacttcctgtctccttggaattagatgtggccttgtgactcattttgatcagtgaaatggtgacctgtggcattttcagatggaagctttaagagccagtgtgagacttactgacttctttccttttctttgctacagtgactggcaatgtttgggattgcagaggctccagtagcctgggaaggtgagaaataaactttgatactttaagccaccaaaacattgggattctttgtttccaaaatatcctcctggcctatcctgattgctacagaaaccattgagctgatttctaggcgaagaaatgataagctaactaggatgaagccttatttctacatatgaggaagatgggcacaacatccagctctttccttaactttggaccaaaaaaaaaaaaaaaaaccctcctgaatctggatccaaaagttgttgtacacacttgcacaagttgattagtgcttgtagtttatgcttttatgcaatatttgcattgcagagagagtttcaagtaaaattaagaataaaacatacagcaaatttatttaaagtcctcctcgaacattaagtcataggaccaaggtcatgcatataactgttttggttgtatcatacagctattgatttttttttcagttggtattatttaagacagaagaatctctcccatgaatagtcaataagttttttacaagatgacatcatcagctatactatcttgtcttaggatactggcctaattttatgcattaaatgtagttatggaaaacacagtcttggaaactaaatgtgtacattaaattatatttgcttattgacttccattataattttagagtttatttcctattagaaagcatgcttacttgaaaatagaatatgaactacattttcaaagcctaacattcactttgagtggtattatcttggtctatgtgcatttaactatcttatgaaatatctcacagtaagtctgccaaatggaaaagtcattccttttttctattgtttgttcactgtttcttcaactaacatctactgcatgcattctatgtactatggaagataaaaagataaataacacatggttcctaccccaggaaagatcatttcataattatttagattatatattgaatattaaaattcaccataattattttatatccttggaaactctcatttactccgttaaacttaaatttaaaattaagtcaccacattgacacttcatgcactcaacagagctcactagttaaaaaactgtcatgaatataatttccattctgaattcaagaatttttaagtgattattacgtattactagcaataatgatagtaaaatttttaagtctttggaaagtgcaaggcataatatcattccatttttcttcaataacttttactaaatagtcaataactaagtatttctattactgaaacacagaccgaaattgtgtgaacagcagcagaatagatcttactataaagaaaccaaacttcagaaagctcaaagcattaagtaacatatgtacatctaatcagatgaaaggttgagtccagggacattgtctgaggcagcaaattcagtaacaggtataggcttgtaagctgtagcatacaacaggacagacgagttaagaaaaatggttcttaatccagtctatcattgttggacatttgggttggttccaagtctttgctatcgtgaatagtgccgcaataaacatacgtgtgcatgtgtctttatagcagcatgatttataatcctttgggtatatacccagtaacgggatggctgggtcaaatggtatttctagttctagatccctgaggaatcaccacaggcctgttgtggggtggggggaggggggagggatagcattaggagatatacctaatgttaaatgacgagttaatgggtgcagcacaccaacatggcacatgtatacatatgtaacaaacctgcacgcttgcacatgtaccctaaaacttaaagtataataaaaaaaaaaaagaaaaatggttctatgaagtaaatgactatggtggtgaattatgaatgtggtatgctagctgtttaatgtctaaccactttacattcctttctattccttgcttctcactgctctcagagagagggggagctctgtaagaattcttctgaggttccacttgttaaggtaggcctgaaaaatgcaaagatagagacctgttgctaagtttcccaggatcagtcttataaaccacattttttcctcagtggataaaatcttagaggtccacccagattcatagaggtgcccccagatttcctaggtatgaaggctttcctaaacacaatatggatttctttatgcctttgaacagctactgtctaggagagtgaggagagtcacatatggactttcaagaagaggagaagaactgtatgtgaacttccacaaagggttagacattcactctggaagtgaggcctattgtatggctgtctgtaaaccacacaatgaagctctgtggcatcttgagacatggcccactttccttggtgcagggttgccactgtcatgtgaatagtactagaagtccataaaacaagagatggaaagcaggaaagttggttacagcatgaaaaattaagaatcagtgtgcaagagcacaagacttgagataagctctgaaactagaactgtggctatttgctttctgtcctattttatacgtcctgttgtatggagttaggcagggtttttcaggcaagtgtttatagccagcaggaggggctgggccctgtaggtgcagctagctactgtctaagctaagggcaaaggcacgggccttttgggaggtacttacatcagtctttaaaggatctttgccactttggcagcacctttgatggcaggagagatgctgcaggcaagattccacctggtggaagagcctgtgcatgagcacatgttagccatacagatacgtaatctcattcactgccttactttattaattgaataaaacccaaagcaaaattaaaccaatgcaaaagcatggcaaacttgtatgtttaatatcatattaatggtcttgctgataaatatttacgtcatttattcatgattaggacatctttttatatagattagaaagacatacaaatggtaaggagcatgttctcttcaaactcttgagagactaatattaagtactgcccaggtttactcaactgacattcagttgtctacattttcaacataaaagtgagtgaactaaaggcagttttaaaaatctcttctaaaatcagtgtatatcaatcagttttgggagctacaagagacttcagcttctagtatgtcaacaaccctccattgctcaaccttcatggctttggggacctgcttcagtgctcctagtctttcctgtcctaatggtacaagtggattatatcaaggaaaacttgagattgctggaggcagcactgattcatctgtggaggtcaagggctgtacagccatgactttttgcaggttgatagcgccagaatcttaataagaggacccatgttagtgaaagaaaggtgactgcagcagctattcactcaaccctgaaaggctgaaaatggggtcacctgtcttggtatttcaattagggggttacagctactgctgccattgctgcttcaatcatttgctcattttttttcctgagaaggtacttctgatcctgggtctcaggacacctttttgactgggagtcttctgactgttggtcatcagcaaattgaggagcagggggggatttgagggagaacataaagagatgctgtggatgtatttcacatcttagataaaatttcagctgtgatctgtgtaggcagtagatattgctaataaaaaattctgctgtgaaaaaaattttttagtttgttctgagtatccctggatgagtactacagagcataatttgctctgtcctcacctaatcacagtagggtttggggcttctacattgaagagtgagtgtggtccttgccaaagagcagataagggaaataatagatcatctatttccctagggcaactaacactctaggtcttctacatctcaggatcccagtttcttcaggtttaatgtctaaaatgaggtgaagctcacagtctgaatccaattatatatatatatatatatatatatatatatatatatatatatatgatatagattaatataatctctatattatattattaatataatagaatacagatattaaacatatatatatggctgtattttatatgaaaacaatcattctagaggatgttgtaagctatttctagattttttgcaaaataaaacttggtcattatataataactgacaatgataatagttacaacaataaataagatactgtttttcaatggtgactacatgtacatgccagtcactgtgtcaggctttttccctttatttgtaactaaattgcaataggagaatatatcatattatgggggtagggataactctggccatctcagaggaaaaaacagaaaaagagaggaaataaatgacattaattatgtttgctttgctgaagagtgtgtgaaacagagaagcaatccaagaagccacacatatgaagatgataatagaaacaataataaccatttactgagtacttatgtagcagttatcttattaaataacaatacataaattatattgtttacttcccaggaaactggcgttcaaggaggtgactaatctaaggtcatctagctaagtgacagagacagtattcaaactaaggtgcctctgactccaaagactattcaaacttccagactttgctaaggacttccaacaactgcattatactgataaaagttgcctgtcagaacctgcacgttgtgcacatgtaccctaaaacttaaagtataatattagtaaaataaaaaaaaagaataaagaggatgttccataactcagtctgtgagtcagacaactgaagaagcctaccttctgccacataggtaagtgaggagtgtctccaagttcatttagtaagctggagaaatattactttctgcatgaaaatactagctcagtagattttttaaaaatgtactaattacatgtttttaaagttaactctgtggtaagagaatttgtgtgtttcatacattcccatgagtgttaggaaaggataaaaagccaacaaaggccatattctcacgaacaagagagcaattcccattggcaacaaaatactgaaattcgttgcaatgatttgttacagagagtatactagcctggaatgcactgattgtcaaggaaatggatctctgaatttaaaagaccagtgccttttagggaagcagaaagagaaggtattgccctaatataacagtatcaaatctcaaaccaaagagatttatggagcagaagaagtcttgattgccttctatagaactataaaagctcaatgtgctaaagaaaacctttggcttcttttgagccactcaattgtttgattattgtcatgttcatcatcatcataactgaaatgtgttgaatacttaacacatgttgagcactatacatataacaattcatttaatccccatatcacactatgtggtaatgactattactatattattttatatttgaaggaacagtggcaattagagattagattacttgcctttggtcacaaaggtagcaaattcagatctggaattctttacttgggcaatctgacttcagagatcttctaaaccactatactacacctactcctgaaactgaaatggtaggtattattatcactatcattaacctgaagcttagtcaattttagtattagaataatattcatggttatttgtcttccttgggctggaagtgggtacatatattgaatggcagaagatatgattggcagcttccctaacatgaacagaaatgggtcaactataaacagtctgagcaaaagaaggtattaagggtacaccaatatatgcgtacaaaattaattgcttgaaagaaggaccattctattctaattgtataatgctcaaatggtctttccatctgtgctgctttttggctaagggataaaaagaaataaaaataaaagaagcagaactgcaaaaagcatcccactgcaaataactgctggaatcttaatccgaagataacataggtgtatgtattttatgaaagtgactgctactcgtatataaatcatttggaaaattatatgcattgtgattataagtttttgacataaaaataaaattcaattttacaaattctagttccactaatttgaaattatgatattgattgtcacaatttattaaattcctgctgtgatttaggtactaaactgtggagttaagcctaagttaacttctttacattttattttaaaagctacaaagtataatatgtatatgcttattttacagttaagaaacgtaggctaaaataagcaattttccaaaaatcacactactggaaactaggctttcatcttaatggggaaagaatagagtctaatacttttgacctactgtgtgcccagtactgatctaggcaattcacaaacattgtctcatttacatatatattcaggggaaggatacaaataatataatataatagatcacgatagtagctgctgactgtttacttgctggaaaaaaggtttatggtcaggtgaaatagtgaataagcaaattttactctcagagacctttcttctttggtcagactgatcaaatgcacattgacagctcctgaaacagcaaatagaacctcagaacatgtttaggtatcagcattgtgttgtacatgaaaccatgccaccttgtttaagcagtggactatgtttctgagccgcataggcacatagctcaaaaaaacactgatggccaaaccatgattcccaaaatataaatgtatacagtagagatggttttgaacatgcctagccaataatgcaagttttagttctgtccggagagacaagggttacaaagagtttctataaaatattaataattttgcatattcatgacctaacaccaaaaatatcttttctcttttttgtaattctcagagagcagtttaagaattttacctaaagtcaccgtgcaagggggatgagctccagggactgtcatttttcacaggtgtgttttggattaaatttggataccttgttaaaaaacgagttttctttttctttctgcagagcacgtgtttttaccttcgtttttatagcaagtttaagaaaccattaataaattagccatcagtgactttaaaatcaatgtgtttctggccattgagaaaacctgttcacgtgttctagtggtgattgtttgctattttggggataataaagtgttgaatttttttttttttgagaaaggaatccagcagagctctgattaaagaggactttctaataaacagcagtttgaaacaactgctctagaatttaatagcccctttgcatgcaccagaattttgagctaaagctagaatataacaaagtcataaagggcttctcctatattcaagtcacatcaagatgaacccaaaagagcaccctcgcattctttcaacatccttcctctttctcttacatacatgaaatatcccttcttcacctgctacttcaaatacccattcattggtggataatatcctctatgatttgaaactcaaaatgtggtctgtggatttacatcatcagcatcacctgagcctttgttaattacagaatctctggccatacctcagacttactgaatcagaatttgcatttaacaagatttccaggtgattcatatgcacattaaagtctgataagcacagctctataatagagtttctcaaccctggctcaccattaaaatatacatagaagaggttaaaaaaatactaatgcctggccctaaccccttctgcccttttccaccaaaattcagattaagtgtcttggtgtgaagtccaatgattcatatatatatatatatatatatatatatatatatatatatatattcagatgttcagttatttcaactatttgccctaggctatagattgtccagctttgctgtattcccattcgttcttaacttcaatttctgataccaagttgctatattttatcttatttttgtaaataatggtcaatgtctttgagagacaaattgaattcatgttgctttgtcactgggcataattgtctttaatttctgttcttaaatggtggctaccagcactctcagatctaagccctgaatatttggcatgtgactagtttgggcctagctgggatgcatccctaaaatgggcaaccaaaaaatatctgacatgacaataaactatattcagtaagagtaggatttctaattacccattcaccttgatttgacagctattaactttgttattaaaatatacctaatgatggccaagatgatatttacaaatgtatttgttagagctgccatctatacaaaatgtcattgactcttcttggttaatcatatttagtaaatcctcattagaaaaatgacaaatactcttttattaagatcactaaccacaaagttatttgttattcatattgatataataggtagttccaaaggaattatggattaagagaaactttagtcataatactagtttatagtttccatgttcattatgcaaaatttagtgcaaatgataattcccagtcatattaaatgaacaggaaaacagaaatgatcacattttcatgaaagtgattaaagtgatattttcaccttgaataaagcagaagcaatacactgacagttttcattatactcactgtatcacttctcgagtagaaataaccatctcaaagctatatatgcatgtcacttttgaaatacagtgtgtgtgtgtgtgtgtgtgtgtgtgtgtgtgtttgtatttattttttatggttttgtcgaagacaaatttttaggtaattggtacttataactgctggcatagcattgaaaatccaataatttctcatttttaaatagttaatactatatttaaataaattgtttttatttattttgttttagtttagtatttgtgttgttgttatatcacagcctcgcctctacttccactccaggaaaagtcaaagtcacaaataatacccacagaccaaattagatttagatttttttataccaagattcaaatgctaacagatcaagatttttcaggtcaccaaaagaagggacttcaaaaaagtccttaaatcatttctgttctccaaggcatggcatgtgttgtactgtgcaactctccatgtgtacatcttataatgaaagtacagaacactctgggactgtgcacaaagaagataccaactaatgagatcactgcagcatttgtctacggcatccttttggaagttgataataagcagtgaaaataacacctttagtgccccaaaacgttgtttggactgaagtaacttgcttgcagcagtcacgatcaacttgagcaaactaaacacaaaataacaaaagcttagacccagagtccttggaagcttaccaataagactctgaacttgaatagcagtttttttctcaatatagacaacttttctgctcagttttggctgcggaccaaaaactagcacagtagattccaacttacccatgttattgagttaaatcacagatgttagcacttaccagagtactaggcatgcagtaggggctcaaaaactgacttgtgaatccaatttaaaattttgtatctgaaaattgagtttgggaaatgggtaggtaggaaagggaggaattgcatttgactctaataacagtgccaattagagactggaatgctactgttggagggaccgtattgccagacgtactgagattacctgaaggcaaataatcaagtagctatgatcttgaattgttcatgtcaggaaaatctcatctgaatcgaacccctgtctttctatgattgtgggttctctctatccgatgtatactaggttcttggattctaagtggtaataagtgacaatgccatgaggatgcactagtagcccttgttatgggcctgtaaatgcacaaagctatggcaatttggtcgtgcaatatattattttgcaatgtcgttgagtctacaaggttggaggaattacttctctttgtctctttcccttgctgcttattttgactctttcttcccacttaagtcacaagcagctaagttatattcattcttggaagctgtcttgagaagcctggagtacatggaagcagatattgtggcaaatcctcagccgccccttcctctctccacctgtctttcccttgctccttccctctcttctttctttggttcagctgacacgggatggctagaagtggtgtccccacacaggcttgaaaagatctagggtgcgacataactcactgaggatccacattgtaatatgggaagaatcataatggtaatatagttacttaacctggttatgtcacaggtttcttatctctaaaatgtagataaataaaggcatctacctcaaagacttacttcttctaagcattctataagaatgtatagagtgtgcttaaaatagcatccaggcttaagtaaaatctacgtaaatatttgattttatttcaataatttctaccaaaaaaaaggtggggtcatgtggtctgagcataaagatagtcagtgacatcttaatggctttatcactgtccaaaacatccaccaaaccctggtgccttcctaggccactgaagaaataccctggctccggcgaatgttataagaagataagaggtcttcatgtctaccagccagctattcctaatccaattggtgtatcttccttctgtttcaacgattcttatatctaggtatgatcacagtgatgtaaatcacattttttgtttttctacttttaagttcaggggtacatatacagttttattatataggtaaactatcatgggagtttggtgtacagattatttcatcatcatctaagtaatatgcataatacctgatagacaggtttttatatcctttccctccttccaccctccaccctcaagtaggcccctgtgtctgttgttcccttatttctgtccatgggtactcattgtttagctcccacttataagtgaaaatatatggtatttgcttttctgttcctgcattaatttgcttaggataatggcctacagctccatccatgttgctgcaaaggacatgatcttattcctttttatgactgcatagtgttccatggtgtatatgtaacatattttctttatctaatctgtcattgatgggcatttagattgattctatgcctttgatattgtgaataatgctgcaatgaaaattcacatacatgtatctttatggtagaatgatttatattcctctgggtatatacctagtaatgatgttgctgggttgaatggtagttctgtctttagctcttcgaggtattgccatactgctttccacaatgattgaactaatttacactcccaccagcagcatataaatgttcccctttctctgcaacctcaccagcgtgttatagtagttctgactgatgtgagatggtatctcgctgtagttttgatttgcatttctttgatgaatagtgattattattgccttgcctattcaggctctttatttaatttcgttttttcatatgcttcttggccacatgatgtcttcttttgagaagtgtctgttcatgtccttgcccactttttaatggggttgctttattttgcttgtgaatttcatgttccttatggattctcaatattagacctttgttggatgcgcagtttgcacatgttgtcttcccttctataggttgtctgtttactcttgtcatagtttcttttgctgtacagaagctctctagtttaattaggtctcatttctcaatctttgttttttgttgccattattttggtgacataatcacaaaagctttgccaggtcctatgtccagaatggtatggtatttcctaggttgtcttacagactgcatttctttttttttttttttttttttttttttttttttagttttgggttttatgtttaagtctttgttctatcttgagttaattttcatatgtggtttaaggtatgggcccagtttcaatattctgcatatggatatccagttatcctctcaccatttattgaatggggagtcctttcctcatcgcttgtttttggcaactttattgaagatcagattactgtatgtgtgcagcattatttctgggctttctattctgttccatttgtctatgtgttttattttttgtaccagtaacgtgctgttttggttactgtagccctgtagtatagtttgaagttgggtaatgttatgctcccagttttgtctttttgcttagaattgtcttgcctattcaggctctgttttgattatatgaattttgtaatagtttattctagttctgtgaagaatgtcattggtagtttaatgggaatagcattgaatctgtaaattgctttgggcaatatggccattttcatactgattcttcctattcatgagcatgaaatgtttttccatttgtttgtgtaatttctgatttctttgagcagtgttttgtaattctcattgtatagatctttgaccttcctggttagctgtattcctaggtattttatttttttgtgggctttgtgaatgggattcccttcccaatttggttctcagcttgtatgttgttggtgaatgggaatgctgctgatttttgtatattgactttgtgtcctgaaactttgctgaagaagttgtttttcaattcaaggaagcttttggtagagactattgggttttgtagttagggaattgtatcatctgcaaacagggatggtttgactccctttcttcctatttggatgccttctatttctttctcttgcctgattgttctggccaggacttctagtactacgttgaataggagtggtaggagtggtgacagaaggcatccttgtcttgttctagttttcaagaggaatgtaaagcagattctttgaagagcatgtaaggcaagtgtccttggtggatttgacttctggttataatctggcctgaaaggaaatactgcaagatgtacattgttggcctggcgcatgctgatcactctgacaagaaagatctccctctatgaaaagaattcacctagggacataggggtgtgtgtgtttgtgtgggcgggggggggggtgggggaagtgggggggaagaagacaaagagatacggagacatttgttttctagcctagaaacaaatgctaagcagtcttatctatatattttccaattcagtttttcatacccacggaattcagatggttggacatgactgaaccctggtttcaacgtaaccgtgtaaaataattgctgtttttcacattttaaagaaggatttcagacttgaagacaagaagctcctttctcctcaatagtgctcactcttctttagtcaaattttaaaaggctctgagctgctaatctgtacaaatataaaatacgaaaataaaatgaaagagctgttcaattattgcccggcatcataataagaaaacatactatctatctgttaactttctctttcacctctaccaagttcaccctttcacacctatcctcccttcagtgtgtgtgatgcagttgctaaaccctattacatactgcagttcttttattaaggattgattgggaaaatctacttgccttaagatgctattatggttttgattaatttgactaaattaatatagagagttaatatctagaaagaaatataaactatctagcgtaaagaacaaaaaccatacacctggaaattaaccctccaccaggaaatattagtattaagtagcacctggtacattcttgatttaggcccttgtgattgttctacaggaagatgccaactatgtgcagaataatgtttctcaggttatatctacattcataaagcattttaatttattatgattttattttattacaaaactgcttagaattcagtaattgacagattgtttcaaacatcactaagctcaacaatgtttgcttctctccaaattattctgtatatttaagcggtgcttctttactgagctttctaaccatatttaggtggcattcaagtacttacccattgtgcagataaaatgaaataacgtgtataaaagcacaataatataatatgtttaatatgtatgtgctccaaacaatgcaagtgtgagatagcattattaccatgtggcattcatccaggtggatgcaatggagtccaaatgaacctacctgtgccttggcttaagctctgttcctatatctctgtcccctatgatatccctggaaaaaataaatgctcccagaaacctgatgtacaaagcttcccaagtgtcttaatataatgggaatttaaatggaccaccactaaatggagctattgtgaatccaagtactgcttaaccttgtttgttagtcttttcaaagttattaatgacctttaactctcttcaaaattatttaactactctatctggacatgaatacacactctgtttccccctctctctctctctgtaaaatgggaatacaagttctaactcaattttggtttcatggtgataggaagatgggtttatttttacaaaatactttgtagtttaaaaggtctattccaacattaatgagtattattagaagatggcattgcagcttaatgaagtgatgcctcaactgacactacagtttgaattcggatcagccaattttaagcccactgagtctgaatgctcagatgtccattttttcagtcagtaacagattttgctagggttcatgtgctttaacagattttttcttggctatgtttatagtaaaaatgtaatagtaaattatgagcactgtaaaacagtgttgttcatattctgattctcccattagaaatatatggtcaaaatgttagaaaaaaattgtaacagaaatgtagagttattgtctgtctaggtaaggtattatgcttaataaataagattagtattttcattaagagtaaaacattgaaagttgcttgtaaatgaatttacgtataatagtcccatttttctattgactttcactgtaaaattacagatttgtttctctgctctccacaatggtcccaatacacaataatatttgaagatgcaacagtactttaatatgattcatctaaaggaaaatgttgaattttatacaacacagtatttattacatatatttagcatatcctaaatgtagttatgaatagaatacaagttcatgagctttgaggttatcatattaatattataactaacaaaattgggaaagataaagaggaaaagttcatttattcatcttttacactagataacttctggtataaatttgtctccctgaatcttggcacattattttactttgggtgatacttagctgtattatttcctcacagttttataattaaccaaaggagaatgggagcaaatttagaaaaaatgaatgctaatactcaaactcactcacaaagtataaagtagaaaaggttgctttgatgtttgacacagcagcttaaagatcccaaaagggggggacatttgaagtaaaatggactcacaagactaaactgaaaagcactgtagcatctattagagcctcctccttccccataacctccagctagagtacacgcatctctcatttcacaggacctggtaacggattcttatttctagaaaatgaatatgttgatctaacatgaagatacataggtaaaaatagcttaatccattttggtaccagtaccatgctgttttggttattgtacccttgtagtatagcttgaactcaggaagtgtgatgcctccagctttgttctttttgcttaggattctctcggctatatgggctgttctttggttccatatgaaatttaaagtagttttttctaattttacaaagaaagtcaatggtagcttgatgggaatagcattgaatctataaattactttgggcaatacggccatgttcacaatactgattcttcctatccatgagcacagatacatagaccaatagaacagaacagagacctcagaaataacaccacacatctacaaacatctggcattacacaaacttgacaaaaacaaacaacaaggaaagcattccctatttaataaatggtgctgggataactggctagccatatgcagaaaacagaaactggaccccttccttacatcttatacaaatattaactcaagatggattaaatacttaagtataaaacttaaaaccataaaaactctagaagaaaacctaggcaataccattcaggacatacataggcatgggcaaagtcttcttgactcaaacaccaaaagcaattgcaacaaaagctaaaattgataaatgggatctaattacactaaaaagcttctgcacagcaaaagaaactaccatcagagtgaacaggcaacctacaggatgggagaaaatttttgtaatctacctatctgaaaaagggctaatatccagaatctacaaagaactcaaacaaatttacaagaaaaaaacaaccccatcaacaagtgggtgaaggatatgaccagacacttctcaaaagaagacatttatgtggtcaacaaacatatgaaacaaagctcatcgtcactggtcattagagcaaatgcaaatcaaaatcacagtgagataccatctcacaccagttagaatggcaatcatcaaaaagtccggaaacaacagatgctggtgagactgtggagaaattggaatgtttttatactgttggtgggagtgtaagttagttcacccattgtggaagagagtgtggcaattcctcaaggatctagaaccagaaataccatttgactcagcaatcccattacttggtatatacccaaaggaatataaatcattctactataaagacacatgtttattgtagcactatttacaatagcaaagacttggaagcaacccaaatgcccatcaatgatagactggaaaaagaaaatgtggcacatatataccataaaatactaggcagccattaaaaaagaatgagttcatgtcctttccagggacatggatgaagctggaaaccatcattctcagcaaactaacacaggaaaaccaaacaccccatgttctcgcttataagtgggagttgaacaatgagaacacatggacacagggaggggacatcacacactggggtgtgttggggggtggggtcaaggggagggagagtattaggacaaatgcctaatgcatgcggggcttaaaacctagatgacgcgttgaaaggtgcagcaaaccaccatggcacatatatacctatgtaacaaacctgcacgttctgcacatctatcccagaacttaaagtaaaattttttttaaaaaaaaagaaataactttatccaaacagttacaattccaggtgaagcaacaaaaaactaaacaggagtgtgtttaataaaatggcaaatggacttgaaaagtatctcaaaaacattgtcaactgtttaacgagctggaccagtatacgcatctcctaaccactgtaggacactgaggaaacaatacattcatcagagatgattaatggtgctagtatgaccgtgtataacattttcctcacattacgctgtgacacaatggtaaacacttaggcatatcaaaaaataaagggaagattcaacattgctatgagttaagcatcttgttgtaagaacttgagtattgctacattaagactcagaccactcagatattccctacaggattgcaagagaaagttgaatatggcatctactaaagaataatttttgcttcaggcaattagtcagatttgaaaatcttgacctacctcatccattaaaatcatactctgctatccctatatacataccattcaaagatacatatttgatatgtgtacataccattcaaagatacatatttcacttctatgaagtacctcaaaaccagaatcactttctataacttgagattgtttttcctatttcttgtgcatccccattctgacaataaaatcaagtaccttcaagagcaggcacccttaatatgaaagtaattagtttgcaaatattttatcccattgtgtatgttgtctttttactctgttgatagtttcttttgctgtacaggagctcttaagttaattagataccatttgttaagttttgcttttgttgctattgctttcagtgtctttgtcatgaaatctttgcctgtttctatgtccaggaaggtattgcctaggttgtcttccagcgttttatagtttggggttttacatttaagtctttaattcatcttgagttgatttttgtatatggtataaggaagtattccagttttaattttctgcacatggctagccacttatcccagcaccacttattgaatagggagtcttttccccattgcttgtttttgtcagctttgtcgaagatcagatggccgtagatgtgcagcattatttctgggctcccacaaagatctcatattcaacatttataaagaaattaaacaaacttataagagaaaaacaaacaactcattaaaaagtgggcaaaggacatgaacagacatctttaaaataagacatacacgtggccaataagcatgtgaaaaaaagctcaatgtcactgattatcagggaaatgcaaatcaaaaccacaataaataccatctcacaccagtcagatatggctgttattaaaaagtaaaaaaatgacagatactggaggttgcagagaaaaggaaacacttacacactgttggcaggggtgtaaattagttcaaccactgtggaaagcagtatggcaattcctcaaagagctaaagagaaaactaccattcaacccagcaataccattactgggcatatactcaaaggaatataaatcattctaccataaaggcacatgcatgcaaattttcactgtagcattattcacattagcaaagccatggcatcaacttaaatgtcatcaatgagggattagataaagaaaatgtggtacataaacaccatggaatactatgtagccataaaaaagatgagattacatcttttgcaggaacatggatagagctggaggccattatccttagcaaactgctgagaccagctcagtcggggacaccctaacccagcagcgctagaggaattaaagacacacacacagaaatatagaggtgtgaagtgggaaatcaggggtctcacagccttcagagctgagagccttgaacagagatttacccacatatttattaacagcaagccagtcaattagtattgtttctatagatattagactcagatactcaactgaaagtatcccttttgggaaacgaagggatgggctgaaataaagggatgggttgggctagttatctgcagcaggagcatgtccttaaggcacagatcgctcatgctattgtttgtggtttaagaacgcctttaagtggttttccgctctgggtgggccaggtgttccttgccctcattccggtaaacccacaaccttccagtatgggcattatggccatcatgaacatgtcacagtgctgcagagattttgtttatggccagttttggggccagtttatggccagattttggggggcctgttcccaacagcaaactaatgcaggaatagaaaaccaaataccactgttctcacttatgattgggagctaaatgctgagaactcatgaacacaaagaaggagacagcagcactggggtctacttgagggtagggaatgtgaggagggagaggagcagaaaagataactattaagtaccaggcttaatagctgggtgataaaataatctgtacaacaaacccccatgacatgagtttacctatataacaaacctgcatcatgcccccaaacctaaaataaaagttaaaaaaaaaaaaacaaattactcatcactggatgtctttcatgtatatatgagatatggagttaataaacttgttttctcttaaaaatatcagagtaagtagtgcaatggaaatacatatgtccttaatagattttcatttcatttgcaaaataacagacatgcctctaattgcgaaagagagattaaaggagtgcagtgacagtctcgtactcagtctggcccacgcatctaggaacatctcaaaattttaggttaaaataacaccacagatgggtgaaatacagatgggtgaaatgtgtaagcatttctagactactgaagaagtaagattagccacaaatcatattttccaagtgtgtagcatgtggagtccctaagctctttggactctgtagctacatattcatttcttggaggtgtttctatgggtttattcccaagaggacccagcttcccactcattttatcaatcagctgtcattaactaacgtagaattagtatctgtgccaaaaccttcgtgagaaatatttgacccatgttaaaatagagttcattagggttctaatatttgaattattttctttccaattctgattcaaagcctaagtaaaacaactaaacattcaaagggggcctaaagaaagtgcagctcttaatgcctctggatcagtgatttttatccccaggtcccatcttgagattcttatttagttgaagacaatctgtaaatataatacatgcagttgtagatggccagcattccagaaggttaaaaatattattttagggatctctttgagaataagatgaaaactagttaccttcttaccatataaaacaatagtttgcatataatttcagtatcctggacacctgtggtctatccaaagggaccagtttaagatttggatctatgtcagagcagatcagtagaataaaacacactgaatgtgtaagtattctagttttcttcagaaaactttcactgatttataatttaatataattgtcatcagcctttacatcttattgatataaaaattgattgcataaaaagtttgtctttcccaccaataattcctatttctccatatccatgccagcatctatcatttcttgactttttaataattgccattctgacaggcgtgagatggtatctcgttgtggttttgatttgcatttctctgatgatcagtgatgttgctttttttcatgtttgttgatcatataaatttctttttttgaaaagtgtctgttcatatcctttgcccactgtttgatggggtggtttgcttttttcttgtaaatttgtttatgtttcttgtaaaatctggatattagacgtttgtcagatgggtggattgcaaaaattttctcccattttctaggttgcctgttcactctgatgatagtttcttttgctatgcagaatctctttagtttaattagatcccatttatcaatttttgcttttgttgcaattgcttctggtgttttcttcatgaagtctttgcccattcatatgtcctgaatagtattgcctaggtttgctcctagggtttttatggttttagcttttacattgaaatctgtaatctgtattgagttaattattgtgtaaagtgtaagtaaggggttcagtttcagttttctgcatatggctagccagttttcccagaaccatttattgaataggagatcctttccccattgcttgtttttgttaggattgttgaacatcagatgcttgtagatgtgtggtgttatttctgaggtctctactctgttccattggtctatatgtctgttttggtaccagtaccatgctgttttggttactgtagccttggagtatagtttgaagtcaggtagcatgatgcctctggcttttttttttcttagcattgtctttgctttacctggtcttctttgattccataagaaatttaaggtagtttttttgttttgttttgttttttttgtgaagaacatcaatggtagtttgatgggaatagcattgaatctataaattactttgggctttgggcagtatgaccattttcacgatattgattcttcctatccatgaggatgaaaagttctgctatttttttgtgtcctctcttaattccttgagaagtggtttgtagttctccttgaagaggtccttcacatgccttgttagctatattcacaggtattttattctctttatggcaattgtgaatgggagttcattcatgatttggcgctctacttgcctattgttcatgtaaaggaatgcttgaaccattgtggaagacagtatagcgattcctcaaggatctagaaccagaaataccatttgacccagcaatcccattattgggtatgtactcaaaggaatataaatcattctactattaagacacatgcatacgtatgtttattgcagcactatttacaacaacaaaggcatggaaccaacccaaatacccatcaatgatagactggataaagaaaatgtggtacatatacaccatggaatactatgcagccataaaaaggaattagattatgtcctttgcagggacctggatgaagctggaagccatcatcctcagcaaactaacacaggaacagacaaccaaatgctacatattctcactcataagtgggaactgaacaatgagaacacacaccagggcctgttgtggggctggggggaagggagggaacttagaggatgggtcaataggtgcagcaaaccaccgtgacacatgtatgcttatgtaacaaacctgcaccttctgcacatgtatcccatggtttttcttttcagaagaaatgaaaacaaaaaataaaaaagtttgttaatttcttctgagaaaagatgcctttgtgtctacatttaccctaaatgtatcaaaatattgaggcttctagctcccaatccctgctttggaggcttgggtttacacttcccccacacaaccgatgtttgtctacagtaaatttcttcacactagtgctacttccattcctttttatatccttcactttcttccttctgtaaccttggtacctaagataataggttctcaataaatacttatatttagtataattcattattttattaattacaaaggtgtaacatgtatcttgtagaaaatgtataaaatatagaaaactgcaaaataatgaccaactgcaatctcacccattttgttttgagatttttgtctggaaatgtattttaaaaatgaatcatcccctttcctaatcccaattctattcccaggagatggccactgtgaatgatccagtatctttaaagtgttttctctatttttatccacacaaatatgtatacatgcacatatacacatctatatcctttttttacaaataggattgtactattttgtgctgcagaaattgctttcttcatcaaccaaagtactatgaaattttctcagttctgcagatttaccttactcatttgaatttaacgctatttgataagtatttttgaacatacaaattaattatttgatttggaaagaaatgtcttttggctaacatcttattttattattttagaaatcagccagaccataagtaagtggttatgactattctttcttgtaagatagtataataaaattccggaattagaatgatctatgcatccttcgttcaggtttaagatataaactttctgtttcagaagctggccatatcactactggtttccaaagatcagggaataaacatgactttgtacccccttccataactaactacatgtaaaatttcttttaaccattgtcagttctcctgcttcattttgtcagaccactagactgcaaatgtttctcaaacttcaggggtcctgtcacctgccttttgcttcagacagcaggatactgaattctattgccatcacagtaacaacaatgataagcacagcggtcaggttttaatggcaccacttaatgaattctctgagaaaagaataatagcgagaaatctcaaggtcagcagtgtttactttgagaaggacctaacaatagatctgagaagtccttcaagtgtaccaggcatctttttctgctctgcctgcagttaactgagattttctttcctttttcctcgtcttcagtattacatgtgaagcaaaccaattctagtctcagaaaagtgatagcccttgatgttaacatatcaagcttgggttcgatggaaaggttaaaagaaaacaggcaagatcacatcctaacaattctcccatagatttagggtgagaatttggaccaataaatttgtttaacacagaaaagaggatgcatcaagaatccttagtggagagtctgaaattatggaaatgattataaaagtagcttggagctacactgtgaagagagttgagggtattcattgtctctagggattatatataatattataagtcttggagtaaacaaacaaaagctgaactacttaatatgaaggataatagagtttagaatacattccttaggacagcaattaagcatggacataagtataggtcaatttcatgaggaaaagaaaactgaccatgaaataatacaaaaaagaagaaattctgaattaagataaaaactgtgtgcagagacaaaggactagatggcatgcaaattttccatgcagttaacagtttccaagtgttttaaaaaatgcaataaaatatctctaaatgcatttcatgcatctctttaagttctttctcaaatatctatcctatattgctatgaagtagtgaggggaaaatagttattactctctctgtctctctcctttgttttacgtaagagagatgtttaggaaagtttgtgtgcgtgtatgtgtatgtatatatgtgtgtgtgcacgtgtgtctgtctgtctgcctctctctgcttctgcctctctgtctataaagcaggcctccttccaataattaactatggttgatttaggggtcactcgcctaaggccatacaccatgtcaaaatatgaataaagatttcagggaggataaaaagtgtttttcagctattcaaacaaagccactgacactataccaacacaaactactagagatgaaaagtatcttagagatcgatccctcattttctgtatgaaactgaggttcagcaagttatacgccaaaatccaatgttacccaatgctttaatggaagatctggtctactttttgaacatggtaagatctgagggttgctgcagggctccttgctccaaaatatttcctacacagctttccagaggacttgaaattccaaaggtcaaaatcttgcatcagaattattaatattctgctatcccaaatgataccttggatgacctatccacgcttttatttacgttcgatgcctccttttgtgttcctcttgcctactcaggaactctgtgtcaaaaattaatcatctatgttcaatgtagtctaatttttcctctctaatggacaattcccatcagcatgcttttattattatcttatgtttttattcctcccttcttgaaaatatgtactttagaattctctcttcaccctacattcattaccagttatggtcccacttctctgctccccttagtaacaaaattccctgaaagagttgtctacatttgttattgaatttctcccttcccattctcttttcaacacattccaaacaaacagaccatactaggccattcttgctttgctataaagaaataactgaggatgagtaacttataaagaaaagagttttaattggctcaaggttctgtaggctgtacaggaagcatagtgccgacatctgctcagccttccctgaggacctcaggaagcttacaatcatgatggaaggtaaagagggaaggtaaagaggcacacctggcctgcattctaaatgtctccttttgtaactttaatatatggtaacacttggagaaatataattacttttttcaacagtgatagtaattcacactattgtgtaactccctcacgttgaaaccttattaagttgttgaccagtgacaccatattggagaagtatcatggtttaagaagcacaaggataataagaaaagaaaaaaaaatacatttgggttgtataaaatgtataggtaaattcatgaattgtagttaaaaaacctttttttttttcaaataaaatatgatccaattctgacccttctattgaagtccttagctagaattccatttggaatttcagcctcctttcccctttattgtctcaaagtggaaaataggctaaactccaattgaaatactgtgctaattggaaaaacataggtgagcaaatgacttctaaggtgtgtgctgcactctgcattgtgctttagtcataagaatatctttaaagcaaaatgagatattcaacagagtcagatggaatcccctagcttgctagacagaagcaaggaacttcaaattaattctgacacatttttcattgaattatcccagtttcatgccctcaagtcactcatgactcattattcatatgctcttttagaactatacacatcggggcctgtcagggggtgggggactaagggagggatagcattaggataaatatctaatgtagataacaggttgatgggtgcagcaaaccactacggcatgcgtatatctatgtaaaaaacctgcacatttagcacatgtaccccagaacttaagtatagaaaaaaaaagcctatatttgtcacttacttacctgcctataagacctttacttcattaattttcttgcctgtttttttgttcgctattctttaatctttattatagccacgactgaaaattgacatatacctaggattgatgcctttgtcaagaacacatattacatatgcaaaatcacttatattgatgttatattatgctaaaatatttgtttccttcaattaagactaaagtaagagtcaggaatggcagggcacatttcaaaataagcgtgatctaacttagtacaatttgagagacaaaagtgatctcagaattgatccaggctaaatacctacctacccaatgtcagaatcccctcaactgaaatctaattccctgtaatttcagaacttcaacctatttatctatcctccccctgttttttttttcttcttagcaatgtggaataaatctaaatctaccacaaaataaaagtgatttgaagtatgggaaagacatatcatactctgttcccaaaatttctcttctctaggcaaaacttccttccattaagttccttagacaacatgtcatttttagcagcaggttgctcatcttcctctgagctcaatcctttcttaaaatatgacactcaaatgctaaattccagtattcatcacactaagattgtctatgtaagagtaatttacatacatgtttgcattatggtcttcatattttaaaagtccaatctaatgagatcagatacaaagcttatgaggaatgtttctaaaacgtggcctttagtaacaatccattaattatttttgagtggagtaatcccagtattatccagcccatgtaactcaatccttttcactaagttagtaaaatcaagactaaatttaagtctggcaaacctaacacaaaagaaaacgctgtaagcttggcatgtagttacttaagtcaatgtatttgggttctagtaatcactcttctctgtttaataaattaattttaatatatggcaatggaaatcaatactgaacatgaaatctgcttttacttcttttgaaaattcatacaaacattatccaccaccacactgctgatatttctctgtgttccatgaactctcaagcatattacttttatactggaagaaattacatgttacagaaatatttcagctgggtttggaatttcaaattaatttaagtgtattaaaacctgtcaagatatactcagggctacaactacattttggacacaactacattttggtaacaagactgcagataatatcttgaatgtgtaaatttcataatataaggcaagcagcacagtggaaatagtggagtctactaatctatgggtagaagtgacagccagaaaaccaaacaccacatgttctcactcataagtgggagtcgaacaatgagaacacatgggcacagggaggggaacatcacacgctggggcctgtcaggtgttgggggagtagaggagggatagcattaggagaaatacctaatgtagatgacgggttgatgggtgcagcaaaccaccatggcacatgtatacatatgtaacaaacctgcacattctgcacatgtatcccagaacttaaagataaaaaacaacttaaagattaaaaaaatgaaaaaaatatggcaagtgacactggtgaaaataaaaaatttataaagttaaaaaaaaaagtgacagccaggaggaataattatggctagtaagttaactttattggattgcccaattcagtgctcagaaagaaaccgccaattggaaattagaattagctacagtagatttgcaaacaggtcaacttactgatattcatgatataattcactaaatataggtatctttttcatttccctttacagctctcatttcttgccaataactccagatattgtcaaataatcacaactgtaccttattgctgccagtgaaaggaaactttccaaaaacctctgtgaggatgaaagctaatgtccagcccccaattattcaattagattttgaaaaagggagctgtcattcctcaatttacttcagcaaatgcttagtgcatgcaacgcataaggaatgtatactcaattggagggattcaattaaggaactaatttaagagtgaaagccacaatgtttgtgggattttttttaaatgatataggtatattcaaaacatcaagaaccagttcaaaccaaagttatataaattgtagaagcttcataatcaaatatttatgactctctctacggtgcttgaaatattaaattattaaaagcaaatattgtagcaaacaggttatcatcaatctcaataaaagttacgttttactatcactgtcacattattactttttgcttttagtcgtttaagattgaagagaggtaacaaactgtggtaacaaatcaaactttttcagtgtaatttactttgtgagtaatttctaattgattcagactgatgagactgcacagtctgatgtactgctgaagcaggagatactttggaccaagtaaatttataagctcctcttcttgagagaaaaatggctgctatatttcatgttgtcattttttagctttaacaatgtagttgtatacctatgcggattcttaaaaaagaataccaaataatgtgtacacctgtaactgtctcacccacctatcaatattggatttggcaggcccaaccttctacttgctcaaaataaaggatttaagcaaaatgcagaattaacccaaaaagaccagtctcatatatgaaaagcaaagctgcatagcaacatcactcagccacctgcagttcaaagttcatatcttattaacatcactaaaattagaacaatgcaatggcttggttgtgtgttttggtatgattgtttgtgattctgttgagattggctctgtgctttgcttaaaaatcctgaatgttatttttccaaaacatgattctagatatagatcccagtattttgaaaatgagagttggggggaaaagattgtgcttgtctgctcaaaaggtcagaagcacttcacctcaattcagtgacaaatagccttattttacagaagatgtaacactggaatatgaaaatagccatgtctgacacacctttggatttttactcaagatccccatccaatgtgtatgtcccttggctgataaaactgttctttttgatgtgaggaaaaaataataaaaacaaccaacaagttttcctctttactcatctcatccattctgggatggaatatccccagaggcttgagtctgaagggcttttttcaaatttcacaacgtaatggagacccctctatggaactcttttcccttttcacctaggtattatgccatctggctgaggagctacttgtcatctctgctgttccctgataggccagaaacaaaaggtgtccctaggtctaggtaaaagtcaaataaaataaaaaagaaaaacaacttgaggtgcaactttagaggcctcaagcatctcaaaggctttaacaagtctagttaagtacctgtggggccatagtgggatttcaatatcctcacatgacccaggactttataattccaaacattgtcttgtcattaactgtggaactcttgctaattgagtctgagtgtctaggagacagtaagggagatgatgaaaacaattatttgtaatttagcagagtaaactatgtaatttttcttaagctaaacattttaggcattcctcattataaacaagtcaaaattcctttccatgtttcccattcttgtccatttccagactggccttctgatttttaatttccaaaatgacctccattttgaaatttaaaattcagggatcatctttgaggcatttctctttttcatctcactatcaaacttgtcattaaataattacatttctctctcttcattcccagtatgctagtccagaatatccccaaatccatatctgaattattgccactgccacttcactctttttctagaatcaaggctctcctgcctgcagtccattttacttagtgctgtcaggatgaattccttaatatacctacaagcctgaatatgccccacattgacttctacatcaagaccagatagtttggccttattatcaatactctcaacaatgaggctccaacttatctgtccaaccttaccactctcttttctgctcagctctgtctttcctttgtattcatcatgcttattcctgtacttattttatgctgcgaccctccactaaaatgtaatgagtcttaatcctcactttcttaaggttgatgatccttcaaggtccaagttaagtttcactttcacgaaaccttctatttcaattatcatttatctgtccacacataaacgtagtataattgcgagtgcttaatatttccttattgaaatattcaaatagatgcttctcccacagatctttgcaaccctcgggtcaggagataccctggtgaacccactccaccaaggccttgtatctgacacacagtgctatgcgaaatttcagcagagcagacactcaggcaggcacagagacccaggaactttacatactccagctctgggatccctggaaatggtgactggaactcaggcaaagcaggaggttagacctccgtacatatgcctaggaagggggctgaagacagggagctgagtagcattagtctgcgagcctcatttgcagggcacctcacaggataagacccattggcttggaattccagccagccaccagcagcactgttgcacttacttgggatgggactgagttccccagggaaggggcaggctgccatctttgctgtttggaagactcagccatgccagcatgcaggcttaggggagtccaaagtgttggggggtaatgctattcccattaaactaccaataatattcttcagaaaactagggaaaaaaaactattttaaaattcaaacagaaccaaaaaaagcctaaatagccaaggcaatcctaagcaaaaagaacaagattggaggaatcacgctacctgacttcaaactgtactagaaggctacagtaaccaaaacagcatggtactggtacaagaacagacacatagaccaatggaacagagtagagaaccaagaaataagaccacaaacctagaactatctgatcttcaacaaacctgacaaaagcaatagggaaagcattccctattcactaaatggtgctgggagaactggctagtcataagcagaagattgaaagtggaccccttccttacacaatatacaaaaattaactcaagatgggttaaagacttaaatataaacccaaaactataacaactctagaagacaacctaggcaatatcattcaggacataggcatgggcaaagatttcataatgaagacaacaaaagcaattgcaacaaaagtcaaaattgacaaatgggatcttattaaactaaagagcttctggacagcaaaagaaattatcaacagagtaaaaaggcaacctataggatgggagaaaatttttgcaaactatgaatctgacaaacgtctaatatacagcatgtctaaggaaattaaacaaattcacaagaaaaaaaacaaccccattaaaaggtgggcaaaggacatgaacagacacatttcaaaagaaggcatacatgcagccaacaatcatatgaagtaaagcgtaacatcactgatcattatagcaatgcaaatcaaaaccacaatgagataccatctcacaccagttagaatagctattatttcaaagtaaaatcataagagatgctggcgaggatgtgcagaaaaagaaatgcttataccctgttggtggtagtggaaattagttcaaccattgtggaagagagtgtgttaattttttaaagacctaaagaaagaaataatatccaaccaagcaatcccattactgggtatatacccaaaggaatataaatcactattattaagatacatgcccatgtatgttcattccagcactattcccaatagcaaagacatggactcaacctaaatggccattaatgatagactgggtaaagaaaatttggtacatctacaccatggaatactatgaagccacaaaaatgagtgagatcatgtctttttcagcaacgtgaaaggagctgaaggacattatccttagcaaactaatgtgggaacagaaaaccaactaccatgtgttctcatttataagagggaggtaaatgatgagaacacatggacacatacagggggaacaacacagacttgggcctatcaaagggtggagagtgggaggagggagagtatcaggaaaaataactaatggatactaggcttaatacctcagtgacgaaataatctgtacgacaaacccctatgacacatgtttactttggtagcaaaactgcacatcctgaacatgtacccctgaacttaaaatgcaagtttaaaaaaaagattccagtaaatgatttcaataactttaaatttgctgtaatattatttattatacatgaaacatatattaatatatattcatagttgtaatatgtttaggcatattttcaaaagaaaggaaagtcacagagaaacacatacacacacacacatatatatgtatgcatttatgtataggaatatatatctttatacaaaagcatagaaaaacaacaagaagtatacttgcttcaaatcataaatggtggtcacctggtcacctccagcaatgggacaatgggagcaagattgacaaaagtgttagtaaaggagatctttcaggttctactctaaatacaccaatgctgctagaaattttccaagaaatatattcaagttttacttgtgtgatttttaaaaaaaaaattatttaattaaaggggaaaaataaagttatcagcaggccatcctgaggcctcaatatatgtaaagcacccttcctcctatgtgtacaaggatatattccccttttattcatagcctgctgcatccttaaacagtattttaaaataatcttttgcttttgttgttttgttatctccccttcccttcatcccataccaacttgttcactacacaaagtcagtagaacccacaaagtcctggaaacatagttcaaacacctaaaagagctctggttttcttgatgtagttaactcaggcagtgaattaataaaaattgagcaattttcaatagaattaatttaattaagccggaaatttctctcccgtaaacctaaaattactgtcaaacataaaagtattaaaaaaattctctttttttcatcagatccatattgttatttgttttaaatatcattttagagctatagtcgtgtgccacataatgatggtttagccaacaatggaccacgtatatgacaatggtcccataagattataatgaagctgaaaagtttctattgccctagtgacattttgatgatcctgaccctctgtaagcctaggctaatgtgtatgtttgtgacttcatttttaatttaagaagtttaaaaaaaaaaaaaaatagaaaaaatagaaaaaagcttgtagaataagaatatcaagaaaaaatattttgtacagctgagcaatatgtttgtgctttaagctaagtgttattattagagtcaaaagtttatcaagtaataaagttacagaaaactaaagttaatttattattgaagaaagaaaaagatttatatatatttgggacagcctaattatacagtccatagtagtgtacaataatgtcctaggtctttacattcacgtatcacttactctctgactcacccagggcaacttgccgtcctgcaagctccatctgtggtaagtgtcctatacaggtgtactgtcctttatcttttatactgtatttttactgcaccttttctaggttaagatacgcaaatactgaccattgtgttacaattgcctacataaaccatctagttttatgtaagtacactctataatgtttgcaccatgatgaaattacctaaggatgcatctgtcagaacagattcctgtcattaagagatgcataactgtattggctttccactaaatatatgacttttaatatttttttctttgcttttagtcatggggccaaattctattttcttaattcttcttcgtcttttgtataagatacattgttcctaataaaaaatgcaatttcatttagagacattttgctttacatttaatattttagaaatgcaagatatatcaaaggataactagaagaaagaaatgcgctgtccaaaataaatgtgctatcttttccaagggcatgcaaatacattttccctcaaagattaggaggtgggtaatgctagtacctgaaattccaatttttctcctttaaatataatcagtccccaccttatgaaggggttgtatttcaaaacattgtgcttgttgagttttaggaataaattctcactagaaacaatgtttatccatggtgaacatatgaaattttcaggcaatcttaaaataaaaacttattcatttctttttgtacctgaagttatataaagttaaatacaaatggttctttcaaatctaaccaccacatatgtcaatgtttctgtagaagttaacttttttagaattttaacctagtttgttaggaacgtatctacttccactgcagggagaacagatattcacctaactgcatgccaccaataatggccataatgatctgaaagagattctaggacacattaaggttgcttattcagccattcaaataaaacatcaccactgctatatccttggacctgaaaatataactgtgattagaaaagatatatttcttgctctcagtaggaatacttagcacagagacttaaagcatgttaatatatgagccacacagctattggaggtagactatttggggcaggtgaaacagcaagtgcaaaggccctaaagagacaaagtgcctggaatacctaaaaaacaacatgtaagtcagcattttagtcagtgtttctgaagtggcagtgaaaaggggagcatttattagaatatgaaataagagaaaaagaagacatagagccttattggccatttttagggcattgagtttcactctgaatactaattggaagaacagagcagtgacataatctgtattaggttttaaccttatcattgcgggtgctgcattgaagattttctgaagtgggcaaagggtgaactcagggaaatgagttcaaaggttgttgcaatagccccaggaagagaagatggtgattggagccatgaagtaacaatgaagcagaggaaaagtagtcagtgtctggatatatttgaaagcagagccaaaagttttttgatgataagtctaagataaagagagaaatcaaggatgatcccaaggtttctgagaaaatggaagaaattggcttgtcattagttgatataaggaagaaagagaggaaagtaggtttgaaggaaatgaaaaaaaactatcctaaattcaattttggatatgctaattttgagctatcaaaatccccaaaaggagatgctgaataggtaattaaataatatgaatctggaatttaagggagaggtcaggataggtgatatgaatttgggaatcattggtacaagaaaattatttaaagccatgagactagatgttcatacatcttaacctaatatgtagagtacaattgctatagcagaaagactgggtgatattggaatgtaaacaaggtgtatctaccttataatgatagccaggtttaatagaacagttgggaatacctttggagaaaagttgacatttacactgagaacaaaaggaaccatcagaatcagctagatcaaaaggttatggagtgattcgggaatgcgcaatgtcctgaaggcaatgctgatcatggtgcagtgggaggaagtaaaaaatgttcaaactggcagcatcatagactgcaagaagtggggttctcaagaggcaagaaaataagagttgtgcaaaatgagccttgagaagaagacagaggacagttcatctcacattttgtaagccatattattaagatttaattttagaacagttttaaaaggttggtaataacatattatgtaggctaaaccttctgacaatgatgcagaatacactctctccccataaaagatgcaactctatatatctaaaaatacatttctcagaacctagtaatgagtttgctctctgcttcatttctgccaatctcaaagaatagtttcttacttccctttctactgccaatacctactgcttcaaagactccctttttgacctctatcccaagttgtatgaagtgggaagacagcaactgtggaagctttttctcatatctccttatctttatcagcatcatcatcaccaggataaagaggtgcttttccaagttggcacttgggcaacacaggaaatttttaaaagggtaggatgagggagaagcaccagggagctgccatctaggtggcgtaagatgcacagcatcatttcaaaacaaatcaaaagtcagcttacaatgcaaagctatcgcctgccaggtttgccaagaaatgcttttgaggacagaagaaaacaagaaattcatatatttaatcattattcatatttaatataaagcaaagatgatgcaaaacttgaaggtgactccatggccctcaagggatcacagaatgttaaagacagaagagatatggagatgctatcgtccaatctcctaatctcttcatttccaagataggcaaactgaggcccccccagaaatgttgacttgtaaaatctggtggtagtccttcatagtatatgttcactggctttgaattgcttttcccttttaggattatttttgaggagacagggaccaagggtccaaatgatcccagtggctagtgcttagcaataaatgtttcagaatctatactaaatacagtggcttggatgttaactgattaaaattaaaaaagacagaactcctctctgtgggttcttagacagccccattgcaatttgaagaaaatatgtttagtggtttgaggtttcaatgttgtattgtctcggtactgttcttgttatgtctttattttgactctgttggtactagacttcagaaatattgctgatatgctgcctaatccatcaaaagtcacaacaaaagctcttagggtgaaagacgttgtctttaataatgtaagttctcattattgagatttaagtgccccatgcacagtggttttgaatttacagtgtgacactagatggtcctatcagctagttcatgttatgccagaaactcaatattctctctttcctttctctgacatgtaggtgagaggattaaggatatttaaaacagaggagacaccagaatgcatccagtactactggtagagggtggaaggacagatttagaggttttctaaagtagtatttttgcactgaagtagctcttaatgcaagtattcaatgaggaattttatctccagcatgtgagagtgtgtgtgtgtgtgtgtgtgtgtgtttgtatgtgtgtgtgtgtgtgtgattatgcattgtatgttgtgtttgtagataaatagcagcattaatacctgggtgatatataaggctagggagttctatatactcatctgccctttgtgtcccatctccctaaagcacaagccgtcaaaagaatttctctaaaataattagattgtagttaacaacctaacatctggtagaattcagcagcacaggctggaggtgtatctaaagcaggaaatattcaaatacctataaaagggagtaaattatgttgaaaataattatgatgatgagacatacagatatttcaagattactaggctgttgattcctttttcaaaagccttatggaggaaaataacagtggcctctattctcctactcttacttccacacaattattacatggaaatgatatggagctttaaacaatgcctttctccagaactcctgttgaaagcatgtcattgtttcttacagtggggataatattttctatttgtacgtggagaaaagagctaataaaatgttgcatgtatattaaatggatacctgactcaggaacacattaacttaatgatttatagccatcatgagttcatcttaaatggcccctggtaaaggaaaacaacgaatatacttcaagaaaactactgaatttaatatgtatcccttttagctgacagtgaaattctagcttgtgttcctctaaagagtaaaatatttcagctacaaaaattacctccacaaactctcatgtcttagcaaaagctgctattttatttgcacatttttcataagatgaccaattaaagttaaaattaaaggagctgatttgtacacataaatatcctacatagagtttctctcttatttacaagacttgtcatttaaaaacaaatattgaacagaatctccatgcactcagtacaactcataataagtagtgaaaatatgagattgataaataaattagaaactaaataatataatcaatttatgtacaattctgttgttaaagtagtgtgcatttgtcaaaaacatttggaagcatttcccaaagaagtcttaaaaaatgactaagggtttaggacaaggtgtcccttgcagatcattcttacctaacccaagttccagcctacatttgggtgtagagttatgatcagcctccttctatcagattttgtgtcctagtgagatctctatacatcactggaaatgaagagctgcatttgatcctcatctaacagcgttctttaaaaaataaaataaaaactgaaactttgtcaatcagagctgctcacaccatttacaaagagaagcttaaatagaaaatagcagcaacaacaggtggcatggattccagaatgggctagcaaccaagaggagaagcaacactgattcatgagcatagctacagggcctggtacagagccagctccaaatccctctgcttttagaacagcttttaattttttatcatcttatgaaatgagagcgaattagatgctgatggctggcagcactgttggcctacttttgccacagggatgtttattcaggtgtatcagcagtacccatagccacatactttaaatctaatctggagaaataacctttgggatccttcatcctgacaaagtttaatatgagaccagagatgataggtctttctgccttcatgctcactcatgaatgagactggagtacatcaacttgatttcattgagatcataatgatacagcttttccaaaggagtcctttttcactttctcttaacctgagggtactacgttttgcaaacagcgtacaaatgattcattaaaagagaatttgagaatcccaaaaacgaaaattatatttcagatctgtatggcagttgcctcaatgaggagagtggatatggatatccttgtttatgtccttgaaaaaaagacactgaaagcgaagtatcacgtccaaggctctactcacaaattactacagaattatttttaagttgttggtcaatgactctaaaattcaaaaaggaaaaaagaaatagaagacttgaaactagaagtaccaaataaaaagaacaaatggaagaggaaaaagacacaaatttaatcaggaaaataggatggaattgttgctgtgtgaccttgagcaagttttgtaacccctctgtgcttcactttctttatgcctcatctataaaatagggataaagacagtacttactttagatttgatctgaagattattttcacttataaaacatatagagcactactgttcctgcctcatgctaaaaactcaataaatgtttggctgtgataataattattaattaattaaatggtaattatatgtcaggctctgtgcttgttgcaaagtagtttataatataatatttgtataatacccgcaacacttcttatgattttttacaggtgaagaaacttaagcaactctcccagggcacaggtaacaaacagcagagccaagattatcacctaggaccacctgtttcttaagattatgccctctagatcaacctatgtctattattaccaaatacttttctacattctttcttttatgtaaaaaaaagaaccattctacaaaatgtaaacaatgatatcattttggcaaattttacatatctcctttgttatgccaaatataccaatttcctcatagatattaaattagtcacaatgggttcctgcaatctccagaagatataatctgcagcttgttaaacatccactagtgcagggacattgggaagcaatatatcgtatctgtcataattcttatctgctagtaatagtaatgaactgtagctatcctaggaaataaaaaggatttgttggaaggttataatgggtactattacattggctgagaaaacagacttctaagactggaaggaacaaatgagctttggagggataagaagcaaaacaaacaaacaaataaataaataaaattaataaccttttagccagaacgacctggccaggacagagccaccaatatttttaggcctccacctcctctacgcactaccattattaccgctggacatggtaacaactgcgccaaatcaattctaatcattattccatccttgtgttatgcaatttagattcatagtctgggctgatagcatctgattagctgagcctggcttatatacccattatctggctgccagaaggcaaggaaaggagcctccagtctttgatttttgtatgaaaggtgggtactgtgttcaattagtacattacacagtgaagaattggatgatgaacagccaaaaacacacagcaaatttccactatgccgattcaggtggcccagaatcctttctcctagtggcctatatataaaagatttggttaccccataaattcctgggtataattaaaaaattggagatacaccactttgtacacactgctttttgcagtggtttcctagaactgcttgttaatcaaagggcattactcttgtgttggcatatacatcaatgagattttatgcttaaacatacacttggaaaacaagacaacatttaacacttcaaatatatgtgtgtgtgtgtgtgtgtgtgtgtgtgtatgtatatataatatatatatgtgttccaaatttccctttcacatgttttcaattgttcttttcatatcaattgaacacaaatgacatttaccagccttcatcagcctgtatctcaaaatgttggcattatttatatgttcataagggctttcaaagaccattactgacactcaacacacaaccaccttttcatctttaccatagttcatcttaagtggaggaaacaatcttgttttacttacacacttttctgctgctatcttaaatgttcataggaatcaaaattatagctaagaattaaggtatttatagacatacatgaaactttagaatataggcagatagtatagcacatagaatatcaattcagtacttagaaaagatttgggtatctactatgaagtgtctagaaacatacaatagtatttgtagtatgtcattcctcactgatttgaaaagtaaaacaatttctaatgtttatattacatgatttgttaatagtatgcctggattgtaaataatacatctcctgagaccagcatggagaaccaagatgcgtatttttttaaaataaagaatggtgagaactacaaagtgattggctcacttttggtaattcacttattaaaataataccaaacaatatctaagaaaatacactaaatactatgaatatgctaggtaggttggaattatagtacccactcaccacctgccaatgcatgatggatctgattagcatagatgaaatgccaaactctcaaagaggaatactgaagagagagaagacactcaggcgcttgggactggcttcactgtaccatttttgcttttgttgtgaccagagccactgaaaaacaaaccatcaaaaatatttcaacttggcatttgtattcagaataatttaaatggacaaagataaacttgcatgcaaagctgatttgtttatttctttgctatttgtctgcatcctccttttaaaaatgaaagatattaattaaaaagaggtatgtggaacctatcaaggcacaatatttcagcaaaatgcagccctactttctaagtattatagacagtaatcgttctgtgtacacgaataggtattcaagttgactaataataaataggattagaaaacaggggtcctacaatattcctgatagaaaattagatacgtagataattttttcttccttttagactcataagcatctccttatcaagtctaaaggaaagaagagaaggcaatgaaggtaaatacagggcagctttttcagtctgataagaaaaataacattttgggaaagagtaagactactctttattttttaaaatgctgcattatatattgctccagagtatcatggggactgtattacatttaatttagttttatttattcttggcccttacaacataaaagttgactttttcaaaagtcataaggaagtatattcattgatttctcaaaactagtatatctaaaaacaaaagatgatactgcagcccacatataagggtgaatgaaatagcaaagcagtagaaaagcagcaagtgaaaaccatatgtgatgcatttgtggaaaatatatgatcatagcagacaggacacattcatagagaaagggacttttaaataacaaagttttgagacactactcaatgaaaaaaaattaaagtttttttgcctaaaatcatggagctttacagattcaactcccatcacaaatgcataggcatttttaaaaagggcattggcagaacaaactcacgttggaaggaagctgtgcacctggctttccttattatatagatgtgtgcaatgtccaatagaaaaacaagtctagatttttaaattctggttaatatttgtttgtgattcatttcaaagactgaaatgtgagtgattatagaacaaagacagaaacatctttgtaggtatcagattaatattagccaagatatgatacgaaggtcaggacctatttgatgcaaagtgtgaagcaacatggtcaaacacagatgtaaaactctgtgtgatataaaaccaaacctacaaaaaagaatattttaccagaaccactcatttatttacccagcgtttattgaatgaacacctttgatagaccaggcagtgtggggttacaaaagtaaacaagaagcatccctgacctcctagaactcaaggtgagaggggcagacatgtaaaccaataattagagcacaacttgacaagatactcccccttactgctcccagttaattaatcctccagtgataatggattgataagtaacaccaggtaagattatttgtagttgtatgcatgtgaatggtctattttaaactttaaagaagaaaaaataccacatctgcctccagaactaatcttctgttactggcataaattctaattcagaaactatgtgaaacagattttcttcttccaaagcaagagatctcttgtatcaaggtcatatttaattcttttgacaggatattctgtcaggtatcaagctaaaatagaagccaaagaagccagatttcatcctaatttcaggaaaacaaacaaatatatatatatatatttgtttgtttgttatatatatatttgtttgttatatatatatgtggtgtgtatgtgtgtgtgtgtgtgtgtgtatccaaaataaatcaggaaaaatgtaaaagaaagaaataaatagtgaaaactaataggaaatatattttaaaatttccaatcattagcaacatcttgtcagttacagacagaaggggctgcctatagaagagctgaatcaggcatcaggaaggggattgaaaccatcaagttcatattaaataatgcgtggtggcaaccccaggaggctggcatctggaggcagccagaatgagtttttaaattacttttattggaactcctcagctgcaggtaatggcttaagggctgcagaatatgcagatttgaaagaaatgcaatcttactatttcatagctttgtctcccctgactccctggcagaaatctttgagaatgtttctgccacctgcacgcccagcacattttcttatctttcacacattttcttctcttcttcccagtatcactagatcttggaaatgtaaacttcgacttgtggctatcctatactacccttcttcatttacacaaaattttgcaattatacaaaatagcacttcaatagtacataatatacctgcaggagcatagtatttcttaaacactcaaagagctatctttcatggaaaataccttaggttcaactgtcataagttctatcattaaaataataaggaaacgaattatgtacgtaaaatttttaaaaatgcaaaaaagtttatgcaaaataatgacctgtttgtcttgattattataatgaaaacattaaactcagctacatgtgctgctgctctaattgtcagatatctcacaattgctcttgtcttagaactactcatctactgtcctgtttctatgatatctatgaagaggtagaaggcatactgaataaggaaaaataatgacaatagaaaatccctgctgcagaaccatctggatcaccccagtaactttggcatctccagtgttatgtcaacataagggaaagggtcctttcaccatctttgccaccccagccttggaggccaactcccaaatgacagtttacttggaattttgtctaaaaactgtgtcccagaacacattttcatccgtccatgcctagggaaagatatttttttttaaatctggagaaaaattagaaaatcaggactaagtgaaatagatttctttttttagtaaatgtatccaataagtagataatctgtccttgaattaggatggaccacaatttacctcttttctgaattggtttataacttgttttacaatacttatggtcttgcaaaaagaaagaaatttggtctagtgctatgtttcagttagtaagaaattcatgatgtatttaaaatgatagcagagtacacagcctataattactggttgttatctcccacccaaaactcaaaatctgaaagataagcacaatggggaagtttattttaacatcatcagtagcagctacagcaacagcatcacaaacacctgggtagtacaatagtttatgtagcacattaatatcatgatatatattaagcttcctaaaattttatgaattgacagggaaggcattatctttagcatttctagaaatgaagctctgacaaactatacatgtaatatttgtctatttttttctaccaggttgcttctcacaagtacataaaacatagtaatcaattacaaaagcattttgtagaaaaaagttgagtcagggctttgcaccaatgtgtaacatgataattcatgaccagagataaaccttgcttatctagtcatgacatagatgagtgatacacttttgattaagagagattcgaattcttcatggaaaaatgtgaaggcccaagctttcacggagccgttttgccacattgtgttcagttaagcaataagcttcttctattatattggaagagtaggggttttccagggaataaaagtgatacagtggaaagaagaaaagctccaggtaaagtaataatttgggccttaaacatttgcctggagatactatcaaaagaatgatagttagtagagactaggaagggtgtgtatgtaagtgagggataaagggaggttggttaatggatacaaacatgcatttagacagaaggagtaagttccactgttcactagcatagaagggtgactatagctagcaacaagatattatatatttcaaaatagctagaaaatttgaaatgttcccaacacaaagaactgataaatgtttgaggtgttagctatcctaaatacccggatttgatcatgacattctacacatgtatcaaaataccatatgtatcccataaatatgtacaaatattatgaatcaataaaaagtaaatatctgttactcatttacacttaatctaaaaacaattaacttttctctggaaaaagcatcttctttaactgagcacacaacttacagatagatgtacatgtgcatcaatcagaatctgggcataaaaccagtcagatcacatgaactggatattctgaggagagtttgaaagagggagtagttccaaagatatgagcagtgtatggggaataccacaagaaagtataaggcaaaatcttggagctagtaagaggtgaagagagccacttttaggtctaaataggccagagaagtggatgatgacaacaacattgagatgaagtggctatgaggcctcttgacaagatgcagctagtccatgttgaccacacagaaaaggaggatgaagaataactaacctaacctcactgtcttcccttcatctgatagaacttcttccagtcttccccattgtcctaatctaaaatgaagccagaaggcagacaagtcctttaatgtaatcataaagatcagacttccaaggcacaaggcaaggtatagagggatggaatgggaatctggagacaaaatgaaggttctaagtatatcgagggttagaaactggcaaaaaagggaaaggacaaatgtcaccagccaggccaaccgtattaactgtgacaggtaaacttaggctcaatgaagttaagtgacttgtcccactgagtaaatggcagtcctggaattataaccaagatttttatttccaaacttgattgttagtttatttcaataaagctacccatttattggcttttaaatggtttctaaatgtagctgactaaaagttaagttaatgagagccaaaacactatgtaaatcctcctggaacatctctttataatagaaatgataactatacaaacataaaggcagcaatttctagagtattcatcacttattttcccaaagtgttaatcaaaatatataaaaacaatgctgtaaattgctcttagatccccctctgtcaacttgtgaaaggatatttaatccatcatagccatcaaataatgtacctactattgaagcaatataaggaactcagtaattaaaggcctgggatttggagttcgacagacctgggtttgaaatcctacttaactgctaatttaccatgtggtttttgacaagttacctaacttctctaagctctattttcacgtctatgagttaggaataattatagcaactatttcatacagctgtgataaattatttcagatagtgttttcagtgcataaaatgccctcaatcaagtttaactgtcagtggtattcttaatagtagctcaattatatctaatcactttgtacatctaaatgaaagatgacatctccctagggaaactccttcccaaataccactcttatgaggactcaaagatccatattgagattctccaataaatacatgaccatatgtgtacttatagtttatctgtaagtcaagtctctatcactccatctgtctatactagcaatgaaaataagacaacctatctccatgatgtgtcaagaaagcaggacaattgtattaaacttttgtagtatgtaggatgggccacccaagacataatcactttgtcccagaaagtagtttttctgcatgtggtattttgttttgtactttcatgttttattttttaattgataagtaaaaattgtatatattttgcacatgatattttttatgtttcctgcagtagtgatgagcttcgttcacagcaactaaatattggagcaaaatgtttgaatctgtgattctctatagtcactgtcattcaaaaggaaattccagttagtgattcaaataggcgatctctaatatttagtactttactgagctcatatctaatcccttttagttgtaaagtacaactatcagaattttttttactatttgaggaaaaaaattagtttctattcacccagaagggctgattactctcatcaaatactctggcttatgaataatgtatgtatgtaggtaggtattatatgtatgtatatactaagtttgtatgtgtatgtgtggtaaaacccagactcccacagctcaagttctttcattcctaccccctaaaggaaagccttgctaccagtttggtttttgtccttcttgttttttctctatgattttataggcataaaatatatttatattggcattaatataaacatagacatgtttagctatagatatgtaagaatatttgttttatttacaaaaataggatcatattataattttcatttcccatttaacaataagatgtagacagcaagatctacatacatagatccagatcagcacatatagctctatttcactctaagggcatggtacatggtattccactgaatagctgtatcattcttctattaagggacatttaagttcttatagtttttgggtttttttgttttattttgttttgctattacaaacaatattccagtagcttcctttgtacataagtatttttacttatctgttttgctataatttttgtctaaatagaatcttataggtaaaacttctgagttattgcatagtatattttaaatgttaataaatacttctcaattgccttctaaaagtttgttccaatttacatgccctccctgacaacagtatgtgagaatattctgatactttactggattagaaaatatttccattacctcagagattacacttgtgaggatataatctctgttcatggagtaaacagtgtatgtgtgtgtgcttgtgtgtgtgcattcgtgtgcgtgcgtgtgtgtgtaggtttggtcatattttaaatgtgttgggagtatggtctatctctaactcaaatggtgtcaaccccatagtgacaagcattctgtggcgtcatgcattccatggacagctcagcaactgtttcccttgatgttgaaaacagcattctgccagagtctgtgctgacagacaacattagtcatccagtcttttccacagggctgaattgtttgttgaaaaaagccattaggagtaataaagcaatgtgagactaagataatttttcttgagtttgctaatgctaaacaaacacataccctgtcaaggcagccagtaagcagtatgaggcctgctgcttacctgtgctcacaggtggcagcaaaatcaattagctgcttctacccatggcaagtcagtgatattgatccactttataaagctacatgacattaaattgtttttttttgtaaaaaggcatctttcattctgtatttttcacagaacttctcacaactaactcagctctctatgcctcttcgtactaaaagaaacttgataaatagcctaattttctctaaggttcccaaaagacttttatcaaaactatctcacatctcaccatacctgagatccatatgcaaataatgtgctgatcttggagaaattatataagaccaaaaagaccagatgtcaccctcatctttaaaatgaggcaaaatatgcatgatatcatttagtatctttatatcagcatctttaaaaattttcaaaaagttgtacacaactgaaatatgcagaagttattggtagaataaattatggcacaggctaagagtggaatattttgcagtcattattagtaaaaagtgatattttggaagagtatcttatgaaatggagacttattcatggtaggctctttagtttacaaaagaagtgtgttgaaatgcaatatgtatagtaggatttaatcctgtacaacaaaatgtatttaaataacgagaaataccactgtatatcaacagattgttgctgggtagtagtattgtgagaggtttatattttcttccttaagtttttccacatattctaaaataagtagtaccaaatgtgctttatataacacataaggaagaacgttttaaccatcaaatgacgagacgttggtataggttatcaaagaaagttataaagcttccattatagggaaggagtgttgaagaagataatatatttaagcacatgttcttaactatttgcagataacttgaacctgattatttagataaactttggcatcagatctcggtacaaattcaagctctgcttcttacaagctaaattattctgaaattattctggagcagttgtatcaccagtttgagccacagttttcttgtatctattaaatgagtataataaaagcattcctgtagagcttctgtgggaataaacataatgtaagtaaaattagtatgtaacacatacctggtacatactaagtatggcagagctgggatctctgttcaccaaatccatttccctatcctcctaggcagacatctagtctatatttctcagcctcaaattacagtgaaggatgataattttatgaagtcgtggctattgtaatgtaggtagatataatgtatgccaattccaggtctggcctataaagacctcttgcgaaatccttcattctttccgtagctgctaagtggaagtcactgccactaggtgaaggtggaagagctcccaataacctgggttttaaaattactagatcaaggattctctaattccttcacctattgaactttacaagagcaacaaattctattgtgtgaagccattggaactcttaaatttatttgttatagcagttagtgttattttaactaatagagtgctcaataaatagtaactgtaaccactactaatatctcccctaattttaagatttccctacttacaactgctttaaaatacaaaggagtggggtgggcgtaggggccaaaatttaaaagatagttggtaataaagctgggacgggatttatggtgactggcatgccacctgattctaaaaataggactgtatttcagaagaaggaaaaggttatatagaaatatgatctagtgaagcaactgcttcagagaaggtgcatgacatcatagccatatccaccctaaggtctgcacaaacctcctatacaaagagaaagctgatatatttccaagaatatcttctaggtgctgttatccagtttgagtacgtgatctttttcttttatgcacggtgcagagtcaaacggttgcaaaattgaagtatgcattgcctttgcctctagaatgagtcatgaactcaaaggtctggctagttgtggtcatgaaagattccctagactcattcaccagagcaagatgcctttcagtgttgaggtaagttaattcctgcacatgtgtagtttgtaaagccctttgggatgcaaagctctctgcaattgtcagatgttctttagattattagacaggaagtcaggataaaagcgcttccaaatgctacaaatctctaaggatgtaagcagtgctgtataataaaaattgcagtaagccatgcaaaccctctgctacaggcagtatcacaaaagttcagtttttgtttgtccttcctgtgaagtattactcttatttaagcatagaatctatgtcctaagttggtatacaatgtttagatgctgatagctttaactatttttaaaaccttgatgaaaatatctctactgcttccagacacttgaagtgaacatttcaaatccccataagaatgatgtatgtaattacattactgtataataaatgcagttatgagatgaaatggaataggtttcaggagaagagtccaagaatttcagtacataatgatacattctcagttctgcagttcaaaatgagatacaatatggcacagacttccaatgatgatccacattagaggaaaaaaagccccaagcaatagactgatgggatgagtagtaacaaaaatatctgaatgctacactgtgattatcaaattctgtacttaatataagcactaccatccccaaacagggtcaaaagtttaaagggaacattgcagaaaatgaggcaccagagaaagttataactaactaggtcaaaagtgttcagagtgtcaaaactcagaacgtctataaaagggcaggaaaatgtcacaagcctacaagaagcaagcgatgactccataaaatctgattattattataaaagacaggattgttggaagtaagcaagaaaattattcccagtatttaaaatgtaaaaataaagataacatacctgtcacagaagtttctccaaaattaaatgctaaataaattaaagcaattaccaggccagtagctgtgaaaattgtaataaagaaggatccccttcctcaatactttttctccattttttctgctacctgccaggcctctaacttcctgttgtgaaattgctgcttattgtcatttgaaaacctaattgtgatttgtttaaaatgtgctttttataatttagaatgaaagctacttaattatctttgtatttctttactccttgatttaatgggtcattgctttagatttattaactaaatttcacatctttgttatttataaaagacctactttatagaaaaatcattgttttaaaagcatgtaagaagtcctctcttgctattatctacacatacagctcgtcaaatagacatatctgatcattttgaaggggacttaaaggaaaaaaataaaaatatagaagaccatttgggctaggaagctttatctggtgccagtgatcaggcaaaggaactactggggttcatgagtagtccaaataaatagcatacttcttcagcaccttaatttcctgtaaaagctattttataaaatatagcttagtttaaaaattaaacagcttcttagtgtttaacttcaaaattactttgcccttcccacccaatcttatcagaagaggactgggagaagtgtccccacgtgggagcagatgagaatgcatccactttgcaggaaggccaactgcctagggaaaagcagaagctgaataaaccttgctcaatttattggtttcaaatttaccaattaaatatgtccagcagaggaatgagttagaggaaaagaaaagtcaggaatgatatgactagtaaaactttctacatagaaaaaaaagtcagagctgggaataggcattcccagcttatagtttcaaaaataattaagcagtctttttgaagagtagccttgccaactcaaatctagaaacatcaatctccaaccatctttgctgctgccgcctgatgatgcagcactgaaaaccaaaactcagcatcttgatgtattttaacttatcagccttcaaagaacagccaagtacaatttttgaaaagacaaaaatcagtcagctgataactggcctggatggtgttccattcaggattctggtagtgacagaattcattcagatggtttaaataaacatactttaatgagggtattacttataagggtgtgggcaggattaagggaacaaacaacaaatactggggcactccaactctaataatggtaggacattagtagcactcttaggtcagaggaaaatagtttcaattacaaggggttggaaggtgaaagtaaagtgaagtagaggcatttcttcccttctccctccctgcctcagcttcaccctacctccattttccagtctcttgttgacccccattgactgaagcctatagaaactggagagtaagtgatctgaaaggacagttacttggggtcagcctcccaaggcacagagtgtgacagagatgagtgaagaatgaatctgaaggtcaaatggagaacaactagcagagacaaattttactcaagaagaaaaatataatcctagagattttatttgtggtcaatataaattctgcaaactaatttttagagtgatattgttgaaaggtcctaattccagctctaactctcagacaagctttgccccaactgatgcaaacagatggatgtctattcatccacctcataaatgtcaccaaagggaaatgctatgatttcccatagtaaaacaattgtagccattttatttcaactaatttggtagatgtttgccttttttcactccaagtagattatatggtatgcttttttatgtgtattctaagtaatttcaccactacatactctgtgtattcattttctatttctgcataatagattctcacaaaattagcaacttaaaacagcattaacttattatttcacagtttctatagatcaaaaatccagtaggatatgatcaggtgcttggttcaggataccacaggctgaaatcaatgtgttgaccaggctgagttcttattatttggagaccgtgaggaaaactcttctaccaatctcattcttcttattggcagttttgttccttgtgtgtgtaggattaagatctttgtttccttattggctatcaatcagggccactttcagctcctagaggtcacccacattccttgccacatggccccttccttcttcaagccatcaacagcgcaccaaatatttttcatgcttcaaacctctgacttcctcagtctgactcctaagcccagatttaaagggctcatatgctgaagtcaagctcatttgaatcatttttatatcataaggtcaactaaattgagaccttaattacttatgcaaaatcccttttgccatgtaatgtaacataataaagaaaattctgtcttatcacaggtttcacgtacacttattcacaggtttcacgtacactcaaggggaggaaattacacagttcacaaacaccagagggaaaaaattgggggagctatcttagaactctgcataccacactatgggatgtcagtaaatcttattaatataatctagtaattttctcccttaattctaaatttccctgtctttcaagtattcaggaaaacaaagctcattgtatcatcatcatttttaaaatgaaccattttgttcttgcaaacttcataaaccatatctcataacttttgaacctctgattaaataattccaactcctttaatgttttttcatgtttactttttcaaacacattcatatttcaatttatattctcttaatcttcttcattttttcatatccctcttacattggtgcgtcaatttttgttcttaaagtcatttacagtggaacagttctttaatatatttgcaagtcttcttgaacagctgattcttattctaataattattgctttagtcctttaaaaaggaagccatggccattagaaaactaaatttaatcattaaaaagaaatctttcattatccaggtactcaaaatattgttgaaatatagtagttgtaacagagggagtaagtagacaggggatagtgctagaaactgagaagttggaactcagttagctttcatggtgtcactcagttaccaagtgatgctggagagtgtctgagacttttgtttatcacagttacttcatccgtacaagtgattttcttgatttcctattcttgctaacacttcttaattgtccttgagataacagaaaacaaaatctatgaataggtgtattgaactcagtattttttaactaaaattaaataataagttgaaaattacctaaggtaacaattgaattatagtaaaaactaatctgaaagtagaagtttcttgtttgtctccatggatgattgataggtttatactattggctccctaggatctgtaaactagggttcaaatggtaagaaaaaataaaatttgctccagaaagtatcgaataatccaactgccaatgattacattgttctggataattgcatttgacagtccataacacaccaccccgctgtgagggaagacatgtcaagaaccgatgcactgttcttgctgttattctgcaagatttacattcatgccttgaggtgctccaaagagaaaacattcatacaaaatatttttaatgttttctaatctatttgttacaggattagcttttgttatgaaacatagggtgtcacaattaaaatcagctctaggctgggcacagtaactcacacctgtactttcagcactttgggaggctgagggggaggatcgatcacataaggccaggagttcaagacaagcctggacaacatagtgagaccctatctctacaaaaaatttttaaaaattagccagacatgatgatgtgctactgtagtcctagctacttgggaggctgaggtaggaggattgtttgagcctaggaggtcaagattgcagtgagatatgattgcaccactgcactccagcctgggtgacagagtgagatcctgtctgaaaacaaaaccaaaaataaaaaccaatcttagttgtgttttccaggctgtgttaaactattgaatgacttgagcaaaacaaaacaaaacaaaacaaaacaaaacaaaacaaaacaaaaaaggcctcttattcaaaatgcaatataaaaaatgttcagcaactcttacttgggagatttttatataaggagtatgtttgttagtaaataaatacaacataaaattgaatggaagtgtgctgagttgtttttctatagaaggcaaaagacacacaaatagatgatatgagagagagtcattaaaccgagtcatttgttcaagtccaagccagatcagtagcaaccaaaagctattactaagtgatgacatgttttgacctatgagaaataagcctgtccagttcctaagctacatggattggcactatattttggaataaatgagcacaggtacttaccatcctcctcacctctagggattgaccttttccaatggggttttggcccattgacataacaatggggaaaattgcaatgcagataacctttgtgtgacattctataggcagttgccccataagtcaaatttcagttgacccaggattatctaaaaaggttgatcaaattagtacacttaagaatgaataatgtatggtcctgtttcccaaatgaattggagaaaactttacagagagacaaaagggaaagacaaaaaaatgctaatcaatgttctagcagccacctgtgagtgactaagaatcgttaattaaaattccattcaactataaaaaatgcaattactgtaactccaattgttaactttcattagaggcaagaacaatcagaaacacacatatacagatacaaaggaaaaataacttgcttctgatctgtaaaatcgtgcatgcatgtgcacatgcacacacaaacacactgaccagatgggtttaaaatttattctgtggtaaactactattgacagattctaactctagtttgtctcattaggtcaccctaaagaaatagaaccagaagattgcagaattgcggccttcgattctcctctctaagtagactgagtacacttgaagacaacaatatgggcattcattagatggaatttggaagacaaagctgaggttaaaaattacatttcttttgactaaacttaggcaggacatttagtctagcgttcaccacaggtctcattggtccctactacctgtaccagactttccacaggcacactatatgcgtggccattaaggtttttagtttgcattcccaggaataaattgatttctcactttgataacatgctgtgctacttctggcttttacattaaaacccttagaggatgataagtatggttacagaacacattgtctgagtttcagatctggcttattcacttaataaatgctatagtttggatattcatccaccccccgatatctcgcattgaaatttaatcctcattgatggaaatgaggcctaattggagctgtttgggtcatgtgggtggattcctcatgaatggcttgacatcgtcctcaaagtaatgagcgagttcttgctctgttagttcccatgagagctggttgttaagaagagcctggcacctccactctctttctcttgcttcctatctcaccgtgtgatctctgcacagttgaccccactttgtcttctgccatgagtagaagcagcctgagtccctcaacagaagccaagcagatgctggcaccatgcttcttgtacagcctacacaacatgagccaaataaagctattttctttataaattacccagcctcaggtaatccttgaaagcaatactaaatggactaaaacagtaactatgtgactactttataccagagactcaaaatttctgagcctcagtttctatgactataaaatagggatggagataatattaatatctaattcacagggttattgtgagtattcaagtgtggttaaaatactgtctggaacgtagtaagtactatgaaagtgtttgttattactttaagaaggtggtagggtacttttgaactactcggaggctaaatagtggtgacaaaggaggacagaggaagccaaaagagaaaaagtcttaatctgattaattatatgtgggtcaaaaataaataccagcaccaatgaatatgaggtaagacaagtgttttgctcaattacgatattaaatcttattgcaaattttttgagccttctataagactttaattgggaccaattcccccactgaaggcagctttttattcatttcattgtcagtataaatgactttcactcatctgaatgcaatcatgagatctacctgacagtttcatctcctgaagaaattgttttttattacatgtgcttttatcatgtaaattttcttgcattgaaaatcaagacatgccccaaaacaatctaattttgggttttacttttaatggaggctttaatgtcaataatttgtggaggaatacagagtaatttagaagcctatttcagagtgattgagaaaatattcattgatgccagcaatattccagtattctttgtttgagacatccatggaaatggtttgagtagcttattctagtaatttccaaagctggtgaaaagaattcaccatgaatcacaatagcagtgtttttaaacagatagagccatagaaaataaggtatcaaatttctatatctgatgtatggtctcctctagtttgggaaaggaagatactatatcatcagtaaacaagaacagtgaggggaataataaacctcaaagctctgtggcctaagacagacaataaaggttttattttttgctcatgcttcgtgtacaacacaggtcagaagaaggctctgctttttggagtcattcaggaacccaccccgacagagactctgtttcatcagtgtaacagagggaaggaaatgtgaagattacgtactggctattaaagtgtttgccttgaaaagataccggttggttctgctcacatttcattagctacaaacagtcacatggccatgcttaacttcaaggggactgaaaagtgcaatcctaccatgtgctgagaatgataaggtctggaatagttatgaacaaccttgattaccaccacagatgttcatctaatttacaggaaaattagaagtctgtgtaagattgctgcacttttagaaaaattaggtctgattgtttttatttgaataccctttcgtagcctgggttcccagaaagtaaagtctgaggcaatagttctatgctactaatagtattggaatatacaacttcaggacagcaagggcaaggggaaaaggggaaaaggtagggtaataagaagagtaaatattagagcatgcattaatatatggcattggtaggcatcaagcctgtatcagtctgttttcgtgctgctgataaagacatatctgagaccaggaaatttacaaaagaaagtggtttatggacttacttacagttccacatggctggggagtcctcacaatcatggcagaaggtgaaaggcatgtctcacatggtggcagacatgagaagagaacttgtgcagggaaactcccctttttaaaaccatcagatcttgtgagacatattcactctcacaagaacagcatgggaaagacctgctcctgtgattgagttacctcccatggtgttcctcccacaacacatggaaattaaacatgagatttggttgaggacacaaccaaaccatatcatttcgcccctgctcccctgccaaatctcatgccttcatatttcaaaacaatcatgtcttcccaacagtccgccaaattcttatttcagcattaactcaaaagttcacagtccaaagtttcctctgacacaaggcaattcccttctgcctatgagcctgcaaaatcaaaagcaagttagttacttcctaaatacaacgtggtacaggcattgggtaaatacagccattccaaattggagaaattggtcaaaacaaaggggttacaggccccacgcaagtccaaaatccagtgcggcagtcaaatcttaaagctccaaaatgatctcttttgactccatgtctcacatccaggtcacactgatgcaagaggtgggttcccatggttttgggcagctccgcccctgtggcattgttgggtacaacctccctcctggctgctttcatgggttgacattgtctgcgacatttccaggtgcacagtgcaagctgttggcggatctatcattctagcgtctggaggatggtggcctcttctcacagctccactaggtagtgccccagtagggactcagtgtggggtctccaaccccacatttcccttctgcattgccctagcagaggttatccatgactcatccccacccaagtaagaaacttttaaaattatctgatactcaataaatgttggttaattaagcaacattttaaatgtataatgtttataagacagtcattttctaaagggaaactaaacctgtcattttggtaggagaaatttaaaaataaaatatcaatcagtaagactgaatcatttcaaaacctctaacttctcacaatcagtgggaaaaaaaatcaaaaattccaaaagaagagttttacaatgtggagaagtaaaaaggacatgaagtggtaataatgatatgctaacataggtatatattaggcctgatggcaaaggggtgagaactacctcacaggttttcaccccaatttcaagctttgctaattcataaaaagccatttttagaaaatgatatcattgaaaatcttctcattgacttttctcagcttaaacgtttaaaattttatctagctgtaaatcaatcatccctttatttaaagagctatgaacatttttcttaatatataaaggaaaaaactgtctttaaatctagcaaatactttcactggttaaataaaaaaaaaatcttgttttctttcttctgacagctggtacacaaagaaaaggagaataataagttttaattatacctttcaaaacccaacagatttgaaagctattcaggaattacatgagagaattctcagcattaacttgtgggtggttaagagatgttagctctcattcttgagggtgagatggccaaacttgtgagttgaaccacaaaactaaaattcccaaatttgcaagcctttataatgattattttcttcaggagtgccctgtgtctgtttttctcttttttttccccttacttaagaatggttcaatcaagtcatcaacactttaaatcatcacacagctcttcttctccaattacatcaaccaacatcagatgtgaaaatagagcacacatcaagcaaaaagatgggattataatatcttccactttagccagggagtcaagcagagcgaagaatgagagcatgcacaagagagacggtgtaaatagtcttttatgattcattccttgactctgaggaaaaaaagaatattgcatttgttaattctaaagtttagaaatgaatctggaagcagatgttggcaagatggccaaaaaggacattcgatctcttgtctccccacaaaaccatcagtgtaaacaaccacacatatgcaaaaataacttccgaagagctaaggaaaccaggtgagagattacagcatctgggaacagcaaagaaataagaaaaacatattcaagataataggaacaacagttttcattatcattataacctcttccccaaccccaggcagcacatcatggctagagacaccctcctcttgaaagaaggaagtgagcattggactttgcctcagattctaacacaagactcaccacagtaaaacccagtgccaggacctcatggccccagactctagtccagtatccatgagctgaacttctaggcctgccccactaccaggccaaccttagcagcccccggcttcagaccagccccagcactcagccagcccctgtgatttcagagtttatatctatcccagcatcatggaaggcccccacagccctagatatcaggctggcacctgtgaatttagcctccgggtcagttcctttgtatacaggctctaggcccacccagaaccaggctagcccctgcagccacaggctccagaccagcccagagtcaggttggaatacacagctttgagcttcagacccaccccagcaccacgtaagcacccctgacctcagacatcaggccaacacctgcagacagaggctctaggcttgcctagagccaagccagtccctgcaacaccactcttcaggccatctcctgtgtccccatgcttcagccgacccaaggtgcaagctcattccaataaattgcagtgctaggccagccttcaaaaaccaagctccaaaaccacccctgtggactcaggttccagtttggccccagcatcccaaggatccaggtcagcccttgcagatctaacctccaggccaccacagtcataccaagtctctagggtagtccccataggtccgggttctagcacgctccctgtgggctgaggttctaggccagcaaccacacacagcctccaggccagatctcacataacaaggtcccaggccagtctccacagcttcaggatccaggccagtcctcatgattctgggaactggatcaccaccaatgatgccaggatccagacaagcccccacaaacccaggccccatgacttcccaagcaccaggcaggccccagaccctcagctagtcctggtggtcccaggctccagtgaatccaggatccaggctcattccaagtcgacctttgtgccaagccagcctccacagattgactccaggccaccactgcaaaactaggctccagaccaccccatggacccagggcccaggcctgctgccatggactcaagctcgaggcttgccccagcaaaagaccagcccctgtagactcaggcttcaggccagctccctcagaatcaggcagaagtctcaaccacatgctgatccaggttacagacaagccccctatgggcccaggaccaaggcctatccctgtaaactccaacttcagacccatctcactgaacccaggtttcaggcatgccctcatggacccaggctccaggatcacccaccatggactcaatcaactggaccaacccagagaattcaggctccaggtccaatcctgtggattcaggcacaataactgcccgcctgctgactcgggtatcagcccagacagtccaagtacttcaacagtcagcccatccacagaccctaccatacagccttcccagaatctctggatgcactgattggtgaatgactttcccagatgatgtccatctgtaaagactgaaaacgttccaaattttttaaatgttcagataccagtgcaggaccacagggatcagaaaaagtcagggaaactatattaccaaatgaacaaaataaagtgccaatagccaaccctaatgaaatgaagatgtataaactgcctgaaaacaagatcaaaataattgttttaaggaagctcagtgaacttcaagaaaatacagaggaacaattcaacaaaacaggaaaacaataaatgatcaaaattacaattcaacagagagattgaaattattttaaaaatcaaacaaattctgaagccagaaataaaaagaacaaaatgaaaagtgtgatagagtgtcaacagcagaactgttcaagcaaaagaaaaaatctgtgaacctgaacacaggttatttgaagatacataatcagaggagaaaaaaaggataaaaacaaatgaggaaagcttatgagacttacaacatcaagagcaaatgttcagattataggactaaaataaaaagaagagagagacaacgggccagaaaatgtatttaaagaagtaatagtagaaaactttccaaatctgtagaaagatgtaaatatccaggtacgagaaggtcaagtttccaattatattcaaaccaaacaagaaaacaccaagaaaaaaacagaatcaaactatcgaatatcaaagacaaagaaaggattctagaaacagcacaagaaacatatgtatgaggaaattccaataaagctagcaatgttgttttcattattttttttatttttttttttaatagtacaaagttggggctctttattcagacgatagagtaaggaacagcaaagtgggagggctacaccatcaccatgacaacagaaagcctcataaacgtaaagtccctcgacttctgttgggcagactcttcctagctcaggagaaacatgttttaactggctgagaacaaggccaggcagcctggccacagtgtggaagggcagccagaggcgcggcctctggtcagtcctggaagtgcttggtgagggcttctagcagctcctgcttcttcagccagtactccaggcaggcctctttcatcattggcacagtgaactttcccaatgtgcccttgctgatgtgggtcttcagctcctcttctgaatactccgcttgggccttttgcttctggaaccttcattattgcattttctcttggtaattttcccttcaggattataatctggtgagtagacaagttccttaaactcattcaccatggagcccagtcttttattcatttcttcaaccttgggtaatataaggtccactgcttgttcctccatcaaatacaagatcaagggctccaggttcccgaagtgctgctgcagcacggggttctcaaagctgtcacttctgtatgtgaagcagagcttctgaatgatagccttcatgttgtccacctgctctggagttgccatgactttttcagtaaagggcaccttccttttatcatcagcaaagggtaaaaagaccagctggaaacctggagtagtcacctgaattttctggtcatccaactcctcttcctgtgacaccaaagccaccaaataaggggggatgttcctgcggggtgtgtatctgcacaatgctatgaccaccttctccagacacttaatgagcagagcactgaacagggttgaactcccattcaccggcgactcctcagggtacgtgaacaaggagggcctcgggtaatggtgctccttcagcattaccaagggcttgaaaaccatgagcatcaaagctggttcatcaaaccattttagctcttctgtttcctctttctccagtataatctgatgactcccatagatctgagaccgcttggtatcgctaggcagaagcaaactgccggtattaatattaaatttccgggacttggttttcactggttcatttgttttccgatagagttttattgaaggaggcttgagagccttctggacgagactgtaaatgcccacagagatcactatgtctttgttgagcttcagctttaacctgctgagtgcccatttcctggtctccttggcacgaaccttctgcaacaggtcttctagattgctggattcctcaaagtgaactggattcctcaaaggatgaggtcctcatcctttgccatgctgatgatatctctgtagaacaaggatatgtcaaagcccccaggtttcttcaggggcatcaagtcaaggaagatgcctatatctcgtagatcaccggctttggtcctggcctggcaggccttaacactgtcattgccatgagggttgtcttcattggtgagcagcatgattttctatgactcatcttgaactggatatcactaaacagtttggcacagacccacagaacttcactgaatgagtagtcagatccatggcccatcaggtcttcgaaacatttttgtccctgctgccccttaaactggtcaagctttagaatttgttttgcacctggattttccaactcctgtaagacgtaaatatttttaaaattcactgaatttttgtctttctcagtatcataaagatctcgatcactgcttatgatcttactcatgtacacactttggatacactggatgctcatgtcaaaaggagtcaactcaccttcgctctgagattcaaacatagccctggaggcatcaaccaaaaaaaattaaactatcacttcctgaatatttctagtattcacttgcttcaaggtcctcttcttcttctgcttcttcatcaccctcggttttataataagactcacaccctgatgtgttggctactgctcactttggcacagggaggtaacccacaatggatttcatagcagaaaccttgcagaacaagagagagtgggatgatatattcaaaatgatgaagaaaaaaccctgccaacaagaatgctttctctggaaaagctgttcttcagtaataaaggagaaataaatactttcccaaacaaaagctgaaggatatcatcaccaccagacctgtttttcaacaaatgctaaagagaattcttcaagcttaattttaagaaaatgctaaatagcaacactaaaacgtgaaagtgtaaaactcactggtaaaagtcagcacaaggtcaaattcagaacagtctaatactgtaaaggtggtgtataaattatttaaaaatttagtatgaagattaaaataaaatttataaataaaagacaagaaatcaaagcataccactagagaaaatcacctaatcacaaacaaagacagcaagagaggaagaaaggaacaaaggatctacaaaacaaccagaaaacaattaacaagagaggtggctaagatggccgactaaaagcagctagtgtgtgtggctctcacagagaagagtggaaggggtgagtaaatatagcaccttcaacggaatcatccaggtacatgcatggggattaatcaaataaacaactttacccatggagaatagagaaaagcaccacaggatgatggcccacctgggagtggcagggagccaaaggaacctccgctcccagggaagtggtgagtgaatgtgtgtccccaagaatgcatgcttctcccacggatctttgcaaccctcagatcaagagatctctttgtgaacccactccaccagggcctttagtctgccacccagagctacgtggagttttggcagagcagccgctcaggcatgcacagagatctggaagttttagatgctcttgctttccaggcttcccagcaaaagtaactgcaactctggaaaagggcaaagtgggaggttagactcccatacatatccctaggaaagaggctgaatccagaaggtcaagcagcaatggtctatgggcaccacttccaaggcacctcaccagataagacccactcgcctggaattccagtcagctacagatggcagtattgtgcctccatgggatggagctcccagggtgagtggtaggcccggatctttgctgtttggatgacttagctgttatggccttcgggctttggtgagtccaagctgaccagagatggaaagaatcctccagcacagcacaactgctctactgaaatgtggccagactgcttctttaagtgtgtccctgattccattcctcatcactgggtggagcctcccaaccggggcctttagccacccccctcagtgttctccagtcagcagagatttgaaaactctctgggacagagcactcagagggagagtcagagagctccctgtgagctgtttggatgacttagttgttctagctttcaggctttggagagcccaagccaactgagggtggaagcagtaccccagaatagcacagctgccctacagaaatgtggccagactgctttttaagcaggtctctgatcccatttctcctcaccgagtggactctcccaacaggggtcttcagcgacccccaccggtggtctttggctgacagaggttttagacctccttgggatggagctaccagagagagggtcgggccaccatcatttctgttttggtgacttagctgttccagcctttgagctttggagtgtctcaggagccgaagtggaccccaagcacagcacagctgctctacaaaaatgtggccagactaattttttaagcagctcccaaactctgttcctcctgaccgggtgagacctcccaactggggtcctctgccacctcttacaggtgcgttcaggccagcaacacctgtgccttcctgggacagagcacccacagggagcagcaggctgccattttgccattttgcagtcttcactggtgatacctccaggtactggaaaatcccaggagactagggaatggagtggacccccagtatatcaccatagctctacggaaaagtggccagactcttacatgggggtcctctcatacctcctcactgggcaggtcctccaggcctgggcctctagccaccccccaccagagatatgaagctaatagcaacttggcaactccctggacagagcctccaggggcaactgacagcctctctgccactgtctctgcagtggaactgtccttactaccctcagactaatgaagaagcaaagaccctaagtatcttatccacatctccaacaagctgcaattgccccaaggacaggaggctagtccatctcccatgagtcccaaacatcccctactgctcatcaccaggcagaaaacccctggctttgggcccacagtacagactctccatcctgggctgattgctctgagcaattgctgacccacatctctctcaggtggagtccccaggagaggagcaaagtggtaaaggcagcaagccagctgatgcagagccgagagggtttggtgcaggagcatctgtagtagagcatggctatccctctaggttcaacttgcttccataacagactttagctctgagggaactgtcagacatgatgtccgcagggtggtcatgcacatcagatggagctggcccaacctgagcactctttggtctgctggcctctcccaaggccccagcctggccatgtctgcttacagggcagtcttgtgtgcctgggggtccacctcatagcttctgtaccagtggttcatgcctgactggtggagagctccagtgaggcagcccctatggccacacaccagtctgcatagtacctctgcaaactgcagcttccccaagcccacagcaaccccccacatcactttgctggcacgtgtctgcatgaacaagatttattttatttgccccaccagcacgcaggagtgcagtatgcccccctaacccccaacaaccagcattgcagacggagccttgttggacacagagccagcaaaacctacccctgacagcaccctgcccttgcactaatgctgcgcagagaacagggaatcctcccacatcctgaatcatcactcctgcttgcagggcacagagaaggcaccaagacctttgctggacagcaccctacttcaagccaacaccacctccattgcaacagtgcacacagtcaccagcaggaaaccccctcctgccccattttctgccaactgccttgactctgccactgtgattaatgcccgcagggaggcagacacccctgcatctgctggcactctactgctgctgccacatctcagtcccctctgtgcagtagactccaaaacttgaggagccagagaaaaaagtcagggcccaatacaagtcccccagagttagagcacaaagtccaggtgttgggagctgaatgtcggccccctaaaatcttccagaaatgaagtaagttggctgaatccaccttataccacaatcaaactctcaaggtcatcaaatagaataaaaggaaaaaaaaattccaaagttcagcaatcacaaagattgagggtagataagcccacaaagatgaaaaagaatcagcataagaacactgaaaactcaaaaagccagagtaccttctttcctccaaatgacctcatcatctctccaggaagggttcggactgggcttatgctgagatggctgaaaggacaaaagtggaagtcagaatacgaattggaacaaagttcactgagttactggagtacattgtaacccgatgcaaggaagctaaaaatcatgagaaaacattgcagaagctgatagacaaaagagccagtatagagaacgacataactgacctgatagagctaaaaaacacgctacagtaatttcataatgcaatcacaagtattaatagcagaatacataaagtggaggaaagaatctcagagcttgaatactggccttctgaaacaagacatccagatgagaatagagaaaaaaagaatgaaaaggaatgaacacaacctcagagaaatatgaaattaggtaaagagactgaatctatgactaattggtatacctgaaagagatggagagaatggaaccaatctgcaaaacatatttcaggatatcacccatacgaaattccccaacctagctagagtggtcaacatacaaattcagaaaatgcagagaaccccagtaatatattccactagaagatcatccccaagacacaaaaccatcagatttgccaacgtcaaaatgaaagaaaaaattttaaaggcagctagagagaaaggtctgatcacctaaaaatggaagcccatcagactaacaatagatctctcagctaaaaccttacaagccagaagattggcaccaatattcaacattcttaagggaaagaaattccaacacagaattttatatttggccaaactaagtgtcataagcaaaggagaagtaaaaccctttccagacaagcaaattctgagagaatttattaccaccagacctgccttacaagagctcctgaaggaagtaccaaatatggtaaggaccattaccagccactacaaaaacacttaagtacacagaacagtgacattataaagcaacgacattaaccagtctgcaaaataaccagctaacatcatgatgataagatcatatccatgcatatcaatactaactttaaatgtaaatgggctaaatgccccaattaaaagacacagtgtggcgagctcaataaagaaccacaacccgtcggtatgctgtcttcgaaagattcacctcacatgcaatgactcaaacaggctcaaaataaaggaacagagaaaaatctaccaagcaaataaaaaacagaaaaaagaaggggttgcaatcctagtttctcacgaaacagactttaaaccaacaaagatttaaaaagagaaaaaaggtactacgtaattttaaagggttcaattcaacaagaagatgtaactattctaaatatatatgcacccaacgcaggagcactcagattcataaagcaagttcttagagacctttaaagagacagactccaatgctataggagaaattttaactcttcactgacaatattagacagatcatggagacagaaaattaacaaagatattcaggacctgaactcagcactggatcaaatggacctgacagatatctaaagaactctccacccaaaaacaacagaacatactttcatctcatcgccaaatggaacatactctaaaattgatgaaattatcagaagtaaaacactcttcagcaaatgcataagtactgaagtcataacaaacagtctcatggaccacagcacaatcaaattagaaatcaagactaagcattttttcatatgtttgttggccatttgtatttcttcttttgagaactgtctattcatatccttagcccaattttgatggattgttttattcttgctgatttgtttgagttcattgtagattctggatattagtcctttgtcagatgtatagattgtgaagattttctcccactctgtgggttgtctgtttactctgctgattgttccttttgccatgcaaacactctttagttcaattaagtcccagctatttatctttgtttttagtgcatttgcttttgagtccttggtcatgaaatccttgcctaagccagtatctagaagggtttttccaatgttatcttctagcatttttatagtttcaggtcttagatttaagtctttaatccatcttgagttgatttttgtataaggtgagagatgaggatccagtttcattcttctacatatggttagccaattatcccagcaccgtttgttgaaaaggggattgcttccccactttattttttttgtttgctttgtcgaagatcagttggctgtaggtatttgggtttatttctgttttctctatactgttccattggtctatgtgcctatttttataccagtaccatgctgttttggtgactatggccttatagcttactttgaaatcaggtagtgtgatgcctccagatttgttctttttacttagtcttgctttggctgtgcatgctcttttttggttccatatgaactttagaattgttttttctaattctgtgaataatgatgatggtattttgatggggattgtgttgcatttgtagattgccaacaagtatatgaaaaaacgctcagcaccactaatgatcggggaaatacaaatcaaaaccacaatgcgatatcatttactcctgcaagaatggccataatcaaaaaaattaaaaaacagtagatgttggtgtgcatgtggtgatcagggaacacttctacactgcttgtaggaatgtaaactagtacaaacgactatgaaaaacagtgtggagattccttaaacaactgaaattagaactactatttgatccagcaatcccactactgagtatctacccagagaaaaagaagtcattatatgaaaaagatacttgcacacacatgtttatagcagcacaattcccaattgcaaaatagtggaaccaacccaaatggccatcaatcaatgagtggataaagaaactgttatatatatacgtatatatacacacacacacacacacacacacacacatatatatacgtagatatatacattatatacatatatacatatatatacatatatattatatatatatatacgatggaatgctactcagccataaaaaggaatgaattaatggcatttgcagtgacctggatgagattggagactattattacaagtgaagtaactcaggaattgagaaccaaacattttatgttctcactgatatgtggaagctaagctatgagaatgcagatgcgtaagaatgataaaatggactttggggacttggggggaaggataggggggtggggggaggagaggaataaaagactacaaatagggtacactgtatactattcgggtgatgggtacaccaaaatctcacaaatcacgactaaagaacttactcatgcaaccaaacaccacatgtaccccaataacctatggaaaaaataaataataataatgaagaataaatttgaaaaaagaaatcaagactaagaaattcactcaaaatgatactattacatggaaattgaataatctgttcatgaatgacttctgggtaaatgatgaatttaaggcagaaatcaagaaattatttgaaactattgagaacagataaagaaagaagacacagctaaagcagtattgagagaaatttcagcactaaatggtcacatcaaaaagaaagaaagatctcaagttaacaagctaacatcgcaactaaaagaactagagaaccaagggcaaacaaattccaaggctaccagaagacaagaaataaccaaaatctgagctgaactgaaggaaatagagacatgaaagatcattcaaaagataaatgaatcgaagagctgttttttttcttttttggaaaaaaactaataaaatagacagctaactagactcataaagaagaaaagagagaggggattcaaataaacataatcagaaacgaaaagggggatattaccactgaccccacagaaatataagcaaccatcagggaatattatgaacacctctatgcacaaaaactagaaaatctacaagaaatgaagaaattactggacacatacacactcccaaggctgaaccaggaataaattaaatcccggaacagatcaataatgagctctgaaattgaggcagtcataaatagcctaccaaacaaaaaaagcgcacgaccacgcagattaacagcttaattctaacagatgtacaaagaatagcttgtaccattcctactgaaactattctaaaaaattgaaaaggatggattcctccttaatttattctatgaggccagcatcatcctgataccaaaacctgacagagataaaacaaaaaaagaaaacttcaggccaatatccttgacgaacattgatgcaaaaatcctcaacaaaacactggcaaactgaacccagcagtatatcaaaaagtttatgcaggccgggtgaggtggctcacacctgtaatcctggcactttgagaggccaaggtgagcaggtcacctgaggtcaggagttcgagaccagcctgcccaacatggcgaaaccccgtctctactaaaaatacaaaaaatacgtggtggcgggcacctgtaattccagttactctggaggctgaggcaggagaatcccttgaatccaggaggtgaaggttgcagtgagccaagattgtgccactgcactccagcctgggcgacaagagtgaaactccatctgggaaaaaaaaggggggtttatgcaataagatcaagtaggctttatccctgggatgcaagtttggttcaaaatatgcaaatcaagaaatgggattcatcacttaaacagaactaaatataaaacccacaaaattttctcaataggtgcagaaaaggcttttgataaaattcaacactcctttgtgttaaaaactatcaataaactaggtattgaatgaacatacctcaaaataataagagacatatgtgacaaatccacagccaatatcatgccaaataggcaaaagctggaagcattcccctttcaaacctgcacaagaaaatgatgctctctcaccactcctattcaatatagtattgaaagttattgccagggcagccaagtaagagaaagaaataaaaggcatccaaataccaagaaaggaagtcaaactatccctgtctgcagatgacataattctctatatagaaaacctcatagcctcagcccaaaagcttcttaagcttataaacaacctcagtgaagtctcaggatacaaaatcaatgtgcaaatatctctagtattcctatacaccaacaacagttaacccaacagccaaatcaggaatgtactccaatttacaatagccataaaaataataaaatacctaggaatacaacttacaaggggcatgaagtacctcttcaaggagaactacaaactactgctcaaggaaataagacaggacacaaacaaatggaaaaacattccatgctcatggataggaagaatcaatatcatgaaaatggcaataatgcccaaagcaatttacagatttgatgctattcctattaaactaccattgacattcttcccagaaatagagaaaactattttaacattcacatggaaccaaaaaagagctcgaatagccaaggcagtcctaagcaaacagaacaatgctggagacatcacactaccagacttcaaaccatgctacaaggctacagtaaatgaaacaacatggtacaggtacaaaaacagacacatagagcaatggaatagaatagggaacccagaaataagaccacacacctacaattatctgatctttgacaaacctgacaaaaacaacaatggggaaacaattccctattcaataaatagtgctggaataactcctaatgtcatatgcagaagattaaaactggaccccttccttacaccatatataaaaattaactcaagatagattaaggacttaaatgtaaaaccccaaactataaaaaccctggaagacaacccaggcagtaccatttaggacataggcatgggcaaagatttcatgacaccaaaagcaattgcaacaaaagcaaaaattgacaaatgggatctcattaaactaaagagcttgtgcacagcaaaataaactatcaacagagtaaacaaacaatctacaggatgggagaaaaattttgcaaactatgcatctgacaatggtctaatatccagaatctataggaagcttaaacaaatttacgagaaaaaagcaactccattgaaaagtgggcaaattatgggaagagacacatttcaaaagaggacatacattcagccaacaatcacatgaaggaaagctcaatatcactgatcattacagaaatgcaaaacaaaactacaatgagatatcatctcacaccactcagaatagctattagtaaaaagtcaaaaaataacagatactggcaagattgtggagaaaaaggaatgcttatatcctgttggtggaagtgtaaattaattcaagcattgtggaagacagtgtggtgattcctcaaacacctaaagacagaaataccattagacccagcaatcccattactgggtatatacctaaaggaatataaattattctattataaagacacatgcctgcatatgttcattacaatcccattcacaatagtaaaaacatggaatcaacataaatgcccatcaatgatagaccttttaaagaaactgtggtacatatacaccttggaatactatgcagcaataaaaataataagatcatgttctttgcaaggacatggatggagccggaggtcattatccatagcaaactaacacaggtacagaaaaccaaatactgcatgttctcccttacaaatggaagctaaattatgagaatacattgacacatagaggggaacaacacccacaagggcctattggagggtgaagggtgagaggaaggagaggatcagaaaaaataactaatgggtaccatgcttaataccttggtgatgaagtaatctgtacaacaaacccccatgagacaagtttacctatgtaacaaacctgctcatgcaaccctcaacttaaaataaaagtaaaaaaatgcagtataatcaaaagaataccctaaactctgtattacttattttttattttgtaataaggcaaaattgctatcatatttgacattctacctaccccagaaaatcctggtatttaatgaaaagtaaaaattaataactaaataaattccatttttggttcaaaaaataccaagcaagtttatgcattaacaaggctggatttctttataacctaagcaatttctcaaggtagacacgagagataaaacatttatgaagactagtaataaccaccattttctattttattcagacatacaggaatgtatgttctggcttaattacctatgggctctgtgtccttaggcaagttactttaattctctgaaccccagttttctaaaaaatagtgtatattatacttctctggtatgttgaaaagataaaatgagataaagatataaagcaacgggtgactggcacataaaactaccagtttcatttctacttccccttattcttttagctctacctaatatttcttcataaacatgtattgtaagacacatacacataacaaaacacattactatccttcttatttgaagatggtagagttgtcagaagcttggattttcaaatcaaacagatctactgtctaactctagcttctccacttagtaactctgagtcagttccttaacttttcgaacctgcagtttcctcatctataaatagaaatgataacagaacctgcctcttaaagttgttgttaaatgggacaagcaagtaaaagacactgactgttccaatagctggaagtacacaataaattattagctgttttgtacctattgctgttattcataatataattattattacaattcattagtattattccagatcaatgtttcctaacttcgggctgaggataaatgaacaacaattttttcaaattttattttagatttaggaggtacatgtgcatgtttgttacctgggtatattgcatgatgctgaagtttagggtatgaatgatcacgtcactcaggtattgagcgtagtacccaaaagttagtttttcaatccttgcccccattcctccttctgccctctagcactccccagtatctattgttgccatctttatgtccctgaataccagatgtttagctcttactcataagtgagaacatgcagtacttgcttttctgtttctatgttaatttgtttatgataatgacctctagccccaaccatgttgctacaaaggacataataatgtcactcatttttatggctatgcagtaatccatggtatatatgtaccacattttctctatctagcccaccattgatcagcaccgaggttgattctatgtcttttctattgtgaatagatgaagagaagagtacatatttctttttggtagaactatttgttttcttttggatgcataccctataataggattgctgggtctaatggtagttctgtcttgcgttcttggagaaattgccaaactgctttccgcagtggatgaattaatttacattcccaccaatagtgtataaacagtcccttttattcacagcctggttagcatctgttgctttttgacattttaataattgccattctaactggtatgagacagtatcttattgtggttttgatttacgtttctttaatgagcagtgacatggagcatatttttcaagtttcttggccgcttgtttatcttattttcagaagtgtctgttcctgtcttttgctcattttttaatggggttatttgtttttgcttgttgaattaaattctttaaagattctggctattaggcatttgttggatgcatagtttgcaaatattttctccaattctgtaggtcatctgtttactcttttgatagtttcttttgctgtgcaaaagtcctttatttaattaggtgccacttgccaatttttgcatttgttgcaattgcttttgaggacttagtaataaattagtttccaaggccaaaatccagaatgatgtttcctaggtttctttccagggttcttatagtttcaggtttacatttaatatttaatccatcttgatttcatttttgtatatggtgaaaggtaggggtccagcttcatccttctgcatatggctagcccactatcccaacaccatttattaaataaggagtcctttccccattgcttatttttgttcactttgttgagtatcagatggattaaacaacattttatgtgtttctttttatcagtttttttagagacttcctactcccccactcattgctagggtacaaaatagggaacataacttgatagcaaaagaaatattgttttggatgatggaattgtgtgaaaatgtgagtaactaatgaagaacaatctctccattaattggagaagtccttccttctaagcctgaatcacatgaggcagaccacatagaagactctttcgtagtcccttctccctttcagaaaaacatatgccaactctgattaatctaagaacaaaatggagtgctaggtttggagactgcctatccaggaataccaccaaaaatcatggtgcacaactgattccatgaagataccactgctgctatcactgagcacagataccacagcttgctactgatatcaacaatttggggatgggcacggtggctcatgcctgtactccccctacactttgggaggccgaggcaggcagatcacttgaggccaggagttcgagaccagcctgggcaacatgacaaaaccccatctctactaaaaatacaaaaattagccagatgtggtggtgcacgcctgtaatcccagctactctgtaggctgaggaaggagaactgcttgaaccttgggggcagaggttgcagtgagccaagttcacagcactgcacttcagcctgggtgacaaagtgagactctgtgaaaaaaaaaaaattggtaactagacactatcaatttaacaattgcctcaggaattagtttagatgatggggagctaaaaacaataattgctgttcccatactggagtcccatctggtcattttgaatgtttaggcctaattcttatgtcagttttgtctcatatcacttttcctttgacaatattgcccatcaccacccaatctccatgggctgggaatgtaactgaaaaatcccttcacttcttgattcacatcttactcttttttgtctctctactttctctactgtttttccatgtctaaatcactgaggcaaatgtaaataaatgcatttttcttgggaaagtgactgcaatgagcttgcccattaaacaaccctattatttttctctctctttaatgaagatggataaatattatactgtagcttaacaactttattagctatgtgaattatagccctttcactagaagtcaaggtaattatgtttaaaaaaaaaaaaaaaggagcaatgggtttaagggaactttggtaggaactagaggcaacacccaatattggcataagtaatccatggtacaaaatcacaaagcaccaaccaaagcaacacatttcacaggtggagggagtaggatgtgctaggctgctctgaactggagtgtgaaatagatattagtctcctggtgctgctgaatatgcacaagggaaaatgcaacttagagacaacactaagcaagccttttaatttgtcgtttagtacttcagcagtaggaaatacagtataactgctgggttgtagtgagtccatgctcctattactgacagagcttggccttcataactaaaaatatttaaaaccctccagaaaaccccagaatttcatgtactcctggtgcatcattctggactagaaagtcctcaactgtgcactggcttttcaagcgtatatattgacattcttattaagcgatgagttagagagtaagagggatgatttgattatgttcaaaagtagaattaacatccctcagcaaatcccagtacagcctcatgccacataatgacatttcagttaataatgggccacatatatgtaggtgatcccataagattataatggggttgaaaaattcctattacctactgacattgtagccattgtagcatggtactgcaaggtaatgctcatgttatacaactcatgtttgtggtaatgctggtaaaaacaaacctactgtgctgccagtcatataaaagtatagcacatacaattatgtacagtacatagtacttaatgatgataaacaactatgttactggtttatgagtttgctattctatactttttaccattatattagagtgtacctgttctacttataaaagaaaattaactgtaaaacagcttcaggcaggaccttcaggaagtattccagaagaagacattgttatcataggacatgaaaactccatgccctgaagatcttccagtgggataaggtgtggaggtgaaagacagtgatattgatgatcctgaccgtatgtaggccagggctaatgtatgtgtctttgtgtcttagtttttaacaaaaaaaaaaaaagttgaaaaagtgaaaagaaattaagaattaaaaatagaaaaatgcttaaaactaaggatataaagaaaatatttttgtacagctgtgcaatgtgtttgcattttaagctaagtgttgttacaaaagccaacaaattttaaaaaattaaaaatatgtaaaacaaaaacattacagtgagctaagtttaatttattattgaagaaagactgttataaatttagtgtagcataggtatacaacatttataaagtccacagcagtgtaatgtcctaggccttcatattcattcagcactcacacactgactcacctggaacaatttccagtcctgcaagcttcattcatgataagtgtcctataaaggtgtatcattctttattttttatactgtatttttactgtaacttttctaggtttagatatgtttagatatgcaaatattgaccattgtgttacaattgcctacagtactcagtacggaaatatgccataaatgtttgtagcataggaacaataggctatataccatatagcctaggagtttagtgggctataccatccagaattgtgtaagtacattctgtgaggttctcacaatgatgaaatggcctaacaatgcatttctcagtccctgtagttaagcgactgtactttaaggagctgctgaacaaaagggacacctggctgcatgttgagggctttttaattatgtgaaaggaaatgaagaggttgtgacctgctgttgggggaagaaggatataaaattttatttaggaggcacataatttgaagtcatgccatttgatttgattattaatttctgccattttggcctttactgagggaaacaaagtggcattttctactatttcttgttggttggttctttcatataatctctttcgctaagagtcctctagaaagtaataaagattgtagcacctaaaatgtttctactcatttgttacatagaaataaaataataaaccattttatgcaacaagctacaagagaaaaaaaaatgcatcattgagcaagatcatcagaatatcacaaagaaagcttggctttcccaggtggtagtcatttgtttctcttttaaaattaatagccaaacagtttagaaacttcgtcttccctacattcacagggtaacattggatattgtactgcagtgttaaaaagagggtttaccagatagtccaagacactagcgaaaggggagataagttttgatcagttataagagaaatagaggctttttttgttaaccgcaacctcttttacccctcatattcctctaaatattaattatcttttctgcatcttttcatttccattgctaaaatcttggtctacatttttattccaacaattctccatctccaatttctcctcattgaaattcattgttgtctaagaaatactactaaagttcaggacttattatgacattattatactcagaaatattcagtagttcttcattactaatttaacaaagttcacattccttagtcaaacctttgcatgatttcattttgactatctgtctattccctctcccagaggatgctacttttaattaattcaaactaaagtaattatttattccaataataatacattttattgtatagaaatttaggaggaagttctaaatctactctcatcgaagcctttcctaatgtaatcactactctttcttcactctaatagcattccatttgtaccatttatagcagttagcacattctgacttgaattagagttacttatttactgaaaagtgtgatttaaacatggctggtgataaataaatatttattagattaataaatgagtgaatgtactttcaaaggcctacctttagactaggtcaatggaagagacagtctatttctttaattgaaagagattctcttgtggtcagcagggtcactgaacaatgacaggttactttcccaggatcagacatcaagttgaaatattattaacttgtagcaatactgaatatgtgaaagaacttcaacattaaattgatgaaaataatagacatactaatcatatttgaagatacaggtatcactcatagtttctctattaatatagattaatagcatagcaaaatcaatattacaagggcttacagctgaagtagttctcatgatgcaaactacacaagatattcaaagttttttaaaatttaatatatgcataaatatccctagagttgacaacgttacagatacagagctgtcagttattctttcattttctggaaaatttcactttgaaaatctaaaactgagctataggagggcctttttaaagaatgtagctataatttttatttttgcttttaatctgttgttattcgcaaatagcttttcttttgcaactaatagtccttgtgggatatattccaacagggggaagaaagatcaaaagacatttgtgctaaaagaattgtaaacttgttttcagtgttcagtgcgtcttctccctaaaagtacaaattaccagacagtggtaacaaataactctgtgattctcaatccagttgaccaatagagatcacataacttctatttttttaactagtgcttactgtcatgcagaggttgaaatatgtgctcctcttcagagcaaagcaacattttctccttcagagaaaagttattttaatataatacatttatgatggcttcaaagtcataacctctgggattcaactattggccatgtattatgagttatttcttgcagtacacccaagcactcttcttcaaatttccatttttctgtcatcataacatttgctgaacactcatagaatgcataatgccatatgaagaaccaaaggggtagaaatgaaggcaaattaattctaccctaacctatttacttgataacatatctaagagaatacagtacctttgataaggatattaaaataggactttaatgcaatcccttctagttagcctattctcttgacccagaccgaatccctgccctcaaagatctctcttgctccccacaaaactgtgtctattaaagaaagacatattcttaaagaaataatatacacacttttccttaggtgagtgatcttactcacttccatatacaatgagtgccatgcattgtgccaaataatttttatggattctttcatttaatagttacaactctatgagacatttagtatttttcatcatattatacagataaggaaactgaatcacaaacagcttaaatttcccagggtcacacagctggtaaatggtctagaaatggattaagtccaagtttgttcagagcttgcactctcagccattatgtggcatcacctcccttcctaggagaaagctgtggttcgaagaaaatcagtctgagacactcattggctaaagtgctgcagagacctttgctaacagaatactagagagagattctgaaaactaaaccaatcaccaatcatggggtaaattctgagactaatggaaaatttgatagcataagcactaagttgaggatcctacctcaactcttcaagggctatactcttccttcaatttacatagtcatgtggttttcaggataaacatgcgcaagcaaaatataccccaaaggcaaccttgacatgcagtcaatttaagaaaaaaagaacaatttaacatttatctgaaacttttcttcttcaatactttccacaaaccattatctttggcacccatttcaacataattagataaacaattacgacaaaacaaaagcaataagagtagaaatggctcatggcttttattccagtacttcagaacatattacaagtatctattaatgctcaggtaatatgtatcagaaattgcaatgtaccaagaatgagaaattgcagtacgtcacgtactttgtaaaatctaaactgagatggagatttgatgtgattgcacatctggtgtttttctctagtgtatatgtttgggtgggcaggattgggcaaaaatgttatcattgatttgttctggaaagggaatattatgcttaagtgttggttagtatgtgtgtttatacatacctacagacaaatctatacatctctctaaagttctggtctctatctacagtatatcatgataaaaatgtttagctccaagtaaatgactgcaatgcaaaaaaataactacaaacatatactggcagtaaccgaatttgtgaaatcctctaacattattggatacagcctactacaataattatcccaaacttctgttacgcttaacagcttttatgagaacattaaaggaatgcaacaatgttgtgtttgcaggcatcatttcatgttccaaaggctaatctaaatcttgttttttaaagatttgtaaatattgcccatcgcaaagtgacttagagactatgagcactatgaaagcaattatgaaacaatacatttaattcatattaatacagagtttgacttgctgtttgtgaagactgaatgagataatgcattcgaataggcttgacacagtgcctaccacatgatgggaactcaaaaaattatgtttcctttcttacttcaagctatgagatgcagcctaggctattatcacccttctgaaagttaacgtggatgaaggacacatttctgttacttttctgggatagacagctcttaataagttactttatgtcactcctggcatatggtagataggtcctataatctcctgggtagtcttgatttgaggaaggggagggagtaactagctctgattttcagccacatttattcttcatcttagaaaccaaaagaaagtatacatagaccaatgaatctatgaaggcctggatttaaggtgaatgtcaggagggtaaatgaataacacaatggacttatgtatttgtgaaacaaaccaaatctctttcacgtgtgacaagtcactgcacagttaagcctttttggccttgttcaccataggtaaactggtcgttgttataggctatagtaaaacttactttagaggcaaattttatatcaatttctatttttggtactttatgaatgttccacagattatttacagtgttttaagctatttcttgaatataatatctggcttgtttttcttgcttttgggtccctgactagtattgacttttaacctcatctcaaactctattattttatttttcttatgttccaatactgtcaacatctctttgttctggctctagactctgttatgcctcttcacttctggtttatattcctatttctgggatacactaatgcctgaaggccagtgtgacatgaacttacctggataagatacaatacagattccaacacagtgtggatgagaaaagctgaagaattgggtctgatctatgaagtcggagtcttcctgattaaaaggaaagattgcaactcttggtataaaggactaatatccattgcttccatatcttctttgagtttctttattgatagatgtatcatgtctatcttacccaggctgaaaaaaaatgagaataatattagctataagtagtggagacactttaaaaagtagcaattcataatttcataaagaggaaaatagaagactcttgttttgcagcctataagatcttttctaatcttataatgtaagataagtaatgtcactgagccataaaatctcagtaggacagtttcatatcctatacacatgctgtgcatcttttctgcttgcagagttccatttcaagcaaactggaggtgctgacttaaaagcctgagcctgtgtgtttaatctacattgttgggattgtcactccagtggctggggtatgccctttttaaggaatttcctttaacctgaaaaaagattaattgacacaaatacaattttttctccaaagagagattgtttttcttcttaatcatgtgtttttgtatttgtttgtttgtttgtttttgacacagagtcacattctgtcacccaggctggagtacagtggtgcaaactcggtttactgcaacctctgtctcccaggctcaagcaattctcccaacccagacctgaaagtagctgggactaaaggtgcatgccaccacacccagccattttttgtattttttgtagagatggggtttcactatgttcacttactttttttcttcctcctcttagcaagcattaattaattgagggcctatgatgtgccaggcactgtgttaggtattaaaagtacagagaagagttaaaaataaatttgaagtctttgtggatagacacactggcataagtacttgaaaaacaaatacaactaagatggaggggtgcatcaggaaatggatgctgatcactatagcaaatataaagggaataaatgtaaagaaattgccagtttgtgcttagaattgaggtgaatcttgccccttggagaaagctctatgtcacgagtcctgaaagaataagaatgttgtatgggatataaaatccagttgaaatatactcatgagacagcaaattatgcaccaagagcattttgcaattaaaatcataaaatcctaaagttgaatttacctgtaatgattatataactctactaagtgatgaatagaattgtcttttctgattcagccaaggtttatccagagcctttttatgggaggctctttagttacaaatcttaaggataaaaaactcccacataaatgactcaaccaaagaattgttaaatattgagactcaatttgaacataatttagtcattcatttcaacaaacagtattatgctggagaagaagattataggaggcatttggtaggcactttgggagattcaaggagcttatattctattaggagagataagtcatatattacttagattgaaccacataactgctccttatgtgagtcaaaatggttgaatgttaatgatttcataaagttcaacttaatactaaaaggcaaatcacaaaggaaaaaacataactaatgtaaaagagatgcaaaaatactatcctaattgatcagataaaggagtaaatattgtcacctcgaaggcagaggtggcaaagtagtattttggatagcttttatagaatatgggtacaaattttatacacagaaacaaaaatgggtagaacagcaggaacaaatgtatagagttagtaaagtgcatcaagtttatagtaagcaacctgtagttcaactggaatgaggggcatagagatgaaggtaagccatgagatataacattagaatgagcaatggaagcaaaaccataaatagtcttgcacacaaaatgatgagtttttaattcagttcagtagataattaggagcctttgagggatttgttgtggcagggttgtaccaaatcagagctggatctcagaagcttaattgtcagtgatgcacacgatgtattaatagtgaatggaatgaaaagcaaagggaagtgtcaaatatcagagtaaaaatgattaagaagctggaaattgtagaagattcagccttctgatgaggaaccaagcatatgacagctgcttatccacagacattctgacaaattggtaagtatagttcgcctctgaaattgccagcattttcttttctgtctttttttttttttttttttttgagacggagttttgctcttgttgcccaggctggagtgcaatggcatgatctcggctcaccgcaacctccacctcccgggttcaagcaattctcctgcctcagccttcttagtagctggaattacaggaatgcaccaccatgtccggctaattttgtattttttttttagtagagacggcgtttctccatgttggtcaggctggtctcaaactcccgacctcaggttatcagcccgcctcggccttccaaagtgctggaattacaggcatgagccaccgtgcccggactcttttttgtcttcttttctcctatgtctgggcacttacttttctcctgtgcttgccaatttcttccattaaaattggttctcatgtaaaaattattctaataattcatttacaaaggggtataaatgagcactatagcttagtttgatactttttctgctcctcctccatccgtggctcatagctcaaaacaccaatctagttgatttggttacacagctgacagtggcaatttcctcggtagtagaagaaataggggattacactatatggctgttatttatccattgatgtcattaaagtattaactgcaatgtcattggatccatgaggagacttaccaggaaaaagagaataatacacagacagggttagagaattatcttagtagagaccctagacttcactttggtcaactatccattcaaacaatgattggattctaaaacattcctaacaggtggtcagcccgcctcagcttgaatatgctttgggatgaagaacactttaccatcataggcagccaatttcatctcaattataattattattactgatctttcttgtaagtctaaatttgcccttcgactcattggtccaaagactattctctagggtgacagaagaagtttactccctcttccaaagaatatcccactaaatatttgaaaagaggtatcatgcagccaccaaatcttctcttcctacaataaagatccaacttatttaaccctaaatagtataatttcaagttttcttattctggttactttcattttgaacatctcccagctaaccaatccaagactcctgagttttatctaaaaatcaaagggcacaaaggtcaattgctctcaaatcatttataaacatgtattctggggctgtaataaaaaggcttgctctacttttaacaagaatatacttttatagttgctttatccataatagcaaaaaactggaaacaacccaaatgtccatcagtaagacaatttaaaaaatggtatattcatacaaggaatactattcaccagtaaaaagtagcaaactcttcatatatgcaacaatatcaggttaatctcaaaagcattatgttaagcaataggatttggacacaaaagagtatttaatgtttgcttatattcatattaagttcaggaacaagcaaaaccatagatggtgacagaaattaaaatagcagttgcttaggtgaaaataattaattggaaagaacaagagggagctttctcaggtgatgaatatattttatattttgaacagagtcagtaattacttggatgtacacatttttcaaaagtgatgcattttattacatgtaagttttacttcattaaagcaatattaaaatgcattaacttgtacacacatttgtctgttttaatatttaggttatcctcaaaacacttaaaagaaaatttgagatttcttgttttaaaaattttcatagtgacttttatttttctattttttaacaatttcaatttttattttagattcaggagtacaggtgcaggtgtgccacgtgagtacattgtgtgatgatgagatttggcctatcaatgattccatcaccgaggtagtgagtataatacccaagagttagtttttcaattgttttcgccttcccttccttctccctctaatagttcctagtacctattgttgctgtctttatgttcatgagttcttaatgtttaactgtcacttatgagtgagcatatgagttttttggttttctgtttctgtgttaatttgcttaggataatgtcctccagctccacccatgttgctgcaaaggacatgatttcattcctttgtattgctgtgtagtattccatggtgtatatgtgtcacattttctttatccgatacaccactgattagcacttaggttaattatatgtctttgctattgtgaatagtgctgcagtgaacatacgagtgcaagtgtctttttagtagaatgatttgttttcttttggataaataaccagtaatgagactgctgtgtcaaattgtaggtctgtattacattctttgagatatctccaaactattacacagctttacacagtgtttgaactaatttacattcccacaaacagtgtataagcattcccttttctctgcagcctggccagcatctgttgttttttgactttttaataatagccattctgactggggtgagatggtatcttattatgcttttgatttacatttctctgatgattagtgatgtggagcattttatttcacacatttgatggcctcttatctgtcttcttttgagaagtgaaagatctctacaagaagaactataaagctctgctgaaagaaataatatatgacccaaacaaaaatgcaaaacattccgtgcttatgaattggaagaatcaatgttaaattaaattaaaagggccctactgcccaaagcaatctacagtttcagcactatttctaccaaactaccaatgtcactttttaaagaactagaaaaagctattctaaaattcatatggaaccaggaaagtgccttaagagtcaaagccatcctaaacaaaaagaacaaagccagaggcatcacattacctgacttcaaactatactataaggctacagtaaccaaaacagcgtgatattggtacaaaaatgaaaatgtagaccaatggaacaggacagaaaactcagaaataaagcctcatgcctacagccaactgatctttgacaaagctgacacaaataagcaatgaggaaagaactccctataaataaatggtactgagataactgactagccatatgcagaagaaagaaactggacccctacttttcaccatatacaaaaattaactcaagatggaataaagatttaaatataagacctcaaactataagaatcctagaaaaaaaacctaagaaacatcattctgaacatcagtattgggaaataatttataataagtcctcaaaagcaattgcaatgaaaacaaaaattgacaaacaggacttaattaaattaaagagattctgcacagtaaaggaaactatcaacagcaaacaaaacctagagaattggagaaaatattcacaaactatgcaactaataaagatctaatattcagggcctataaggaacttaaacaattcaacaatcaaaaataaaaaaccttattaaaaagtgggccaaagacttgctctattttttatgtttggccactgagaacttttagatccccactcctctgtcttgcctccccaacaacctagataagaagactcactcagcctctgcatgacaggaggaattttagatagcacaacctctatctgagcattaggagtctcccacaccagcttcacaccttaataacaaaagaattcagaaggcacctccaattcactacctttgcttgcattctcattgcacctctgagttagcccttccacttcagcttgttgtgactactaaatgtattttattgaaattcatagttgagtgtgttgttccatttgcctcaacatataaatattcctgggtgggtgtgtgatcatgcccacttctgggtagactaatgaaaactgaagagttcagattttcatttttgaaaactccagcatatcttgccacattctaattttagtgaagacagcttccattagatgcagacaattcatgcacccccttacagctctaatatgtcttgctgctagttttctcatcctcattatgtatgtactatgcattttcttcatctggcctggtgacttgtagtatccaaccatttttgtattacatctatccttttccttttgccttcgttcagctgatagctatgagtatcctatactcaggttcatatatttcaatatgtattccaatccagcttttccttattcatattccttacattcctttgaattttctatcactctaccaaaaataagccccaatatacctttcacagattctgtagatgctcctcagagacaagattcaggaggcatagtctggaaagagaaaccggctcctaaataatgaattttttttttctcaaaatgtgaaaatttgtctttcctaacatttagtcattcctgtttctgcattgcaatgctattttggtctgggtcttgtgaatgggtgttcagactgtcattttaatttagcaccatcattgctatagagcagctgtccagaattcatatttctaaaggatttttttaaaaacaactatttctaaatagatagaagttctgcatgctacgatgacaacaaaaatctctgtgtgcttgtacaagttttctcctttggatttctgtattttcaaatgtttataatacttttcaggttcaaaatagttttatgcaatggtttgctttacatacacctacacacaaatacatatccatgcacataagattcttctcaccattatctaccttcagcatggaccagacataaaaacattgaaaacaacatcctgtagcatcacttaggctgtagggctgccagatgcggtggcacatgcctgtaatgccaggacattgggacaccaaggtgagaggatcacttgagcctcatacatatggaggtcaagataagcctgggcaacatagtgagacaccatctctacaaaaaaataattttaaaaatcagctgggtgatatagtttgaatatttgtccctgcccaaatctcatgttgaaatgtaatccccagagttggagatggagcctagcaagaggtattttgatcatgggggtggatatctcatgaatggcttgggccatcctcttgatgataagtgagctcttgctctgagtttatacaagaactggtcatttaaaagtgtgtggcacctccctctccactttcttgcttctgttctggccatgtgatatgcttgcttcccacatgccttccaccataattgtaagcttcctgacgcctccccagattccaagccaatgccagcacgatgtttcctataaagcctgcagaaccttaagccaatttatcctcttttctttataaattacccagtcacaggtattccttttaatatggtttggctgtgtccccacccaaatctcaacttgaattgtacctccgaaaattaccacatgttggatgagggacccaaggggacataattgcatcatgggggctggcctttcctgtgctattcttgtgatagtgaattaagtctcacaagatctcatgggtttatcaggggcttctgcttttgctttttcctcatttttctcttgccactgccatgtaagaagtgcctttcgccccccgccatgattctgagtgtcacgcacgtctgtgtgaagagaccaccaaacaggctttgtgtgagcaataaagctttttaatcacctgggtgcaggcgggctgagtctgaaaagagagtcagtgaagggagataggggtggggccattttataggatttgggtaggtattggaaaactacagtcaaaggaggttattctctggcaggcaggggcgagggtcacaaggtgctcagtggggaagcttctgagccaggagaaggaatttcacaaggtaatgtcatcagttaaggcaggaaccagccattttcccttcttttgtgattcttcagttacttcaggccatctggatgtatacatgcaggcttgggctcagaggcctgacactgaggcctccccagccatgtggaactataagtccagttaaacctctttttcttcccagtcttgtgtatgtctttatcgcagtgtgaaaatggactaatacacctttacagcagtgcaagaacagcctaatatagaaaattggtactgaggagtagggaattgcagtaaaggtacctgatgatgtgaaggcaactttggaactgggtaatgagcagaggttggtggactcagaagaacacaggaagatgaagttaagttcagaacttcttagagactggttcaatggtagtgaccaaaatgctgatagtgatatcaacagtgaagtccaggctgccaagctctcagatggaaatgagtaacttattgggaattggagcaaagctcacatgtgttatagctgcattctgttcatgccctagggatctgtggaagtttgaactccatagtaataatttagggtatctggcagaaaaaatttctaagcagcaaagtgttcaagatatggcttgcctgcttttaagaatctatgctcagatgcaagagcaaaggaatgacttaaactttgaacttatatttaaaagggaagcagagtataaaagtttggagaatttgcagtccggccatgtggcagaataagagaaaaacttttttgaagaggaattaaagcaagctccccagcaaccacttgccagatatatttgtgtaactaaaagggagccaagtactaatatccaagacaatgggaaagacctcaaggcattttagagactgttgagacagcccctcccattacaggaccagaggcctaggagggaaataaggtttcatgggccaggcccagggcctaactgtcctgtgcagccttgggacactgcttaccacatcccagctgctctggctccagcctcagatcaaagggcctcagatactgctcatggtccctgaatttataagtccatgaattaaaaatattctgtgggaaatgagggttgcagatcccaatccatggcctctactttgcatctgattgaatacatgaaatctcaaaaaatgtaatctgtttcctcagggagttctctgactagatttgtgatcatcttcaagtcctatgtggttaacagtcaccaagatatattatttgtggaccctacaaggttaatccatggatcaactgacaaaattgggagaagagagcccatctatttcctagatagcaaatgtgtggatgctttgaaccatactcactttgaggtagccacaattcaattatcttctaaagcctaaaactctgtgtctttcataagtactatcttaccgtatgatgaacagaaaacaccaacattttaaatcacaaatatttattaatgccttccatgtgtgtaaaatatggtaaaaggcaatgcaatccatataataagttttgccttagaagtcacacttcaagaatgtgttccataataacctgcgaatcttttaagctttttctattatccttgttgatgtcagatagatgtactagatcaagtaacgttaaaggcttcagaggtgactgctaaaaattttcttctaatccaaaagggaatccctgtctaaaaatgagtttggaaagcctcacttataataaaaacaagtttatagaagtgacactgagatcatcccacatcgctaagtagatttattggaggggagagaacttgtgctgctttctaattccccaaaacatgctctggctgatgtacttaaaattagaattgattcaaatattgctgtgatcacataatgtcaaaaggcataaaaatattactaaggccctccttccctgttctctgtcagcccaaacaaattcccagcctccatatcaatttatgctgcatccattatctcttacattagaagataccaaacagaaaaaaaggaaaaacatatctattagactcagcccagctggactgaacttccaacatctttccttatattttgtttaaaaatgacatttgagaatgcagaaaatcatttcaggcagttcaatcctttctttatttgtccatttatttatttgttcaattatgcatgtactgtccatcaaaactttgttgaatgtcttctatttgtctgactctatgctaagtactaaaaatacaaagaaaatttttttaaaaatgtaagcactgctcaggcaacttcagacctcctgtacttagtatttaatatgtgtatctgcctgtacccaatcaggttattggcaatgcatattttaatgagacttatactcaacatagtataaactctgaaagataccaggtttttaatacagccaattcctctttgctgatgttgacaaactaagattgacttttaatgtacatttcaatatacgatacgtagaaaagccattggggaaatatatagtcttaactgcttagctgaaagttaccatcatgtctataagaaatcattatagtcagacatttctatctcatacatggttaaatgtctaggaataattttacacaaatctatagtttttctcagaaggaatttatatgtatagttgttagtttcattataattattactattatcaaggactctcaggagggaatctaaaagttttggctgccacacattaagcacagccacttcctttagccctcatatcagctgagttcacaatgttaatgtggtaaagtttctgtggtagtaggacagttattctaccggaatatttcatggtgccagtctaagaatggcagctgaaggactcagtaggttagttgggtattttttccccgtcactctcaggccctaagggcttgactgaatgattgcatcattctaagtaatgaagtccctggagaacctgtagaaggcagcatttgaagatttaaggtttcactgctcaagatgtgactggattgctgacacagaaaactgattttaggccactgaccttctggcttggtgagtacaggaataaaaacgtggaaggctaacaagatctacgtgtgttctgggtgcagtcaactcctagtaaccaacattttaattttgacttttaactccactgcatccaaataaatgatgtgtaagtgattacataaagttatagcatattttctcctcactattcacttggcaatgctatagttatatcttcactatggacagcaacatgatatctgtttacttacattcctagaaggatatcggtagcttattatttacacatgataccggcatgttacctgaaatccatgggcagaattacaattttactagaataatttcggatggcataaaaatttttctctgtgttctctaaaactgaaccatggttgtataacctttgttttatttctaggacccaaacagttcctgtggtacttctctttcttccttctcactagtgacagttgtagtatctcataggaccgtttttccaaaagacaaatgttaacacatcatttccccatttctctccctacagcctaggtttctcattgccctctggataaagtcaaattttttaacatggcatgcaaggcccaaaacattacaattcctatctttggaagtgtattttaggcctctctgtatcttgctttctccactcaggccatagtgatctttgtatggtttttggaatatatcatgctttttccagccacatgaactgtgaacattctgttctctttacttggaacttccacaacattctcctgattaactcttgctcacttttcatgagtgacatcatttcatgatgaaaatcttcctgagccctcagataggtagtcttcctttttatatggtttctttagacccagtacttacaagtatagacccagtacttataataactttgtgcccttgaactcactttataaaatatttaaaacaatttgctcaatgtctactttataagactaaaagcttcataatatcagggaatatacatttttggtaaacaagtgaatctccaacgcctagcacaatgtctgatatcattttaattggtctatttcatataaataccataggactccaaaaatgaactacatatttatttaaatccaagtcaatgtcagccctgccccatgccaccacacagcagcaactacatatatcacgtcacatatctatgtgtacgaaatatctaaggaaaacttatataaaataatattctatgtagctgttttataaatttaagacttttagtctcagaaaagtgagaagaaataaaatgtaatgagactctgtgtactgtagtggttaagagtgtagattcaagaaccacacaatctgagtttgaatcatagttctgtcatttacttgctgcataaactaaggaagggtacttaatattgttacacctccctttggctgtaaagcactcaataatagtacctatcttatacattgcctatgatgatcaaataaggtctattatttggcaagaggcagatgctctctaagttgcttttatcacatttttagtatcacccaatttggcattttgtcgttattattttatggttgttttgtaggttttatttctgtttttatgttttggagtgggttggagtagtcctcatggaccaataaatcagctaatgatgtatacacaaataagtcattctgaaagttgtcaaaaacaaggttgtgggaattccagaaaaacggagaactaattgtaacgtgttatttcacatggaaacataaataatctgaaatatctcaagaaattaatgacaagatttaagaagataaaaaattaagagattttacaaactgcagtacagcattaatggctaaattgatctccaacttaaagacttgaggcttaacatatatacattcaaaacaaaatgacagatacaaattaaataacataaatggaatgataatcagagacatttcaggaaaagttttatgtttgcatagcaataaggtaattatgcctagttacaccatcaaaacattattaacacaaatggaagaaaaccaaatgataaagagaaatacaagagccttggtcacagtctagacatagtttcaattaactatgttattaatgggaatgagctaaaagtaaccaataccttactctcaaccacctgaaacagaccattggagatctcacacacacacacacacacacacacacacagagagaaagaaatttgactcacctttattatttcacctaactctggggcagaagtactaaactgaccagaaatgcaggtggttattttccagttgtatggaaagtatattttaagctaatcagagctagagttcacttgtgccatgccccagttagtttctactttcattcagaacccgcatatacaggaatgttgtttggggaagtacaggagaaatggattaacgtaagtgcatactggaatgtgattacaaggagaatattgtaaacaaggaagaagattggaagaacactgggagactttgtattgtggatgaagatttgcaaacactgttcaatttaaaatgacatcttattctcaagtttagtaaaaaaaaaatgagagctgtaactagatattatccaaatttatttgaatatgatccaaataaataaataaattgcaaattgatctatggcctgagtgaactgaatttcttgtctagctgtgaaatgagaaagatgccagcccctaaatagacagtaaaggaaattagagaaaccacatttatcgtatcttctaataaacatcatgcttagattcacatctactgaaccaagcttgaatttttaaaaactgatatggcgcttctgaaaagatctggaagcaagagagaaaggaaactttaccataataactcagaagaaaacatagatctcgaaatattatttttgtgataagaagtgcatgaatgttttagaatatatatgcttattatcctcagtggtagacaataaaatagagtttcttagagagatttaagaagagaatagatcaacattaaagtagaaaggcaaagaaatttgactaaaatagtaaaataatacagggaagtgcaaattataataggaattttaaaattcgtattataggtagcaaatagatgcaatatgaacagaatagacacaggataaaatcaaatcagtaacatgaagaacattcctcatacaagaagcgagaagacattgacacaataccttgagcagtaattctaaatatcttggggattgtggtcatgtttcggaagttaataaaataactttggctattcaggctcttttttggttgcatatgaatttcaaaatagttttctgtagttctgtgaagaatgccaatagtagtttgttgggaatagcattgaatctataaattcctttgggcactatggccgttctaacaatgttgattcttcctatccatgagcatgaaatgtttttccatttgtttgtattatctctgatttctttgagcagtggtttgtagatctcattgtagagatctttcaccttcattattagccatcttcctaggtatttttttcttttttctggcaattatgatgggagtttgttcatgatttggtccttggcttgagtattgttggtatgtaggaatgttaacaatttttgaacattgattttgtatcctgagattttgctgaagttgtttatcagcttaagaagtttgtggctaatacatatgtgtatatatatattgtatattcatgtcatccagaaaaaaacaaagcttgacttcctctcttatttaaatgtccttcctctcttatttaaatgtcttttttttttctcttgcctgattgccctggccagaactttcaatattatgttgaataggagtggtaacagagggcattcttgtcttgtgttggttttcaggaaaaatgcttccagcttttccccattcggtatgatgttggctgtgggtttgtcacgtatggctcttattattttgaggtatgttccttcagtacccagtttattgagagtttttaacatggagggatgttgaattttttgaaagctttttctgcatctattcagatgataataatgtgtttttttctttatttctgtttctatgatgaatcatatttcctgatttgcatatgttgaaccaaccttgcatcttggggactaggccctcttgattgtggtgggtaagctttttgacgtgctgctggatttagtttgccagtattatgttgaggatttttgcatcgatcttcatcaaggtattagcctgaagtgttgttgttgttgttgttgttgttgttgttgttgtttgttgtatctctgccaggttttggtatcaggctgatgctggcttcatagaatgagttagggaggaatcctcctcctcgattttttggaattgtttcagtaggaatggtaccagctgttctttatacagctggtagaattcagttgtgaatccatctggtcctgggatttttttggttgataggctatttattactgcctcaatttcacaactcgttattggtgtgttcagaaattcaatttcttcctggttcaatcttgggagggtgtatgtgtccaggaatttatccgtttcttttcctaatctttaaaaatttgtactgatattattctcattggaagatgtggcactgaacagataaaaataaaaaacaacagttatgaatcaccaacgccatctctcccctgtacctggcagcagtggcagcacggtgcagagagcatatccgggtgctgggggagggagagcacagcaattgtgatgcaatgaattcagcactgtcctgttagagcagaaaaatcaactggaccaaattcagctgatgctcacccatggagtaaacacttaaaccagccctcgcctgaggggaattactgatcccagtcatctgaacttgggtgcctgccaaccttgccaccaagggctatggcactatgtgcctaaaagtaaaatataaaggcagtctaaaccataaggactgcaagtcttaggtgattcctagtactcaagtaggtgcagagatagtggaatatgggagcacatgacataatgagacaccagctagggtattcaagggagcactggcatcacccctctcctaagcccaggctgcacaaatcacagctccaaaagacaccccttccttctgctccaggaggagagagggaagaatggggaagaatgtggttcacctctaggatcccagcccagccacagcaagatagggcactggtcaactgtgaggtccccattccaagccctagctcccagatgaaatttctagaaacatcctgggccagaagaaaaactgatgccttttaagaacgaacccagtcctggcagcattcatcacctgctaactgaagagagctttgtccctgaataaacagcagtgatatataggtattacaccgaggcccttaggtgaatctctgagactcgctggattcaggtgagacttgggatatttccaactgtggtagctacaaggcaaaactccttcagactgaggaaagcagagagaaaagcaaaagggactttgtcttgtatcttaggtaccagcacagccacagggtgataaagaaccaagtgggatctttgggtccctgattctaaaacttgactcttggatggtgatatggtttggctgtggacccaccaaaatctcatcttgacttgtagttcccataatccccacatgttgtgggagagacctagagggaggtaattgaatcatgggggcagttacccccatgctgctgttcttgtgatagtgagtgagttcttatgtgatctgatggttttattaggggcttttccctctgtgcttggcacttcgtcctgccataatatgaaggacataattgctcccccttctgccatgattgtaagtttccaaggcctcccccagacatgcagaactgtgagtcaattaaacttctttcctttataaatcacctagtcttgaacagttctttataacagcatgagaatggactaatacagtaaattggtactggctagtggggtgctgctgtacagatatgcaaaaatttggaagccactttgaaactgagtaacaggaaaagtttggaacagtttggagggctaagaagacaggaagatgtggaacagtttagaacttcctagagacttcttgaatggctttgaccaaaatgctgatggtaatatggacaatgaattccaggttgaggtggtatcagatggagatgagaaacttgttggaactggaataaaggtgactctggctatgttttagcaaggagactagcagcattttcccctgccctagagatctgtggaactttgaacttgagagagatgatttagggtatctggcagaataaatttctaggaagcaaagaattcaagaggtgacttgggtgctgctaaaagcattcagttttatgtattcacaaagatatggtttggaattggaacttatgtttaaaagggaagcagagcattcaagtttggaaaatttgcagcctgatgatgtgatagaaaagaaaaatccattttctggggaaaaatttaagccttctgcagaaatttgcatatgtaatgaggagctgaatgttaatcaccaagacaatggtgaaaatgtcattagggcatgtcagagaccttctcagcagctccacccattacaggccaggaggtctactaaggaaaaatggtttcctgggctggattcacagacccctgctgcatgcagccttgggacatggtgccctgcatcccagctgcttcagctctaaccatgtctaaaaggggccaatatacagctcagactgttacttcagagggtgcaagccccaagccttggaagattccatgtggtgttgagcctgtgggtgcaccgaagtcaggagttgaggtttgggaacttccgcatagatttcagaggatgtatggaaacccctggatgtccaggcagatgtttgctgcaggggcagagccttctgctagggcagtgcagaaggaaaatgtgggactgaagcccccacacagagtccccagtggggcactgcctaatggtgcgagaacagtgccaccatcctccaggccccagaatggtaaattcactgacaatttgcatgatgtacctggaaaagccacaaacactcaacaccaccctgttaaagcagctaggagggggactgtaccctgcaaagctacagaggctatgggaggccacctcttacatcagtgtgacatggatgtgagacatggagtcaaaggatattattttggaactttaacgtttaatgactgccctacttgattttggattttcatggggcctgtaacccctttattttggccaacttctaccatttggaacaggtgtatttacccaatgcctgtacccccattgtatctaacaagtaactaccttgcttttgattttacaggctcacaggcagaaaggacttgttttgtctcagatgagactttggacttggacttttgggttaatgatggaatgagttagttaagactttgggggactgttgggaatgcatgattgtgttttgaaactgaaaagggtatgagatttgggagcaggcaggggaaaagtgatagggtttggctgtgtgtatccacccaaatctaatgctgaatggtattttccaatgctagttggggggagctggtgggaggtgattggattatggcagtagatttctccatgctgttctcatgatagtgagtaagttatcacaagatctgatgttttacaagtgtgtagcacttctccctctctctcctgctaccatgtaaagaagatgctaaatgtcctgaggcctcccagtcatgcttcctgttaagcctgcagaactgtgagtcaattagacctcttttcttcacaaattgctagaatgagtcaggactttaggggactgttggaagggcatgattgtgtttcgaattgtgaggacataagatttgggtgtggccaggagcagaataatgtgggttagctgtgtccctacccaaatctcatcttgagtggtagttcccataatccccatgtgtcatgtgaaggtgccaataggaggtaattgaatcatggggaaggttacctcatgctgctgttctcatgatagtgaatgaggtctcatgagatctgatggttttataaaaggcttttccctctttgcctggcaattctccttcctggatcatgtgaagaaaggtgtgtttgcttcccctctgccatgattgtaagtttcctttggcctccctgccatgtggaactgtgagtctattaaacctctttcctttataaattacccagtcccaatcagttgtttatagcaatggggaataaactaatacagacggcgttttggaactgccccaggccagagacaagtccactgccttgaagggcgagtcccaggccaagcagaattcatgacaagctgactgaagagaccttgagccttacgtgaacatcagtggtattctggcagtacaacttgtggcctgaggtggtggtggctatgggatgagttgtctctacctttggaaaggggaaagaatagaaggaagtgctgcattgtgtggtttgagtgccagttaagccgcaacacaatagaacaccaggtaaacttctaagatttttttactctagtccctgacacctggacagcacttttggacccccccaccaaggacttggagaaccttgccaccatgaagggtagaacacaggcctggctggctctgccatgaactgattgtagagcagcagggcctttaatgaacataggcagtacccagagagtggttacagcaggccttggggtagacccagttctgcggtggcttctggtctgactcagtgcagtcctagttgtgtgggacacagaagtgctcgtgtcacactacccccagcttttggtgactgaggacatagagagacactgtacatttgggagaaagtaaagaatgagaacaagagtctttccctggtaatccagataattctcccgggtcatattcaggaccatcatggtggtacctttatgagtctgtaaaaatcacaatgttaccatttttgaggtgctccctaaaatacataaactttagatcacaacatccaagtccttttaaatatctgaaaagccttcacaaggaagatggtgacaaataagcccatggagtgaagactacaataaatactgaattcttcaatgcctagacactgaagaacatatactagcattaacactatccaggaaaacattacctcattaaatgaaccaaataagacacaaggaactaattctggagaaacagagatacgtgacctttcagacagagaattcaaaatagctgtgttgaggaaactcaaagaaattcaatataacaaatagaaggaattcagaattctatcagataaatttaacacagagattaaaataattaaatagaatcaagcaagaattctggatctgaaaactgcaattggctaatggaagaatggatcagagttctctaacagcagaactgatcaagaagaagaaagagtgagcttgaaggcaagctatttgaaaatacacagtcagaaaagaaaaaagcataacatacaatgaagcatgcctagaggatcaaaaaataacctaaaaatagcaaatctaagagttattggacttaaagggaacatagagaaaaaactagggtagaaagtttattcaaagggaaaatggcagagaactccaaaacttcaaaaaagacatcaatatacaagtgcaagaaggttatagaacaccaagcagatttaacccaaagattactgcttcaaggtatttaataatcaaactcccaaaggtcaaggaaaaagaaagaatcctaaaagcagcaagagaaaagaaacaaataacatgcaatggatctccaatatgtctggcagcagacttttcagtggaaaccttacagtcaagaagtgagtggcatgagatatttaaagtgctgaaggaaaaaaagtaaccccagaatagtatatgtagtgaaaatatccttcaaacatgaaggagaaatacagactttcctagacacaccaaagctgaataatttcatcaataccagatctggcctacaaaaaatactagaaatactgaagggagtatttcaagcagatagagaaggacattattgagcaataaataatcacacgaagatacaaaacttactggtaatagtaagtacacagaaaaacacagaatgtgtttcaataataataatatataataataacactgtaactgtggtgtataaactactcttatcctaagtaaaaagactaaataatgaaccaataaaaaataatcacctcaacaagttttcaagatttagtcagtatgataagatagaaagaacaaacagttaacaattggggtggaatgaagttaaagcatacattttttaaaatttctttttatttgttttatggtgcaaagtgctaatgttttattagattaaattaatcttataagatagtatttgcaaacctcatggtaacctctaaccaaaaaacatacaacgaatacagaaaaataaaaagtaagaaactaaatgatgtcaccagagaaaatcaccttcactaaacaaagacaagaaagaaaaaaaggaagagaagatcacaaaaaaaacccagaaaacaaataaaaatggcaaatgaaagtccttatttatcaataataacattgaatgtaaatggactaaactctccaatcaaaagacatagagaagctgaatgaatgaagaaagagccatggatttgttgcctttaagaaacacacttcacctataaagacacacatggactgaaaataaagagatgaaaatagatattgcattgcaattgaattcagaaaaaaaaagcaagattcactgtgcttagacaaaatagatttcaaagcaaaaactataagacgctacaaagaaggtcactgtataatgataaaggggtcaattcagaaagatatcacaattttaaatatatatgcacccaacaatggagcacccagatatataaaggaaatattattagagctaaagtaagagataggccctggtacaataatagctggagacttcaacatcccactttcagcattggaaatatcttccagacagaaaatcaacaaagaaaaatcaaacttaatctgtaccacagaccaaatggatctaataaatatttatagaacattttatccaacagctgtagaattcacattcttttgctcaggacttggattattctcaaggatagaccatatgttaggtcacaaaaagaatcttcaaacattcaaataaattaaaataacagcaagcatcttctctgaccacaatggaataagaataaaaattaatatgaagaagaattttggaaactttaaaaatgcatgcaaattaaacaatatcctccagaataatcagtgggtcaatgaaaaaattaagaaggaaattgcaaagtttcttgaaaaaaatgataatggaaacacaacatatctaaacctatgggatacagcaaaagcagtaatcagagtgaagtttatagccataagtgtctaaattacaaaaaggaaaaacttcaaataatctaatgacgcatctttaaaaactacaatggtaagatcaaaccaagcccaaaataagtagaagaaataatgaagatcagagaagaaataaataaaattgaaataaaaaatacaaaagatcaataaaacaaaaagttgagtgttttttttttttttgaaaagttcaacaaaactgacaaaccgttagccagactaaggaataaggagaggatccaaataaataacatctgaaatgaaaaggagtcaatacaactgaaagtgcagaaattcaaaggatcatttgtggttactaagaacaattatgtgctaataaattgcaaaatctagaagaaatcgactaattctgagatacataaaacctaccaagattgattcaggaagaaatgcataacctgaacagatcaatgagaagtaacaggatcaaagccataataaaatgtcttcaaataaagaaaaactaaagatccaatggattcattgccgaattttaccaaacatttaaagaagaactaacaccagttatactcaaaatagttcaaaaaattgaagaggagagaatactttcaaacttattctacaaggccagtattactctgataccaaaaccagacaaggacacatataaagaaaactactggccaacatttctgatgaatattcatgaaaacattctcaacaaaatactagcaagccaaattcaacaatacattagaaagataattcatgaccaggtggcatttatccctgggatgcaagtatggtacaacattcacaaagcaatcaatgtgatacatcatatcaacagaattaagggtaaaaaccacatcatcttataaattgatgctgaaaatacatttgataaatttcaacatgtctttatgataaaaatcctcaaaaaatgggcttagagggaacataccttaacacaataaaactgatatacaacagacacacagctcctatcatactgaatggggaaaaactgagtttcctctaaaatatagaacacaacaaggctacccactgtcaccaatgttcgacatagtactggaagtcctagatagagcaatcagacaagagaaatacaaaaagttcatccaaattggaaagaaagaattcaaattgtctctgttagctgatgatatgatcttatattcagaaacatcaaagattccacaagaaaatgatagaagtaatcaacaaatttagtaaagtttcaggatacaaaatcaaaatacaaaaatcagtagcatttctataagtcaacagtgaataatctgaaaaataaatttaaaaagtaatcccatttacaataaccacaaatgtaatcaaatgctttagaatttaccaaagaagaaaagatatctataatgaaaattataaacaatgatggaagaaactgaagaggacaccaaaagatggaaaaacatttcatgttcatggattggaagaatctatattattaaaatgtccatactacacaaagcaattcacagattaaatgcaattcttattaatacgtcaaatgacattcttcacagaaattaaaaaaaaaactatcctaaaatttatatggaataacaagagatccagaataggcaaagctatcctaagcaaaaaaagaacaatacgggataaatcatactacatgacttcaaattatactacagagctatagtaaccaatgcagcatgatactggcataaaaacagacacatagatcaatagaacagaatagagaacccagaaacaaatccgtacaactacagtgaatttatttttaccaaagttgccaagaccacacactgggaaaaagacagtctcttcaataaatggtgctgcaaaacccggatatccataggcaaaaaaataaaattaggtctctatgtgttgccatatacaaaaatcaaatcaaaatggacgaaacacttaaatctaagacatcacactataaaattactacaagaaaacattgaagaaactgtcaaggacattggagtgggcaaagatttcttgagtaataactcataaccataggcaaccaaagcaaatatggacaaatgggatcacatcgagctaaaaagcttctgcacagcaaatgaaacaatcaataagtgaagagataacagacagaatgagagaaaattcttacaaaccacctctctgacaaggaattaataaccagaatatataaggagctcaaccaactctgtaggaaaaaaatctaataatttgatcaaaaatgggcaaaatatttgaatagaattttctcaaaagaagacatacgaatggcaaataggcatattaaaacattctcaacatcattggtcagaggaatacaaatcaaaactacaatgagatttaactttacccccactaaaatggctcatatctaaaagataataacaaatgctggaaagaatgtggagaaaagggaacccttgtacactgtttgtgagaatgtaaattaatacaaccactatggagtttggaggtaactcaaaaaactaaaaactgagctaccatatgatccagtaatcccactgctgggtatataccccagagaaaataaatttgtatattgaagaggtatctccactcctacatttgctgtagcactgtttacaataactaagatttggaagcaacctaagtgcccatcaacagaagaatagataaagaaaatatggtacatatacacaatggagtactattcagctataaaaaagatgaaatccatccatttacaacaacatggatgaaactggagatcataacattaagttaaataagccaggcacagaaagaaaaacatggcatgttctcacttatttgtgggatctaaaaatcaaagcaattgaactcatgaatgtagtgagtagaaggatggtcactggaggctatgaagggtattgggaaacttgggaggaactggggatgattaatggttacaaaaaaatagaaagaataaatatgacctactatttgatagcacaaaagggtggctaaagtcaataaaaacttaattgtacattttaaaatagcttaaagtatgtaattggatttttttgtaactttgtaactcagtggataatttttcaggggatggaaataatgagtaagtatatgtcataaaactggttattccagaacaaatttgtaaattcctagcaacatataacctatcaagactgaatcatgaagaaatagaaaatccaaaaagacctatatatagtacggagattgaatcaataaccaaaaacctcccaataaataaaagccaggacaagatggattcattagtaaaatttattaaacatttaaataattagcactaatcctcaaactttttcaaaaaattctagaggaggtaacacttccaaaattgttttctgaggtattaccctgatactaaagccaggaaatggcaatacaataaaaaagttacaatccaatatgcctgatgaggaaacatgaatgcaaaatttatcaacaaaatactagaacattgaattcatctctacataaaaaaattatataccatgatcatgtgagacttattcctcagatccaaggatggttcaacatataaaattatgttttatatgttgtgatacaccacaacatgtgtggtataccacatcaacaggataaagaataagaatcacaagatcatctaaataggtacagaaaaatcagctgacatgaattaacacccattcatgataaagacactcaaccctctaggaatacaaggaaattacctcaacataataaaagtcatagagaaaagaccacagctaatactatacttagtaaaacactgaaagctttaccactaagacacaaaatgaaatgagtatgtccactcttgccacttctataatgtagcattgaaagttctagcaagaggaattaggccagaaaaagaaataaaagaaatctagatcagataaggagaagtgaaactatctctgttcacagatgacatgattatatatttaaaaccactaaagattccacaaagaaagctcttagaactaataaataaagtttattaggataaaaagtcaacattcaaaaattaattgcattactattcattaacaaccaaaaatccaaaaaggaaactgagaaaaaaatttatttacaatatcatcaaaaatatataaaatacttaggaacaaacttaactaacttagcaaaaaacttatatagttagaaatttgaaaccctgctgaaagaaattaaagacacaaataaatggaaagataccccatgaacatgattggaagatataatattgttaatatgtccatactgcccaaagtgagctacatattcaatgcaatccctatcaaaatccctgtgacaattattacagacatagaaaaaagcaatgctaaaatttatatgaaaccaaaaggacaccaaatagtcaaaactatattgagaagaaagaccaaagctggagaccaaatcacagttcctgatttcaaaacatatataaagctacagtaagaaaaacagtatggtactggcataaagacagacatataggccaataaaacagaatacagaacccacaaataaaactacacatacatggtcaactggtctttaacttcagtgccaaggaaacacaatagggaaaggacagtctctttagcaagtggttctgagaacactgggcatccacatgcaaaagaataaaattgtacccatatttttagtctgtatgcaaaaatcaactcaaaatataggtttaaatgtaagaactgaatctgtaaaactgctaagtgaaaatataggggaaaagctttctgacactggattgacaatgatttgttagatatggcatcataagcacaggaaacaaaaacaaaaatataaataaatgggactacatcaaactaaaaatttctgaacagcaaaggaaacaaaagaatgaaaagccaaattataaaatggaaggcaatattacaaaccatatgtatgataaggagttaatattacaaatacagaaacaacacctatgactttatggcataaaaacaaataacctgatttaaaataggcaaaggacttgaatttgcatttccccaaagaagacatacaaatggatgacagtatatggtatatgaaaagatgctcaacaccattaaatgatcagggaaatgtaaataaaagccacaataagatatcacttcacatctgttagtatgaccatttaaaaaatagaaataaaggaaacagaaatgaaatgttgacgaggatgtggagaaattggagcccttgcacactgttcgtgggaatgtaaaatggtgtagtcactatagaaaacagtatggtgattcctcaaaaaattaaaaatagaataaagagatgatccagtaatcccacttctgggtatatatctaaaagaattgcaatcaagttctctaagagatatttgccctgttacaatttgaaacaaccacaggttttttttgaggtaataatacagttacagagtacattaaagcattaatcacaatagtcaaacagtacaaacttagaagtccattgattagtgaatacacaaagaaaatttgatatatatgtacaatggactattcagccataaaaagaagaaaaccttgttttatgttacaacatggataaaccttgaggacattaggctaaataaaataagtcagtcatgaaaggacaagtaccacatgattccactcatagtgagatatataatgtagtaaaacttatgacagcaaaaagtggaatggtgatttgcagagactgggggaggggaaaatggggagttagtgtgcaatgggtatcaagtttcaatcatgcaagttaaaagagttctagggagcttctgtgaaacactgtgtgaatagttatcaatactttacactgaaaaatttatgaagaaggtatatattacttttatcacaacaaaaatgtctacaaataaagacacagaggcaataaatacaatttaaaggattgaattctatagactacagctaattaaacttcctttcacagattcatgcagtaagttttgaaactgaaactatacaaagtcaataagaaaatttcattgagctcaagaaagtacaaaatggtcaagccatattttctggtcatgttgcaacaaaattataaagtaacaaaaaacactcaaagaaacagaaaactaacactaacagattaagtatctctctccaaaaataactaatgaataaaagaaaaaaatttaaaaatgcaactacaactaatctagaaaatcagaatactatgaagcaaaatgtatatgatagatccaaagtgttattcagtagtatattcatatatttaaatgcattaaatattaaacaaaaaagaataaagataaataaactaacccttcactgaggaagatagaaaaacaaaatcacaaagaagacagaatccctaagggaaaaaataatgtaaataaaactataaacaaataaattagcaaatgaaaagtgtcaaacttattaataaatccaaatccagttctccaaaaagatgagagaagaaaggagtagaggaaggcagagagggagggagagggggagggaaggaaggaagaggaagggaaggggaggggaggggagggaaaggaagggaagggagaagggagtgaaggtagggagtgagggaaggggagagtaaaatagataatctctggtaaattaattaggaaaatattagacaattgcacacagccaaaatcagaaatgagtaaaggagttcatcaactgacacaaagaatattaataacttctaacaaactaattagctaatattaataattttgaatatcttaataaaatgaacatctggtgaaacaattatcaaacctgattcaaagaaaaatagaaaattatctttcattatcaaattattacctcaaaaaaacctgtggttgttttcaaattgttacagggcaattttcatgaataggacatttgtatgtctccatttatctaaatgttttctaaattttattttttctgggtacatactaggtatatatattaatatttatggggtacatgagatgttttgataaaggcttgcaatgtataataagcacatcatgaaggattgggtatccatcccctcaagcatttatcctttgagttatacacaatccaattacatactttattttatttaagttatttaaaaatgtacaagttattattgactatagtcaccctgttgtgctatcaaacactaggtcttatttattttttctaactatttattttataaccattaactttccctctctcccccaggcccccactactcttcccagcctctggtaaccaccattctactctctacatctgtgagttcaattgtattaattttttgatcccaaataaattagaaaatgccatgatgtttgtctcactgtgccaggcttatttcacttaacataatgatctccagttcaatccatattgttacaaatgacgaatatcattcttttggatggctgaatagtactccactatgtatatgtaccctattttctttatgcatgcatctggtgatggacacaggttgcttccaaatcttagctattgtaaatactgctacaacaaatgtaaaagtgcaaatatctctttgatatactgatttcctttcttttgtatatgtacccagcagtgggattgctggatcatatggtagctcaatttttagatttttgagcagcctccaaactgttctccatagtggttgtactaatttgcattcccaccaacaatgtacaagggttcccttttctccatatcctttccggcatttactatctcctgtcttgtggatataagccactttaattggtgtcagataatatctcattgtagttttgatttgcatttctctgaggatcaaagatgttgagcaacttttcatatgcctgtttgccattcttatgtcttcttttcagaaatgtctattcaaatcatttgcccctatttttatcagattattacgttttttcctatagagttgtttgagctccttatatattctggttattaattccttgtcacatgggtaatatgcaaatattttctcccattctgtgggttgtcttttcactttgttgattgtttcttttgctgtgcagaagctttttaacttgatgttattccatttgtccatttttgctttgattgcctctgctactgcagtgtttgtcaagaaatttttatccagacaaatgccttggagattttccccaatgttttcctgtagtagtttcataatttaatgttttagatttaagtgtttaaatcattttgatttgaattttgtatatggtgagagatgggggtctagttttattcacctgcatatggatatacagttttcccagcaccatttattgaagagactctgtttccctactctatgttcctggcacctttgttgaaaattagttgactgtaggtatgtggatttgtttctgggttctctattctgttccgttggcctatataactgtttttaagccataacatgctgtcatggttactatatctctgtagtataatttgaagtcaggcaatgtgattcctcaagtttttttctttttgctcaggatagcgttggctattctgttgaattcggcttttgtgagttcatataaattttaggatttttttttctattactataaaaaatgttattggtattttgataagaattgcaatgaaaatgtatatggctttgggtaaattggaaattttaacaatattgattcttctaatccatgaacatgaaatattgttttattttttggcttcctcttcaatttatgttatcagtgttccatagttttcattatagagttttttttacttatttgtttaattcctaggtatttaattttatgtgtggctattgtaaattggattacattttgatttctttttcgcattgtccactcttggcatatagaaatactactgatttttgggtgttgattttatatcctgcaactttactgaatttgtttatcaattctaagagttttcttgtgaagtctttaggtttttcaaaatgtaaaattttgtcatctgcaaagaaggataatttggcatctttctttccaatttcaatgccctttatatctttctcttgtttgctgttctacgtaggacttccagtgtcatgttgaataacagtggtgacagtgggcatccttgttgtattctagatcttagaggaaacactttcaggtttttcccattcactatgatagcagctgtgtgtctgttgtatgtcaattttattatgttaaggtatgttccctctagtcctatttttaagggttttaatcatgaagacatgttgaattttatcaaatactttttcagcatcaatttataagattacatgatttttatcccagggataaatgccacgtggtgatgatgaatgatctttctaacatattgttgaattcggcttgttagtattttgttgaggatgtttgcatcaatattaatcagagatattggccagtagttttttttttttaatgtgtctgtgtcttgttttggtatcagggtaatactggcctgatagaatgagatgaaaagtattccctcctttatttttcagaatagtttgagtaggattggtattagttcttttagtttggtagaattcagcattgaagccattgggtcctgggcttttctttagtggaagagtttttattatagctttgatgtaattacttgttatttgtctgtttatgttttttatttcttcctgattcaatctttgtaggttgtatgtgtctaggaatttatccatttcttcctgggttttgaatttattggcatatactcgttcatagtagctactgataatcatttgcatttctgcaatatcagttgtaatgtctcctttttcatttctgtttttatgtatttggatcttctctctttgttccttagttattctgggtaaagttttgtcagttttatttaacttctcaaaaaaacaactttttctttcattgacctttgcattgctttttcatttcaattccatttatttctgctctgaatttaattgtttttttctattacttttgggtttagtttgctcttgcttttctacttctttaaaatgcattattagattgcttatttgaagtattttctctatttggtgtaggcaattaaagctataaacttctctctgagtactcttttactgtatcccatagattttgttgttttgtcttttaattattgtttgtttcaggaaatttttcaatttgtttcttaatttcttcattgacccactggtaattcaagagtatattgtttaatttccctgttttgtatagtttccataattcctcttcttgttgacttctggttttattccattgtggtaagataagatgcctgatattatttccacttttgtaatgttttaagtgttgttttgtgatctaaaatatggtctatctttcagaatgattcatgtgctcaggaaaagtatgtgtaatctgcagtcattggacgaaatgttctacaaatatctattagattcatttgctctatagtgcagaataattctgatgttttttgtttattttgtgtctggtagatctgtctaatgctgaaagtgaggaataaatgtctccagctattattgtattgcagcctatctttcccattagctttaatagtatcttctttatatatctgggtgttccagtgttgggcgcatatatgtttacgattgtgatatcctcttgctgagttgacctttttatcattatgcagtgacttttctcgtctcttctacattttgtctttaaatctattttgtttaatataggaatagcgactcctgctcttttttggtttccattggcatggaatacctttttccattcctttattttatctctgtgtgtgtctttataggtagagtgtgtttttttattaacaacagatccatgggtcttgtaattttaatccattcagctactctgtgtctttgattagagagcttagtgcatttacattcaatgttattactgataagtaaggacttactcttgccattttttatttgttttctggttttttgtggtcttctcatcctttctttttttctttcttgtcttcatttaatgaaggtgattgtcccgagtgatgtaatttagtttcttactttttattttttctgtatttattttgtgtttttttgttagaggttaccatgaagcttgcaaatattatcttataacacattattttacctgataacatcttaaccctgtttgcataaataaacaaacaagaaaaggaaaactaataaaaactctattccttaatttctccctgctttttaacattttgtcatttttatttatatcttattgtacacgtcttgaaaagatgtagtgtctttttattggtttatccttcagtatttctacttaggataagagtaatttacacatcatagttgcagtgttacaatattctgtgtttttctgtgtacttactattaccagtgaattttgtaccttctggtgattacatattgttcagtaatatcctttgcttttacacttaagtactgcctgtagcatctcttgtaggataggtctgatgttgatgaaattcctcagcttttgtttgtatgggaaagtcttcatttttcctttatgtttgacaaatattttcactgaatatactattctagcttaaatgttttctcttcagcacattacatttgtcattccactctctcctggcctgaaaggcttctactgaaaagtctcctgccaggtgtattggggatccattgtattttatttgtttctattatcttgctgcttttaggatactttctttatccttgacatttaagagtttgattattaaagatcttgaggtaaacttatttgggttaaatctgcttagtgttctattacaaccatcttgcacttggatattgatatctttctctaggtttgggaatcagacattgttgctttgaataaactttctacttgcatctctttctctacctcctctttaaggccaataactcttagatctgccatttggaggctgttttctatatcctgtagacatgcttcgttgttttttattcttttttcttttgtctcctctgactgttcatgttcaaaacagcctattttcaagctcactagttctttactctgctggatccattctgctattaaaagtctctggtgcattcctcagtatgccaatttcatttttcagctccagaatttttgctagattcttttatattattaaatctctttgataaatttacctgaaataatttttgaattccttctctgtgttatattgaatctcttcacagttcctcaacacagctattttcaattctctgtctgaaaggtcacatatctctgtttcttgaggactggtctctggtgctttatttagttcatttggtgaggtcatgttctcttgggtagcgttaatgctagttgttgttcttcggtgtctggccattgaagagttaagtatttattgtagccttcactttctgggcttatttgtatctgttcttcttcagacggctttccaggtaattgaaaggacttgggtgttatgatctaaactctatctgctttaggcagcaccctaagcccagtgacactgtggttcttgcagactcatagaggtactgccttgctggtctttggcaagatccaggagaattctctggatttctaagcagagatgcttgttcacttctcttactttctcccaaacaaatagaatctctctctctctctctctctctctctctctgttctaagatacgtaaagctgagggtatagtaaaacaagcacccctgtgaccaccaccactataactgtgctgggttagacgtgagggcagcacagcactgggtcttgcataaggcctactgtgaccactctttggttactgtctatgttttctccaggccttggtgctctacaatcagctcatgacaaagccagccaggcctgaattcttcacttcagggtggcaagatctccaggctccatgtggatctaagagtgcagtccaggagtcagggactagagtcaaaaactttaaaattctgccttgtgttctagggtactgtgacttagctagcactcacactgcaggacgcagtccttcccactcttgctccctttccaaaggcagaggagccttacctcctagccactgccaccacaggccatgaagagtactgccagactactgctgatgttcccttgaagcccaaggtcacttaagtcaacctgtggtaagtgttgcctggcctgggactcacacttcaggaaagtgggttccccattggcccagggcaggtccacaaatgccatccaagagtcaaatcctggaattagacaccccaagagcccacttggtggtctacccaacagtggccatgctgacaccaaagatgcaagagaagtcccctttactttttcctctgatttttttaatcaggagttttgccttgtagccaccacagttggtaacgtgctgagtctcatctgaagccagcaagtatcagaggctcacccaaaacacttgacttagtacctgggtattgctgctgtttattgagggcccaagggctcttttgctagcaggtgataaatgcttccagggataggtccttcccttaaagacagcaggttttcttatggtccagggtgtgtctagaaatatcatctggaatctagggcctgaaacggggggctcatctttctgaccagcgccctattctgcagtagctgtgctggtatctaagatacaagacaaagttctccctactctttcattccctctcctcaagccggtgaaaggggtttcttttggagctgcaagctgagcagcacggggttaggagagaggtgatgtcagcagtcccttggctgccccagctggtgtctcaataggtcacgtgccgccccagtccactgtctttggggcccagtttatcactaggattcacctaagagtagcagtccttattgcctggactgcctttcaagtttacttagagacccagagcactttggatctaggtggcaaggtttgcgggaacttaagttttgacctctggatcagcgatttccctctggctagggctgttttaaatattcccttcatgggcaggcaccagctgagtttggtctggtattgctttctgatatatatgacagcactgagttcagagcctcacaattgctatgctcttcctcccctaatacccggagatgctctctgtaccacaccaccactgctagggggtgggtgtgcaggggtaggagcggtggcatcagccattcaagactattttttctatctcttcagtgcctctttcagtgatatgaagttaaagctgggtacaatgtgtactcatctgattcttggttcttatgaaggtgtttttttttttcctctgtacatagttgttccattggtttccttgaagggaaggatgatcagtgaagtcttctattccaccatcttgatccacctctctcccaattttctaaatggtaattattctgattttttctaagtgctttaggccattcttgcatttacataaagaaattcctgagaataggtaatttataaagaaaagatgtttaattggttcatagttctgtaggctgtccaggaagcatggtgccagcatcttcccaccttcttgggtggcttcagagagcttttacttatggcagaaggcaaagcaggagcatgcatatcacatggcaagagcatgagcaagaatgagagcggaggtggagctgccacacacatttaaacaaccagatctcacgagtactcaccatcacaaggatagcaccaaaacaagagggatccacccctatgacccaaacatctcccactaagcctcatcttcaacatcgaggattaaatttcattatgagatttgagggtacaaatatccaaaccatatcattccactgttgggtcctcaaatcttatgcctttctcacatatcagaatgcaattatgcctttctaatagtctcccaaagtcttaactcatttcagcattaactcaaaagtcccaagtccaaagtcttatctggagatgagttccttccacctataagcctgtaaaattaaagcaaattatttactcccaagatacaatggggatacaggcattggaaaaattcccattctaaaagggagaaattggctaaaagaaatgagtaacatgccccaatccaatctataacccagcaggacagtcattaaatcttaaagctctaaaataatatcctttgactatgttatcccacatccagggaactcttgtgtgagtggtgggctccccaggtctctggcagctctgcccctatagctttgcagggtacaaacactgagactgctttcagagttgagtttctgcaccttttctagatggaagatgtaagctgtttatgtatctaccattctggggtctggaagacagtgggacacttcttacagcttgactaggcagtaccccagtggggagtctgtgttgggtctttaaccccacatttctccttcacactgccctagtcgaaactctctgtgaggactccatgcctgcagcaggcttctgcctgggcacccggcatttttatatatcatctgaaatctaggtggagaatgctaagcctccttaactgttgcactttgcacacctacaggattaacatcaagtaggaggccataaaggctcatgccttttgccctctgatacagcagcctgagctgcatctgaggccctttgagctgaggttggagctggagcaacctgaatgcagggagcagtgtccagagtctgtgcagagcaacagggcccagggccttgcccacaaaactattcttttcttctaggcctctgcacctgtggtgggaggggctgccttgaagattgctgaaatgtcttcagggccttttctcactgtcttggacaatagcacttggctccctctaaatcacgctaatatctctagcaagttgttgctccatagcccacttgaattctgcccttgataatgctttttctttctctgccatgtggcgaagttgcaaattttccacacttttgcactctgcttctcttttaattatacattccaactttaattcttttatttgctcccacattggagaataggttgttagaagcagccaggcacaatcttgaacacttttctgattagaatttttttctgccagatatcttcagtcatcaagtttaagtccaaagttctatggaaccctagggcatgaacacaataaagccaagttctttgctaagtcataccaagggtgacctttgctccagttcctaaaaactttcttattttcatctgagaccttgtcagccaggacttcactgtgcatatcactattagccttttggtcacaaccatttaaccagtatctgagaagttccaaactttccctcatgtttatgtcttcttctgagccctccaaacttttcaaacctctgcctgttacacagttccaaagtcatttccacattttcagaaatcttcacagcaatactccattcccagtaccaattttctgtgtcagacaatttttgcattgctataaaggaatacctgagactgggtaatttataaagaaaggaaatttatgatttatagccggttgtatggaaagcataaggctgttatctgctcaccttcttgggaagcctcagggagcatttattcatggcataaggcaaagtaggagcaggaacatcacatggtgagagcaggagcaagtgggtgggggtcccacatgcttttaaacaaccaggtctcatgataactcactcaatataataagaacagcaccaagccatgagggatccaaccccatgacccaaacacctcccaccgggttccacttccaacactgagggttacattttaatgtgtgggaggtcaagtatccaaaccatatcactcaaattctacatttcagttggttaggggaggtttatagggcactactggcactcagtgattacaaaattttatgacattatggttttcaaatcccatgactctgaaatcctaaggtaaaatgaccttctgtattcaacattacattagctctgattttaacatgctctgatagtatggtgatcagattttaactctttctgtgatccatgacattggctagaacagtgctttgaggaaataaactgctggatgaataaaaagatatacttttttgaatatggaataaactatagtcaaataaaaagagtaaaaagaggcaaataaatgactgggaacaatatttgctgcaaaaaagatatgcaaaaagtatttcacttacattttttatcttagaatatgattttaagaacaaatttaaatataaaaatactatcacctcagcttataaaagagtgaaagacatgaacagataattcacaaagttagaaacacaatttcttatctctagtgtcctaaatttctataatgcggttacattactacataatgtgattttaaatattaaaataaagaaaaaacaactggaagaacacatattaagtcactgattcgatgtatggtttaagcttcaaggctttttttgttgtttttgaggatcatgtatacatttgtagaataccgagtctaccacaattggctgtttttaattatttccccattaactcattattcccttgccaaattatgtcacttgacatttttttacaagtatttacttataacgacacttcatttttaaatatttaagtctttttataacataaatatatacaataacatgttctaaaaatgaactgtgcataaagaataaggaaataggcagttcaaataacaggaatgtctactcttgagggtacaacagaaaaataaataatcaggattaccactgctatactgaatcccaagtttacttttaagctcagaaatcaaagtgaaaattgagctgttgatcattatcagaaagaaaggacagttcatggaatagcctttcaaagacattcttcattgtgttttctcagtgggacaaaataagtgatgtggcagacaatgctgtcaaaagtattgctacagaaaatgcactaagtgaataaacagagcttttatttacatcgggttggagaaatgttggggagaggggttactgttttattttatctgaagaaaagctgaaataataacataaaacagagtgcactgtaggcaactctgtgcagagttgcaataatatggtcaacatatggggaatttctgatggtcttcctgaattgatttgaacttagaccctattgaatactgagaaaactagatcgatttaatttcctttacagaaatattacttctctcccgcagccttccacttgatctccagcacttcattatttaaatatcttagtttgtgactgggacacatgctggtttcatcaagtcattgtgagccccttgttatcctccctctacaactctcaacctactaatcagcttgataagctactgatcatcctagtactcaggatgactctaactgcaggtgtttcactgatgacagctcttctttccccatttcttactcaccagctctattaggacagatgcctactaaaaatgttctaaaaatcaaagaaattagccatgttaaacagtatttgcattccttcttattagtctacagcagttctccagaactttttagttcaaagtgttattctcattcatgtgcttaaagaaactctagatcatggagaaagcccatgcagagcccagctcatcattggtctactggggatagtatataaactgtaagctatgaaactccgtcttgctgaggaacttgaatgatgcaggatgtgatctaaaggtgcacttcaacatgacaaaaatacattttaaaatgccattggcatattctatcaactacaacaatgcacatatttagagttcaagatgtatgatgtacgtctcaggttttcaatttcaagtcttggaccccctttctagttcttatggaatagtgtggttagtctctccaattatcagctaaactgacctaccatcttataaaagccagtagcaattcacagcactttctatttgcttaaacaaaacaaaacaaacttaccaaaagatttattgactgtgcaagactatgtcagtaatctatttgaacatgtctgtcaaacctgtcactggagcttgctatttaatatctaactgtgtccctctatctaattttctgtcactaatctattttttaaagcaaaaacggcagttcttcaaaattagataaatgagtgcattgctttctgaatgcatggcaaaagatatgctttctttttatccttcacagcacctggcatagaacatggcatgtagcgaattctcaaaaataatgccatactatattttatattgtcatagagtttcaaaatgcatcaaatcattttctaagtttatcattgctgttgctatttttagtaacaatatattacagttaattgctattttattcagagggtagagggggtgatgtgattaattgcccaaattcaaatgactatcatggctggatcattagatagcctggatgaatatgactgtctgacttctaatgcagtgttctctttagaataaaacttcttcagcattttaaaaacctacaattcatgcattcatgtatacaataaatatttattgggcaccttccatgcatgagatggtgaagatgatacaaagacagatgtgaatgtgatgtttgaatattatttatattgcaagcagagtatatatgatatcatataactttggaggacagaagggtgataatggctttataccagttctctgactaaattgcctttaccgaccatggaatgaaccggcaaaattctcatgagggttgctttgcagtcattactctgtcctgagaacctcagaaaagatcttagtctttattacaatccaagatccaaatcccgctctttcatttcatctccacttctcaactgctagaacaacaacaaagccatgaatatttgattgagtgtttcttaacagcttgagtactttgttataaagtttctcaagactcagtggtttcacaaagggtagatatattttcttaactaaaagtgaatatagccaacagagggcagctattatcatgcatccatacatatccagcttatgtaataatatttataaaagcccattttaaaacacaattattctcaccttttgaggggaaaaaaaacacataaagtttaccatcttatccattttaagtatacagttcagtggtgttaagtatattcacattgctataaaacagatctctagaactttttcattttgcagatctgaaactctatattaatcaaacaactgtcctttttcttctccccaaagggagaggcaaccacctttttactttctgtttctatgaatctgactactttaggtacctcatataagtagaatcatacagtatttttctttgtgtgactaccttatttaaccgaccataatgttctgaaggttcatctatattatagtatctgtccatctgtcagggtttcttttcttgttgaggctgaatgatattccattgtatgtacataccacagtttgtttatccattcatccacggatggacacatgggttgcttatatatcactgctcttgtgaatagtgctgctatgaacatgggtacacaaatttctcttttatcctgctttcaattcttttgatatatactcataagtaggattgctgtatcaaaggatagttccattttttattgttttaggaacctccataaggttttccatagcagttgcaccattttacctttccatcaacagtgcataaagattacaattactcaacatcctcatcactatttgttattttctggaagtttttaatagtagccatcttgatggatgtgaggtgatatcacattggttttgatctgcatttcctccagtgatgttgagcatcttttaatatgcttattggtcatttgcatatcatccttggagatatatttatacaagtcttttacacatttcaaaaataaagatatttaaaattttttgctattgagttgtaagagctctttatattgtggatattaactttttaccagatttatgatttgcaaatattttctcccattttgtaggttgctttttcaatctgttgattgtttcctttcttgtgcagaaggtttttagtttgaggtagtcctacttgtctatttttgcttttgttgcttgtgcttttggtatcatatcagagaaatcattatcaaatccaatgttatgaaactgtcttctatgttttcttttaggagttttgtaatttcagttcttacatttaagtgtttaatccatttccagttaatttttgtatgtgtaaaataagagtccaactgcattcttttgcttgtggatatccagtgttttcaacaccacttgttgaagagactgtcatttctccattgagtggtcttggtatcctcatggaaaatcatttgtttgttgtctgtttgattcccattgccttggcctgggtgtcattctgcttgtgacacactgttttgttactatagctttgttatatgttttgaaattgcaaagtgtgagtcctttaactttgttcatctttttcaaaattgttttggttccttggggctcccttgagattcctcctgaatgtccatgggaattcttttctcttaccaagaaaattaattaattttaaattattttttctttcaagtaatctatttcattttattttttctagggaattttagaaagtaagtcttgttccttgcttcactgactatccatttatatgatatgttgtatatgaaacactccagattctctactgtgcagaatgtttgcttgcgaagaagagcaaatagaggagcatagataatgcttcatcaatgaggcctataaaaattgagatttttacaaattgctgatctcccaaaatttaggacagggctggacatgttgtaaattttcaaaatatatattgaaagaataaacgaaggctgaagacaatatgatgtgaaagatgccagttcacctagaagttaccagatgcaccctcctctatgtgtttatttataaattgttatcagcataatccatgtacatatttttgtctttgaatatttataaagggcttataatacaaagcaacataccctactccacctctctccatcctgtattcccactcccagaggaaacaactgtctattcttttagctgtgtcttctggcatgtattactctacttcttttttgtttggtttatacatatttatcatttaactctcacagtgggacccataccaaaattaaagactgcttttccaaattatttatttaataattacatcttttcttttagattcaggggatatatgtgcaggttcattacctgggtacattgcatgatgctgaggatgggggtataattgatccagtcacccaggtagtgagcatagtacacaacagttagtttttgaacccttgactcctctccttcctttacactctggcagttctcggtgtctattgttgccaactttatgtctatgagtacttatttttagctccaacttaaaggtgggaacacagggtatttaattttctgttcctgcattaaatggcttaggataatgaccctcagctgcattcatgttgttgcaaaggacaagatttcattcatttttatggctatatggtattccatcgtgtatttacaccacattgcttttattcagttaaccattgatgggcaactaggttgattccatgtttttgctattgtgaatagtgctgcgatgaacatgtgagttcatgtgtctttttagtaaaaccatttgttttcttttagatgtaaacccagtaatgtgattgcctggttgaatcgtagttctgttttaggttctttgagaaattttcaaactgctttccaaagtggttgaactaatatacattcccaacaatagtgtataaccattccattttcttcccagtttggccagcatctgttatttctggaatttttagtaatagccattctgactggtgtgagatggtatctcattgtggttgtgatttgtatttctctgatgatgagtgatatttgttggccacttgtattttttcttttgagaaatgtgtggtcatgtcttttgctcatttttaaatttttttttaaattccttgttcaattgtttacacgacttatagattctggatattagatctttgtcagctacatggattgcaaatattttctaccattgtgtagcttgcctgtttactcttttgatagtttattttgctgtgcagaaagtctttagtttaattaggtcccacttgtcaatttttgcttttgctgcaattgtttttgaggactcagtgataaattgtttcccaagactagtatccagaatggtgtctcctaggttttcctccaggattcttatagtttgaagttgtaattttaaatctttgatccaccttgagttaatttctgtatatggttaaatttcagtcttctgcatatggctagccagcaatcccagaaccatttattgcatagggagtgctttccccattgcttatttgtgttaactttgtggaagatcagatggctgtagtcatgtggatttattactgtgttctgtattctgttccattggtctatgtgtgtattttgtagcagcaccatgctcttttggttactgtagccttatagtatagtctatagtataggtaatgtgaagcctctgatttccttctttttcttagaatagttttggttatttgggctctttttggttccacatgaattttataatagttttttttctagttctgagaaaaatgatgttggtagcttgatagaaatagtgtgaaatttttagcttgctttggtcactatggccattttaataatattgattctttcaatccatgaaaatggaacatttttcatttgtttgtataatctgtgacttttttcagcagtagtttgtagttctccttgtagaaatctttcacctccttggttagatgtattcctatattttttggcagctgttgttaagtgggaatgtattcttgatttggctttcagcttgaatgttattggtttataaaaaataaactgctgaatattatatgttgattttgtatcctgacactttactgaagatatctaccagttccaggatccttttcatggagtcattagggttttctaggtatagaattatattgtcagcaaagagacgtggcctgatttctcttttttctatttggatgtcttttttttttttttttctcttgcttcattgttctagcaaggacttccagtactatgttgaataagagtcagagtgggcattcttgtcttgtgggttcttgcgggggatgcttccaggttttgcccatttattatgacgttgacagtgggtttgtcatagatggctcttattattttgaggtatggtccttaaatgcttagtttcttgagagttgttatcatcaaggaattttacacttcatcaaaacctttttcttcaactattgagatgatcatattgtttttgtttttaattctgtttatgtactgaatcatattcattgatttgcatatgttgaaccaatcttgcatcccaggaataaagcctacttgatcaagtgaattaactattttatatgctgctggattcagtttgttagtgttttgttaaggatgtttttatctacattcaaaaggaatattggcctgtagttttgttttgttttgttttaattttgtttttctcaggttttgatatcagggtgatgctggcttcatagaatgagtaagggaggaatccatcttcccttattttttggaatagtttcagtagtattggtactagttcttcttcatatatcttgtagaatttggctgtgaatcatttgttccttggctttttcttggttggtaggattttttatggctcattcaattttggaactcaaaattattctggtcagggtgtccatttcttcctgattctatcatggaagattgtatatttccaaaaattaattcatttcctttagatttttcagtttgtatgcatagaggtgttcaccacagactcttaaggatcttttgtatgtctgtgggagcagtggtaatgacatctttgtcatatgtgcttgtgcttatttggatctctcttttttcctttgttaatctaggtagtggtctattggtcttgtttatcctttcaaacaaacaacttttagttttgttaactctttgtatggatttacatgtctcaatttcatacaggcctgctctgattttagttatttattttcttctgctagctttggggctagtttactcttatttttctagtttctctaggtgtgttgtttgattgttaatttttgagattttctaactttttgagataggtgaatagtgctataaactttcctcttaacactgcttttgctgcattcctgaggtttgggtaggttttgtctctgtttttatttatttcaaagaattttctgacttcttccttaatgttattgtttacctaaaagtcattcaggagaaagttgtttaacttccatgtaattgtgtggtttttgagagatcttgttagtattggctttaattttattccactgtgttccacgagcatcattggaatttttttttttaatttattgagacttactttctggctgataatgtggtcaatcttagagtatattctgtgtgcagatgagaagaatgtgtattatttggttgttgtgtggagtattctgtagatatctattaacttcaattggtcaatgtcaaatttaaatccattatttctttgttagttttctgccttgatgccttaaagtctaatgctgtcagtggggtgttgaagtctcccattattattacgtggttacctaagtctttctgtagatctcaaagtaccgttttatgaatctgagtgctccaatgttgggtgcacatatatttagaatagttaagtcttcttgttgaattgaaccctttatcattatgcaatgcccttctttgtctttttttactgttgttgttttgaagtctattttatctgatataagaatagccactcttgatgtttttgtgttccatttgcataataatcttttatcccaccctttcctttgaggccatgggtgtcattactgctgagataggtctcttgaaggcagcagatggaagggtcttttttttttaatccaacttgccactctatgctttttaagtgggatgtttagacaatttacattcaaggatgttgatatgtgagattttgattttatcataaaattgttagcaggttgctttgcagtttccattgtgtggttgctttatagggtctgtgagctatgtacttaagtgtgttgttgtggtagcaggtatcattttttttcatttccatgtttagaacttccttaagggtctcttgtaatgttggttcagtgacaacaaattcccttagtgcttacttgtttggaaaagactttatttctcctttccttataaagcttagtttggcaggacatgagattcttgattggaatttcttttctttaagaattctgaaaagaagctaccaatctctcctggcttgtaaggcctctgccgagaagtatgcttgtagcctgctggggttcattgcatatgtgatcttaccttattctctagttgactttaagattttgtctttagcattgacttgaacagtatgttagtctgttctcatgctgctaataaagacatccctaaggctgggcaatttataaagaaaaagaagtttaatggactcacagttccacattgctgcagaggcctcacaattatggcagaaggtaaagaaggagtaaaggcatgtcttaaatggtggcaggcaagagatagtatgcaggaggactaccctttataaaaccatcagatttcattagatttattcactatcatgagaacgacacgggaaaaacctgccccgatgattcaattaccttccaccgggtccctcacaaaacacatggggattatgagagctataattcaagatgaaatgtgggtggggatacatccaaaccatatcaaacagtctgctgactatatacaaactgttgtgttggtgatgttcattttgtaaaatatcttgcaatggttctctggattcattgtatcaggatatctacctctctagtgagataggaaaattttcttgaattattccctcaaatatgattttcatgttgttttatttttccccatctccttcagaaataccaatagttcataagtttaattctttacataatcccttatttctcaaacactttatttttaaaattctcttttctttatttttgtctgactagattaatttgaaaaaccagtcttcaagctctggaactatttttctgcttggtctagtccattgataaagatttcaattgtattttgaaattctttaagtgagtttttttttattccagaatctctgattgatttctttttaagatgtttacctcttctttcactttccagattgctttagaagtgtccttgttttgattttcaacattgtcttggatctcaatgaaattccttgcaatttacactttgaattctttttttaaaattttttatttcaagcgatttttgagtacatgtggtttttagttacatggttctttagtggtgatagctgacattttagtgcacctgtcgcccaagcagtgtacacggtacccaatatgcagttgtttttttttttttttttgactgacagagtctcgctctgtcacccaggctggagtgcagtagtgtgatcttggctcactgcaacctttgcctcctgggttcaagcgattcttctgcctcagcctcctgagtagctgggattacaggcatgcgccaccacgcccggctaatttttttttttttttgtatttttagtaaagatggggtttcactatgttggtcaggctggtctcgaactcctgacctcatgacctgcctgcatcggccttccaaagtgctggaattacaggcatgagacactgcgcccggcactcaatatgtagtcttttatccctcacccctcccaacattttccccccaagcccctggagtgcattatattagtcttatgcttttgtgtactcatagcttagctcccacttgtaagtgagaagatatgctatttggttgtccattcccaagttacttcacttagaataatgtcctccagctctgttgtgggaagtcagggacgccgaatggagggactggctgaagccatggcagaagaacataaattgtgaagatttcatggacatttattagttccccaaattaatacttctatactttcttatgcctgtctttactgcaatctctgaacataaattgtgaagatttcatggacacttatcacttccccaatcaatacccttgtgatttcctatgcctgtctttaatctcttaatcccatcatcttcgtaaactgaggaggatgtatgtcacctcaggaccctgtgatgattgcgttaactgcataaattgtttgtagagcatattgtgtttgaacaatatgaaatctgggcaccttgaaaaaagaataggataacagcaatgttcagggaacaagagagataaccttaaactctgaccgctggtaagccgggcggaacagagccatatttctcttctttcaaaagcaaatgggagaaatatcgctgaattctttttctcagcaaggaacatccctgagaaagagaatgcattcctgaggttaggcctctaaaatggctgcttcaggggcagccatcttttacgatcgaagctgtagggatgaaataagccccagtctcctgtagcgctcccaggtttattaggacgaggacattctcgcctaataaattttggtcagactggttgtctgctctcaaaccctgtctcctgataagatgttatcaatgacaatgcgtgcccgaaacttcattagcaattttaattttgccccggtcctatggtcctgtgatctcgccctgcctccatttgccttgtgatattctactaccttgtgaagcacatgatctctgtgacccacaccctattcgtacactccctccccttttgaaaatcactaataaaaacttgctggttttacagctcaggggggcaccacagaacctgccgacacgtgatgtctaccccggacacccagctttaaaatttctctcttttgtactctttccctttatttctcagaccagcctacacttagggaaaatagaagagaacgtatgtgaaatatcgggggtgaatttcccccgatacagctccatctaagttgctgcaaaaaaaattattttgttcctttttattgctgagtagtattttatggtgtatacataccatattttctttatccgtttgttggttgatgggtccttaggttggttgcatatctttgcaattgtgaattgtgctggaataaacatgccacatgcatgagtctttttcatataatgacttttcctttgggtagatatccagtagtgggattactgaattgaatggtagttctacttttggttctttaaggaatcttcatattgttttccatagtggttgtactaatttacattccctccagcagtgtaaaagtgttctcttttcaccatgccaatgtcagcctttatttttttttactttttaattatggccattcttgcaggaatatggtggtatctcattgtgattttaatttgcatttccctcatgattactgatgttgagcattttttcatatgtttattggctgtttgtatatcttcttttcagaaatgtctattcatgtagtttacccactctttgatgagcttttttttctgatttgtttgagttccttgtagattctggatatgaatcctctgtcagatgcatagtttgctaacattttctcccactctgtgtgctgtctgtttactctactgattaattcttttgccatgcagaagcttttttagtttaattaggttccatttatttatatatttatttatttgcatttacttttggggtcttaatcatgaattccttgcctaagctaatgttcaggagagtttttccagtgctatcttctagaatttttatggtttcaggtcttagatttaagtctttgaggcatcttgagttgatttttttataaagtgagagatggggatctagttttattcttctaaatgtgacttgccagttttcccagcaccattggtttctatattagttagggacctttgctgtagagctggtgttatcctttgctcatgtcactacattcagattctttatggtgccagaattcttgtgctagttcttcctcatctagagaccctagcatttgtgggttgtgtatttattttcattcatgtctaaatttttatttttatttttctttctctatttttttctttcccttcccatttgcgctcctccctgggggctgtgactctagagaattctgggtagggtctcttgggttttcttctgtagccccatgcacttctggagatgggttttatactgggctgtgcaattcaacctacaagccagtagatggtgcttatgggtaagagccagttttgaccaatgtggctgcatatatacttgatcactgtttaccaggagaagttctctgttgcctcagagaatgaactgattcatgatgtggacagtagtctgagctccctcctcagccctggagaggtgggggggtaagatggacagggcaggaaaagactgggcaggtccaactacaaattccaagatggcaggaacaagcactggtgccaagggacaatccaatgaccagccaccaagtacccagatgtgtgcctaatcatggaggtgggaaacctccttggccccaagttctctgcacaggaatagggggcagcctaaactcctaatccaggagagtgagtgcttcagaagcttggagatctgcctgggcatggagcagaaaggggccccctgcacccagatctcttcacaggaggggtggggtgactcaggctactgaaccagacaagcaggtgttctgaatgcttggatatctgcctgggttgaaacagatagggccctcctgcacccaaatggctgggcaggaaaggtggggcagctcagggggtcaatccagctgagcagacactttgaatgcctggagaactgcctgggcatggagtggagagggccccactgcaccactgtctatgtgcaggaagagtgggacagctcaggctgctgaaaaaggtgagtgtgcgctctgaatgcctgaaggcctgcctagacataaagcagaaagggacacctctgcacagtatctctgcacaggaagggtggggtgactcaggctactgtccatgcaagcaggtgctccaagtgcctggagatctgcctacatatagagtagagagagccccactgcaccatgatctatgcacaagaagtgttgggtggctcaggatgatccagatgagagagtgctctgaatacctagagatctacctgggcatggagtagagagggcttgtggtaccacaatccatgtccataatgggtgaagccgctcaggctgctgttccaggcaatcaggcattctgagtgcctgaatttttgtttgggggtagggcagatagggccttgtagcatcatgatctcagggaagcaggctaggcacctggcaatgacacacacaggccagttccaggtcaccaagctggccctggctgcaagtctcatcatccaggagaaactgtagctgtagcagctctcctcccactacgggtctgcaataggagatagtacaattccggtgcctactgctgaggcactttccatagttctggttgtagaggcccctaactcattcaaaagtagagactccaatgtctggcctgagactaaaatgcttgcacagtcatgctgccaggtcaccaaagaatgggtgattttgtatgtgcctgggttaaaactgggatcctgctttccatcccaggttggggaaaatgcctgcagttattactggcgtctttccttcagaacatctccaagcctctcctcaaacaagctccagggtttaggaggaacactgtgctctccctcagcctgggtttctcagatctccaggggaaaggtgagtcacagagggaggctctctgcctctgttgtgtactgggacttcactcattttaccagccaggtactgtcacagggctgtttgcccatgttctcctccccaggatctgagttgtccttcatgatgctggtggactcccattttccctcctgaattaaaggtcacataattgatctttatacactatcttgctatttttagctgagccatgctaaaagtgtctaatctgcaatcttctttgagaaaaacaaaattatacttctaaataccatgatgaaactgttatttctaggctttttgttttaaaaaattatacgtcaactttattcaatggaagacaaagatttacattcttcacactctctaatcacgtgtgaacacatatgcatgtatgaacctatgcacacacatacacactcacatacactcttctccttccctgttcttttaatagatttcttggttaaaaaaataattaaaaaaaacctttcattgtttatattactataaacaagtatatagtaatagaattttgcatttccttttctgttatctctagatttaatacttgcatttatttatttgcaagttttcctacatacttttatctaacttatctccaaactctccaccagagatgtaattctttcaattcttttagctcattatataacctatacatttaattacttttcttgaaggcagtttttcaagaatctttcatcctctgcttcactttgggcgggaggttcagtaagtctattgcataaccgtcttttatatctcccttaaacataattctaggaatacccattcttattttctgtgttggattttttatatcttatgttttactctttttagataattctctgttttggaggaggatcacaatctctagcagattcctgagaagagtatacgggagccaaaaatttgataccttgcatatctgagcacgcttttcttctattctaacatttgataaataggttgggtataaaattcaagttacttttttttaatccctcaaaattttgaaggcattggcctgttattatatcataacttgaaatgtttctatacacaagtctcaaagttactttctaaagcttctgttaaatttttaatttctgttgtcacattttgtgtatttcaagaactcctttgaatcatcttaatttttccttcttatagccttctgttcttttttcctatacttgtaaggatagcaataatgctttttaaatgagtatttttcccatgctctacattgtctctcttttttttataaatttctgttacctattgtattgttttgttctgtgtttcttgctataggttttcctcaaatatctagtgactatggctctacactcatatttaagagtgagtgcataaaatacttatcagaaactttgtgcatagatgatgctttaatgaattaataaatggttggcttcatgtatgacaataggattgagatatttcttttgggaattcccaagagttagcaactgtatatctcttctcttaggttattgagtttctccacagcataatcttctaattcctgtcctggactgcataagcctgtctgccagaattcttgggtcttaatggcgaaaaagacttgtgtcctcatcatttttaccaaattgctctgtaatccgtgtgtttgcattctgctgtactgggaattctcaagtcctgagtctctccagttcatcttgagagcaagccttcattcttcttacagtttagaagaggcaatccttcaaatatgtggagtacggagggcacctgggatctatagccaatcctcctcccacattaaatgttgttattccaattcttgagcatttctgtggttctgtggtcacacattggctttctcctgaattgctttcatgctaccccatcacttcctggcttaagtttcagccttctccggtttgctaaatcatatgactaccagattcaaaaattttgctgttaccaccttcttttctgttctcatttcctaagtggtttatgtcctgtatggtctttcgtcccagccattttagtgaggtgtgagaaggaagcagaggtaagtagttgactacgatccagaaatatttacaccagagactccagggttttttttttaagtaattttctgcagatttcagtattttatagaaaataattttcatcatgatacaaaaaacaaatattttcaaatttggtagaagttggcccatatattgtttacagaaatagtttgctcttctttgaacttaatctctaatttcatttagcccaggaaaattacctactttatcataaagtatcagtttctatatctattaatgattcaatgaggacagcacacctagtttcaactatcgagcctgtcaaaataattagaatatgtttttggtacttaaaaatgctacagatcttatttcaaaaaaataaataaagtttacatgacaatttctttgaaccgtatcttgaatgtaaatgttaatttgatagttattcatgtaaaactaccaactaaaagtgtacgaaaggggtagtatattattctgtaactgaaaatagggatgggaccaaaagtatgctaggtcctttccaataaaatgtttttccttacatcttaaatgaattgagatatacaatacacctagaacattgtacgaattcaaaaactattggtacccccatgcgtttcttttttcattatttacatttgcttactgccaacattgcattacacattgtacatatagtgaataaaaaatattttattttacttattcttaccatctgttgtgttcaaaatcacttgagctttattaattcatcacaagtgatttaaatatgtaaaccagtttatcttctgaaatatcttaagataaaaattgagtagcaacctattacgtcatttgttcaaacatatctctcaaacagtttttgcaaaaaatctgtctgtcagggtcaacattgatttaaagagaaatgtgcaacttacctttcatcttcatgctgtattcaagtaagaggagggctatattagctaaggtatccaacagagcaaaatattgtataaaattcacatcaccacatttcccactatgcattgtcatagtccatttatggtaaattgaacaaaattattcaatatttaaaactgactaccatcactttttaaaatagtaaaataatttggaaatgatgcgttaatagagaactccatttggtttcatgctgtaaatataaaatattcacatacactcaatacatatactaaaagcacatacagccaaaatacataacaaacatagtaagccttctaatgctacaagatagtccttgaacgttattaaactctatagttgaaacaaataaatggccattctaagttatgatggtgatatctgatttgcattactctatcttcccatttgaattcctgtgaaaacacagagcatggtgtagaatttaaacagccctaagaattacttttagtagatgagcaggactaagaggcaaaagctcttagtatcttaagatgttaaacatctgtaaaagtggcatggccaaataagcatagacaagaaaagacggtttactctcattctatattgccacattagtgactcaaagatgggaatatagactagaaactgtgttggccactctctaccattctattagcttttaaagttagtgatgttacccctagaaggcccccttaagtacttcttgctaagttccttaaggaaactatagttttttgtaatgcaatcgtccagtggatgaaagggaataatcagtaactaaaattcttttcaaaaagtttctaatatatgagtcaagaatatatgaatatttttaaaagtaccccataactgaaaataagaactcaaggataggtttgttttagtcattcatagtaattaaacttataaagacatatttatatacttattaattacaagaaataaagtgatacataaatgaataataaaataatgaaataattatgtaataatggtaatttaaatgtataatcataaattatattggcatacattggcaagtgctgagagaatgtagtaaaaatgctaaatatttcaacttacataagaataaatcaaatgtaatgttcaccaattttataattataaaaatattgttacaaatataattgtaaaattttgtaaaacagaaaaaagtaaaagtaagaagtattaaattggccattttcttaagataataccaatatttttttaagaggatgaaatatcaaaagtattctgatacattgtttgtggaacataaattggtataggctcactggaaagaaatttaacaacatgattaaataggcataacaatcactgtgttgattaactcattaattctacatcccagaaaatttactatgagttcaaaagtcagagcaatcacctaggatatatgtgcaataatgttcaatacagcattatttataataagatataaatgatcaaataaaaacaatttaaatgtgaaacaaaaaagaaccagatgtaaaaactatactatgtgtttgtactataatatattgtttacattaaaattatttttcaaaaaatatctaatgccaaggaaatttttatgatatgattttaaattaaaaatagattacatatgatgtgacctcaatttattgaaagaaaaaaatgtatatagaaaaaataatgaacaaaatgggaaagagatacattaaagtattattaaatcttactaatatgtggtggttttacaggtggttttcattttctcccttataacattttgtacattgcaaattatctgtaagtgaatatctattacctttaaaatcagaagaaataagctaagtggccacaaacactgatcttttattaaagatatattacatgtattccaatgtttccttgaagctagtccaactgaaataatctaaaatccacaaatgagtattttcacatattattgcattacaaatggtgacaaccattcatctttattaattttgtcacacttaaaaaatagaatctctaggtgtctttctactgctcttatcttattctggcccatcttctgtttgttataagtcaagtggcaggtgctctctcatcaacaaagcattgcttctgagattgtagggggagggagaccaataaataagggtcattaaattttcttcgtaggttgtagtagcatattttcttgaaataaaacagactagactagacaagagtagaataaaatataaagttgagtataaaagagcagaatggaatagaatagaacaggatatatcagtaagggaattattgttgccaaaatcttttattttagctatatatgtgctgatgtactgagtcttgagttcagatttatgtttgcacatgggtcatgattttttaaacatggagaaatgagttctgtaggatgaatatggttaactgtaatttattgtatattttcaaaaagctagaagataggattttgaatatccacaacataaagaaatgataaatgtttcaggtgatacatatgctaattatcccaattgatcattacacattgtatacatgtatcaaaatatcactctgtatcccacaaatgtgtataattattaggtgtaaactaaatttaaaaggaaaaagtatatgtgaaaaaaaatgcttgaaagccactataccaaacagtaatttaaaagcagaaaagatattttgctaaacctaactaaagtgttcttgctacttctgccataaaataaaaaagatgtggccattaaatatttgcttgagtatcaagaaatatggtatttcatttcttccctgtagctcacatttctataggaaaacaaacatgactgaggattccagaactggaccttcaaaaaaatgtgtgctgcacaccacattttattgatcccttatttaaaactcccccaccagccaatgccttcatctgcaaaccaactacagtaacaggcttggattcagcaaaataggaaatttacaaatgtacactgactttgaaaacatatacatggcaaattgagaattcagcccaccagaagtaaactataaatgcaaacattcccaacagcaactttcaaataaataggctgcaaattggaaacatgaacacagcaaacttatggacctcagattgcaaatcacagcagcaattccctgaaaataaggcagtcctcttttcttttgtatagcatgttacgtatcttttattttcagaatcctggagaactgaataatgtttatagaaccttgggggagacagttttcatagatctggaatttaaaaaaaaaaaaagctatatttgtgacgtttttgtgaataggtttacatttagttacctacctcctctaggcagttctccttatactcttctgtgccccttgaggtcattcacatgagtgtggaagagaaaataaaaattagaaagaaaaaaaagctgaccgggcgtggtggctcactcctctaatcccagcactttgggaggccaaggcaggcagatcacctgaggtcaggagtttgagaccagtctgaccaacatggagaaaccccatctctactaaaaatacaaaaaaatagccaggtgtggtggtgcatgcctgtaatcccagctacttgggaggctgaggcaggagaagcgcttgaacccgggaggtggagattgcggtgagccaagatagcaccactgcactccagcctgggcaacaagagccaaactctgtctcaaagaaaaaaaaaaaaaaagagaaagaagagaaagaaaagctaactggcctattctgtggctgtggcagatggaggctttgaccagaaaagcctcaagctttggaaccagactctgaaactttgggtatattccctaaccttgctgagtattagcttttatgtttttaaagtaggaaatgataccaacagtatacctacctggcagacttgacatgaagattaaataaaatagtgtattaagtatcctcagtatatattagttattattatttttattagtgttctaaattgtctaactagaccacagaagaacatggaagaaactataccatggtcacaggcttctgcctcatccaacattctcactatttcaatcttccaaataaaaaggacaactttactgaaactgcaaaatgtttcattgtgtcattcccaactttcatcttttccggtttgtttccaaatgattttataattcaaattttctctttacttgttgcattcttttcttattttgttatgtaatgtctataatatcatctatgttctgcaattatgtctccattcctttgcacttctcattgtctcagtaagacttttctttctttgtttggctttcctttaagataataagaatgtgactatgaactcatcttacatccctgttaaagagataaaagtgctaaaagtgacagaggggaaaaaagcatcccatgaagaaataattgcacatagaaagagcctgtttcaattatctattgctgtgtaactaaccactccaaaatttaggggattaaacagcaagctagaacctcactgattctgtaagtcaggaattctggcaaggcccagttggacaaattttctgttttttattggcctcaatcaaaattattcatgtactcagatggcagaaagactggcctaaaggatccaagatggcaccactcacatgcctggtaccttggcagaaatagctataaagcgaaactcaacaggcactttcaacccaagtgcctacacatgacatctgcatgtggcttaggctacataacacgggatcttacagtagtcagatctcctacattacagcttgggactcttaagtgcaagtgttccagcaaacaaagcaaaagcctcattaccttttatgacctatcctcagaagtcaggcagcaccacttccactacactctattggttgtttagagctgcagaaaattcagccataattgataatactcaaataaaagaagaagaaaaaatctcacatgtggttgattgaaacaaaacaatagagtgtgacaaaagtaaatcacatttaatgaaataatttctacatttaattaaccatattctaaactacagaatctctatacaggcagtgtgatgtaatgtaaagctttgtaattaaaggcagaatataatttcatgttctgtctgcacatcaggcaagtcataacttctgggaccctcctcccaggcccacggagccttgctcattgttagcacagcagtctgagatcaaactgcaaggcggcagtgaggctgggggaggggcgctcaccattgctgaggcttgagtaggtaaacaaagtgaccaggaagctggaactgggtggagcccaccacagctgaaggagacttgtatgcctttgtagactccacctctgggggcagggcatagccgaacaaaaggcagcagaaacctctgcagacttaaatgtccctgtctgacagctttgaagagagtagtggttctcccagcatgcagcttgagatctgagaatggacagactgtctcctcaagtgggtacctgaccctcgagtagcctaactgggaggcactccccagcaggggcagactgacacctcacatggccgggtacccctctgagaggaaacttccagaggaacaatcaggcagcaacaatcgctgttcagcaatattcgctgttctgcagcctctgctgctgatacccaggcaaacagggtctggagtggacctccagcaaactccaacagacctgcagctgagggtcctgactgttagaagcaaaactaacaaatagaaaggacatccacaccaaaaccccatctgtatgtcaccatcatcaaagaccaaaggtagataaaaccacaaagatggggaaaaaacagagcagaaaaactgaaaattttaaaaatcagagcgcctctcctcctccaaaggaacgcagctcctcaccagcaatgtaacaaagctggacagagaatgactttgatgagctgagagaaaaaggcttcagacgatcaaacttctctgagctaaaagaggaagttcaaacccattgcaaagaagttaaaaaccttgaaaaaagattagacgaatggctaactagaataaccaatgtagagaagtccttaaaggacctgatggagctgaaaaccatggcacgagaactacgtgatgaatgcacgaggttcagtagccgattcaatcaaatggaagaaagagtatcagtgattgaagatcaaatgaatgaaatgaagcaagaagagaagtttagagaaaaataaaaataaaaagaaatgaacaaagcctcgaagaaatatgggactatgtgaaaagaccaaatctacctctgattggtgtacctgaaagtgacggggagaatgcaaccaagctggaaaacactctgcaggatattatccaggagaacttccccaacctagcaaggcaggccaacattcaaattcaggaaatacagagaatgccacaaagatactcctcaagaagagcaactccaagacacacaattgtcagattcaccaaagttgaaatgaaggaaaaatattaagggcagccagagagaaaggtcgggttacccacaaatggaagcccatcagactaacagctgatctctcggcagaaactctacaagccagaagagagtgggggccaatattcaacattcttaaagaaaagaattttcaaaccagaatttcatatccagccaaattaagcttcaaaagtgaaggagaaataaaatactttacagacaagcaaatgctgagagattttgtcaccaccaggcctgccctacaagagctcctgaaggaagcactaaacatggaaaggaacaaccggtaccagccactgcaaaaacatgccaaattgtaaagaccatagaggctaggaagaaactgcatcaacgaatgagcaaaatcaccagctaacatcataatgacatgataaaattcacacataacaatattaaccttaaatgtaaatgggctaaatgctccaattaaaagacacagactggcaaattggattaagagtcaagacccatcagtgtgctgtattcaggaaacccatctcatgtgcagagacacacataggctcaaaataaagggatggaggaagatctaccaagcaaatggaaaataaaaaaaggcaggggttgcaatcctagtctccgataaaacacactttaaaccaacaaagatcaaaagagacaaagaaggccattacataatggtaaagggatcaattcaacaagaagagctaactatcctaaatatatatgcacccatcacaggagcacccagattcataaagcaagtccttagagacctacaaagagacttagactcccacacaataataatgggagactttaacagcctactgtcaacattagacagatcaacgagacagaaagttaacaaggatacccaggaattgaactcagttctgcaccaagtggacctaatagacatctacagaactctccaccccaaatcaacagaatatacattcttttcagcaccacaccacacatattccaaaattgaccacatagttggaagcaaagctctcctcagcaaatgtaaaagaacagaaattataacaaactgtctctcagaccacagtgcaatcaaactagaactcaggattaagaaactcactcaaaaccactcaactacatggaaattgaacaacctgctcctgaaggactactgggtacataacgaaatgtaggcagaaataaagatgttctttgaaaccagtgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaattaatgaatccaggagctggttttttgaaaggatcaacaaaattgatagaccgctagcaagactaataaagaagaaaagagagaacaatcaaatagatgcaataaaaaatgataaaggggatatcaccaccgatcccacagaaatacaaactaccatcagagaatactataaacacctctacacaaataaactagaaaatctagaagaaatggataaattcctcgacatatacaccctcccaagactaaaccaggaagaagttgaatctctgaatagaccaataacaggctctgacattgaggcaataattaatagcttaccaaccaaaaaaagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaacaaaaaaagagaattttagaccaatatccctgatgaacatcgatgcaaaaatcctcagtaaaatactggcaaaccgaattcagcagcacatcaaaaagcttatccaccatgatcaagtgggcttcatccctgggatgcaaggctggttcaacatacgcaaatcaataaatgtaatccagcatataaacagaaccaatgacaaaatccacacgattatctcaatagatgcagaaaaggcctttgacaaaattcaacaacccttcatgccaaaaattctcaataaattaggtattgatgggacgtatctcaaaataataagagctatttatgacaaacccacagccaatatcataatgaatgggaaaaaaccggaagcattccctttgaaaactgccacaagacagggatgccctctctcaccactcctattcaacatactgttggaagttctggccagggcaatcagtcaggagaaagaaataaagggtattcaattaggaaaagaggaagtcaaattgtccctgtttgcagatgacatgattgtatatgtagaaaaccccactgtctcagcccaaaatctccttaagctgataagcaacttcagcaaagtctcaggatacaaaatcaatgtgccaaaatcacaagcattcttatacaccaataacagacaaacagggacccaaatcatgagggaactcccattcacaattgcttcaaagataatacaatacctaagaatccaacttacaagtaatgtgaaggacctcttcaaggggaactacaaaccactgctcaatgaaataaaagaggacacaaacaaatggaagaacattccatgctcatggataggaagaatcaatatcgtgaaaatggccatactgcccaaggtaatttatagattcaatgccatccccatcaagctaccaaggactttcttcacagaattggaaaaaactactttaaagttcatatggaaccaaaaaagagcccgcattgccaagtcaatcctaagccaaaagaacaaagctggaggcatcacgctacctgacttcaaactatactacaaggctacagtaaccaaaatagcatggtactggtaccaaaacagagatatacaccaatggaacagaacagagccctcagaaataataccacacatctacaactatctgatctttgacaaacctgacaaaaacaagcaatggggaaaggattccctattgaataaatggtgctgggaaaactggctagccatatgtagaaagctgaaactggatcccttccttacaccttatacaaaaattaattcaagatggattaaagacttaaatgttagacctaaaaccataaaaactctagaagaaaatctaggcaataccattcatgacataggcatgagcaaggacttcatgtctaaaacaccaaaagcaatggcaacaaaagccaaaattgacaaatgggatctaattaaactaaagagcttctgcacagcaaaagaaactaccatcagagtgaacaggcagcctacagaatgggagaaaattgttgtaatctactcttctgacaaagggctaatatctagaatctacaaagtactcaagcaaatttacaagaaaaaaaacaaacaaccccatcaaaaagtgggcgaaggatatgaacagacactcctcaaaagaagacatttatgcagccaaaagacacatgaaaaaatgctcatcatcactggccatcagagaaatgcaaatcaaaaccacaatgagataccatctcacaccagttagaatggcgatcattaaaaagtcagaaaacaacaggtgctggagaagatgtggagaaataggaacacttttacactgttggtgagactgtaaactagttcaaccattgtggaagtcagtgtggcgattcctcagggatctagaactagaaataccatttgacccagccatcccattactgggtatatacccaaaggattatagatcatgctgctataaagacacatgcacatgtatgtttattgtggcactattcacaatagcaaagacttggaaccaacccaaatgtccaacaatgatagactggattaagaaaatgtggcacatatacaccgtggaatactatgcagccataaaaaaggatgagttcaggtcctttgtagggacatggatgaagctggaaaccatcattctcagcaaactatcacaaggacaaaaaaactaaacaccgcatgttctcattcataggtgtgaattgaacaatgagaacacttggacacaggaaggcgaacatcacatactggggcctgtggtggggttgggggaggggggagggatagcattaggagaaatacctaatgtaaatgactacttaatgggtgcagcacaccaacattgcacatgtatacatatgtaacaaacctgcacgttgtacacatgtaccctagaacttaaagtataataaaaaatatatctattatatataaaaagaaaaaaaataaaacctctgggaccctccaatgtttcatccatagttggagattttaggaagtttgcttggctaactctgaaatacataccaacttctttgaaaacagatggctataaatgtatgagataatgcgctcttcataacaactgtgttaaatggatttttaattatcacttctattttacaaaatacaagaaacaggggttaaaaaacattaagtaatttactcaaagttacttaaagcaagcagagccaatattctatcctagatctatgactcctaagacctttgaacactatttgactgtacaatgcctacttcctttaccattgtgatgattctggatgtgatcatttaagaaatggctttgtaaaccataaagtgttctgtgaatgtacagcatcattattagtattgattccaacaactgagagagctataattgcctgtaataagattgattatgcttcacgatataaccaataaactagctaaacctcaaattctaatccccaaatgttcgtacaaaacatgactgaaaacaaatgaaatcatattgatcagctctaaaaataatagaacctgattataacatttgtcctgtggcagctgcttttatccccctatttctcatcatatatcacacagagaaaagaccctttttctcgtgcctgccatcatttatcctttaggaaaaaaagacctctcttctctatctcctcaaacttgaaagataaaacaagatataatgaagaagtgtgaagagcagagaattagtgagtctactcctttttcctccttttgtaagacggtttgatttgattcaatatcagcccagaaagatggaggatatttcttttggtggggttctgtcaacagaaattagacaatctaatttaaggaaaataggaaggaaaaaattcaaacttactgctattttacaatccaaaacccagtatgtagaatgaatatctttgaatcattggtatgtaaggttttcaaaacactgaagctgtccctttatcaggtctagcatttcccctagaagcaaatgataaaatatgaagagtaaaaactgtttcaatatcattataaagtacagatttgtagttctgtacattcaaaatagaaaataaaaaattaaacttaaggatttaatctgatttaggcctaatgaactttgctcaatagtgtgttaccaacatctagccatttcaaaaaatcacatctttaccattttattatttacataattaagtctctcttcatctcacaagtctacagaaaccagtactggtggttacaagttaaagtgtccactcattttctctcataacttatctctgaccttgtcaaatttcctctccaataatatgcgtcatataaatgtatagtacttaatatataaaatgtcaggcatatacatagaactttatagtttccttaacactttcatatgtactgttatatttataattaagcatattttaaatggccgtttttaagtggtcatcattaaaacacagagtatctactctgtacttagaaaaagaagcaaattttagatcacttactttttgacacttatctttagtgactaagacaaatatttatctaatttctatctgcaacaagtttttcaattgctttaatcaccgttctctgatctattatttatacctcggcaagtttttttaatcaatcagcttacttctttttttttgtacaaatagttttatctttaaaaaatcatttcatagatcaaaataccataggaaccaactttttaagtcttagatgtttttcatatatcatttactggtgttaaaaacagatttcttacctctttatttgacttcacattgtctgcatcagctctgctctctcaatcaactctgccaactatagaggtcaggaacaataacatgtaatctttagcttttctgaagttgaatttcctgtgtctaactatatttgatcttttagtagaggctttgaaatggggttagcataataatttgttagtttataaataaaggcatgtggtcaatttttggcatgtcatgagttgtttttgctgagaacaggatgtgagtacactggtgagagtaacttaattgtatttgaatttttccacatcccattgtgcctaatacaccacttgccacataatcagtactcaatacatgcctgctaaattttaattatgtaaataatgaaataatttaagattataatttggatttattttttaaatgttgaactgaattcctgaattagccaatgtttggtgcttagtctggaattaaagacccccagattatttcaaaagctctcccatagagtaataatacacatttggccataataaaccttacttattacatcagtgttaggcatataacgtttaaatctctatcataatttcagatctttggtcaagacctgctacctaagcgaaaacaatttttaatataagagcaggcttagtgacaaactttcattcataccttaaagtgaataccattaaaatggcaaaaactgatttatatgctaagtttccaacacagacaaagttttccaatggctccagagtgcccaattatggaaagaaatgggaaaaaagcataaatacatgaacaacaacaaaaaaagccttactcctgccaaactacaaaaaaagacacatgggaaaacttgatatttaaaaaaaacaacaacaaaaagaatggatgggctataatgcagcacttttaaaaggaaattacagtaaggcactcaagcaactaaatataaaaaatttcaagaaagaaagtcaaaactacttcgagttgtttatttttttattttttggaagcacaaaactcatagggtctataaaacaataacacaatttaaaaaagtaggcaacaatatgatgaatagaacactcccaggtcacacctcaatgttttattattattattattatacttaaagttctgggatacatgtgcagaacgtgcaggtttgttacataggtatacacatgccatggtggttcactgcacccatcaacccatcacctacatttggtatttctcctaacgctacccctcccataacccccccaccccctgataggccctggtgtgtgatgttcccctccctgtgtccatatgttctcattgttcagctcccactgatgagtgagaacatgcagtgtttggttttctgttcttgtgttagtttgctgagaatgatggtttccagcttcaaccatgtcctgcaaaggacatgaactcatcctttttattggctgcataatattccatggtgtatatgtgccacattttctttattcagtctatcattaatgggcatttgggttggttccaagtctttgctattgtgaacagtgctgcagtaaacatacgtgtgcatgtgtctttaaaaacaagctggtacaaaaagaggaaattcactagtcctggaatatctcagagataagatgactgtcaactactccaatatttatgtcacttttcaacagattgatttttgacttggattgtttttatgcaattaaaaatcataattaccttaaaatatttctaccctacatgcaatgtttagcatttaatgaaatgtaatgttgagaggagggaagcagggagagatggtggaatagaacactccagagatcatcccccctgcaaggacaccaatttaacaactagctatacagaaaaaaaaaaaaaagaccttcataagaaccaaaaatcagatgaaacctcatagtacctggttttaaattcctttcattaaaagaggcactgaatagatagaaaaaaatagttttgaattgcaaatgtcaccacttccccacccacctcaggaccactcccccccatcccctgacagtgatggtgtggtgcagagagtgtctctggattctgggggacaaagacaatgacaattgtgaggcactgaactcagtgctgttcagttagagcagaacgcaaaaccagatcaaattcagatgagacccgcctacagagggagcatttaaaccagccttagttaaaggggaattgccgatcccagtggtcacaacttgagttcccacagacctttccacaaagtggtaaactgctctgagtctctaagtgaacttgaaaggcaggctaagccacaaggactacaactcttaggaaagtcctagtgctgaactgtgcccagagacagtggactggggggagggtgatgtgacctgctgagataccgggttgaggcagtcaaaagagtgctggcatcatccctcccctaaccccagtctgctcagctcacagctacaaaagagacccattacttctgcttgagaagataagaaaaaagagaggggaagactttttcttgcatcttggataccagtacagccacagcagaatagggcactgatcagagttatgaggtctctcttccaggccctagctccaagatgacatttctagacacaacctgggccagaagaaaacctgctgcattgaagggagggactcagttctggcatcatgcatcacctgctaactgaagagcccatgggcccagaataaacagcagtgataactaggtactatgtcgagggccttgggtgagcctctgagacctgctggcttcacgtatcagcatggccaaagagaggtagagcaccaagttggctaatgtggtccctgattccaggaattgactttttttttttttttttgagacagagtctcgctctgtcgtccaggctggagtgcagtggcatgatctcggctcactgcaagctctgcctcccgggttcattccattctcctacctcagcctcccgagtagttgggactacaggcacccaccaccacgcccggctaatttttgtatttttagtagagatggggtttcaccatgttagccaggatggtctcaatctcctgacttcatgatctgcctgccttggcctcccaaagtgctgggattacaggtgtgagccaccgctcccagccaggaattgactcttaaatgatgtctctgaactgccctgggccagaggtgagcccactgcctgaagagtgattcccaggccaggtagcattcaccacaagctgacttaagagattgtggtcaaaacacatgaaaaaatgctcaccatcactggccatcagagaaatgcaaatcaaaaccacaatgagatatcatctcacacatctttagaatggcaatcattaaaaagtcaggaaacaacaggtgctggagaggatgtggagaaataggaacacttttacactgttggtgggactggaaactagttcaaccattgtggaagtcaatgtggcgattcctcagggatctagaactagaaataccatttgacccagccatcccattactgggtatatacccaaaggattataaatcatgctgctatacagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagttggaaatcatcattctcagtaaactatcgcaaggacaaaaaaccaaacaccgcatattctcactcataggtgggaattgaacaatgagaacacatggacacaggaaggggaacatcacactctggggaatgttatggggtggggggagggaggagagatagcattgggagatatacctaaggctagatgatgagttagtgggtgcagcacaccagcatgtcacatgtatacatatgtaactaacctgcacattgtgcacatgtaccctaaaacttaatgtgtaataataataattaaaaaaaaaaaaagaaaaaatgctcaatatcactaatcatcagtgaaatgaaataaaaatttaaaccacaaaaaaaaaaaagaaagagattttggtccttaagaatgcatcagcggtggtctggctgtactcctcatagcctgtggtggtgatggctatgaggagaggttcctctgcctttggaaaaaagagagaagagtaagagacagggcatcctgtggtttgagtgccacagctcacccatagtacaaaagaacaccaggtagaattctaggttttttgactctagtctctgactcttgaagggcatctctggacccatccagagcctgggggaacatgccacctgaagacaaggatatacacctggctggcttggccccctgatgattgtagagcccaagggcctagagcaagcacagattgtagccagggagtgattacagcaggccttgggtgagacccagtgctgtgctggctttaggtctcacccagcacaatcatagtggtggtggctacaggggtgcttgcgtcactccaccccaagatttaggaggcatagaacagagagagagaagctatttgtttgagagaaagtaagggaagagaacaagagtctctgcctgttaatccagagaattctcaagaatcttgtccaataccatcaagttggtacctctacatatcttcaaggtttacttcaaagcccacaggtttactgggcttggggtgccccttaaagcagatagagttttgatcacaacacccaagtccttccaaatatctggaaagttttcccaaaaaggatagctacaaacaggtccaggcatgaagtctaaaatgaatacctaaatcttcaatgcccagacactaaagaacatctactagcatcaacacgatccagaaaaacatgaccttatcaaatgaactaaataaggcactagggatcaatcccagagaaacagagatatgtgacattttagacagtgaattcaaaatagctgtgttgagaaactcaaagaaattcaagataacacagagaaggaatttagaattctatcagatacattcaacaaagaggttaaaataattaaaaagaataaagcaaaaattctggagttgaaaaatgcaattgatgtactgaaaaatatatcagcatcttctcagagcagaatggataaagcacaaaaatgaattagtgagcctgaagacaggccatttaaaaatacacagtcggaggagacaaaagaaaaaaaaaaacatgaagcacaactacaggatctagaacatcatctcaaaagggcaaatctaaaaattattttccttaaatatgagggagaaactttattcaaagggataataacagagatttttcacaacctagagaaaaatatcaatatccaagtgcaagaaggttatagaacacaaagcagttttaacccacagaagaataactgaagaaatttattaatcagtctcccaatgataaaggataaagaaaggattttaaaagcaatagaagaaacaagtaaacaaatagcatacaatgaagtgccaaagcatcttgcagcagatttttcagtggaagacttacagaccaggagagagtggaatgacatatttaaagtgctgatgaaaaaaaccttttatcctagaatagtgtatctagtgaaaatatccttcaaacttgaaggagaaataaagactttctcagacaaacaaaagttcaatttcatcaacaccagaactgtcctacaagaaatgctaaagggagtacttaaatcagaaaaaaaaaataatgttaataaacaataaatcatcacctgaaggtaaaaaaaaaattcattgttaatagtaagtatacagaaaaacacataatatcataacatttaaccgtggtgtgtaaactactcttatcctttgtagaaagaataaatgatgagccaatcaaaaataataactacaacttttcaagacgtacacagtacagcatgatataaaaagaaacaatatactaaaggaagggcaagagggcctactagacacagccagctggaacagttcccactaagggactgagacaactggcatgcttttaacagatcttcagagtaaaggtgctaagagtggagagaggaaagatacagaagctggactgaagagagagaaagctggaaacactgcatggggctactatgcactgggacttacttttgaaccacaacagcttcaggagtacgagtgagttgaactgtcaaggaccaaccagctctcaccatgggcccctggaaccctgacaggaggagacccctcaaccatcaccgacatgtgagttggcagaaagagctgcttagagaagtggtaagggcagcaagtcagtggatgtggaacccagaggatttcttgcaggaatgttggtagcagagcatggccaacaacagccatacccctatgcttgacttgatcccatagaagactttagccctaggagaactgtcagacctaatctctgcagggcattcctgcccatcagacatgactggtccgacttgagagccccttggtctgctggcctctcctggggccccagcctggcctgcctgctttcaaggcagtcctgggtgccatgagggcctacaccatattctctgcaccgatagattctgcctgaccagtggagagctccagtgaggtggtctctatggcaacacgctagcccacttgccccctccccatattgcagctttcccagggcgcatggcaactccccacatcacttttctggtgtgtgtctgcactggcaggttttgctttctttgccccactaggatacgggagtgtagtccacatcccaccccccacaaccgccattgcagacaacgtcttggcaggcacagggacagcaagccctgcccctgccagcaccctgtccttgggctaacactgcacagaaaacagcagatcctaccccagattgagtatcactcccgcttgtggggtagacaaggcacccagagctgcactggccagcaccccaccccaaaatcaacaccacatccagcacaaccacatacacagtctcaagtaggggccccacgacccccacagctgcattgcctccaacactgtggtgaacacccacagggaggcaggcaccccagcacctgctagcactctgctgaagctgctgcacctcaccacctctccccagtgttgtgggttgcaaacctaaaggaaccagataacaaagtcagagtaaaatgcaagtcccccagagttagagcacataatccaggagttggaagctgagtcttggcccctgaaaatcttccagaaacaaagccagttagctaaacctaccttataccacaatcaaaacctcgaggtcatcaaatatgataaaagaaaaaaaacattcaaaggttggcaaagtccaaaattgaagatagataagcccacaaaaatgagaaataaacagtgcaagaaccctgaaatctcaaaatgccagagtgcatttttttctccaaatgaccacatcacctttccagcatgggttctgaaacaggctgaaatggctgaaatgaaagaaatagaattcagaatatggataggaattaatatcattgagctacaggagtacgttgaaacccaatgcagagaagctaaaaatcatgataaaacaatttatgaggtgacataaaaatagccagtatagaaaagtgtaaatgtaaatacacccaacactggagcaccaagatacgtgaagcaactattattagaaataaagagatagacaggccccagtacaataatagctggaaacttcaaatcaaatggatcagacacttacatctaagcatcacactatgaaactactgaaagaaaacattggggaaaatctccaggacatttatgggggcaaaaatttcttgacaaacacagcagaagcataggaaataaaagcaaaaatggacaaatggaatcacatcaagttaaaaaaaacttctgcacagcaagacacaatcaacaaagtgaaaagacaacccacaagaatgggagtaaatatttgcatgctactcatgtgacaagggactaataacaagaatatataaggagctcaaacaactctataggaaaaaaggtaataatttgattaaaatatggacaaaagatttgaacaaacatttctccaaagaagaaataagagtagcaaatgggcatatgaaaaggtgctagcatcattgatcctcagagaaatgcaaatccaaattacaatgagatatcttctcacctcagttaaaatggcttacatccacaagacaggcaataacaaatgctggcaaggataaggaaacgcccacacactgttggcgtaaatgtaaattggcacaacgactatggagaacagtctgaaggttgctcaaaaaaactaaaactagagctaccatatgatacagcatttccactgctcggtatataaccaaaagaaaggcaatcaatataccaaaggcactcccatgtttgttgctgcagtgctcacaatagctaagatttggaagccacctaagtggcttgattcatccatcaagagatgaatgaataaataatatatggtatttatacacaataaagtaccattcagccacaaaaatgaatgagatcctgtcatttgcaacaacatggatgaaactggagatcattgtgttaagtgaagttagccagatactgggagacaaatattgtatgttctcacttattttgggaatctaaaaataaaaaaaaaaatacccatagacatagagagtagaaggatgattatcagaggctgggaagggtagtagggggttggcgggaaggtggggatggttaatgggtacaataaatagttgaaaataattaataagacctactatttgataacaaagcagtagtatagtcaataacttaattatattttaagataactaagagaatataattggattgtttgtaacacaaaggataaatggatgagggaatggatacccccatcctccattatttgcttatttcacattgcatgcctgcatcaaaacatctcatgtaccccataaatatatacacctaatatgaaaataaagtattctgaaaaaatcacatgtaatgaaaaatactgtgaaacagaagcatcgtaggaacctattaaacattaaatcttatcaaaagtgagagtccattaataaataaatatgatttgaacagtttttggggatcatcttttcttggaatatttatctttaggaaaagcatagtaaatgagaatttaatcagaaaatctgcaaaaatatgaatacagctaaagtcttttataaaccccacataagccagtgcttctcaaactatctgcagttaaacagcattttttttcaaaatccctaatttgttctagaccaataaatttgtaaagcacaataaaaataaataactagaaaatcgtaagagaaaaaataaagatttgaaaagacgtgcccacatcttttatgttcagattctacagacttaaaattaccctatcaaattgctataaaattttctcaagcttactttaaaattctctacttagcttgttgcagaccaaaaacaaacagcacactgtcaactgtgggcacctcactgtatgcatcacttattatccttaaaacaaaaatgaagagaaatttttagtaaacatatactaaatgaaacagaaagccaaaaaaagtagatcaggtgaaaacaaattttacctacagaaaatattttgtgttataataaaaggaatatttattgacttaagtgtaaagaaaccatttgtttcacatggtgcacaaaacatcccctataagtacactacacaaaatatttccaaaatcttctctaactgctatacactactatgttaaccatatttgcaatcaatcaactatttggattaaatgataaattttaatgctaaatttcatcttttaaaataagatttacatttcattaatacaataaagacttactgatgacccactatatgccagccactatgctaggcactaaagctgtgtgtgtcaaatctgactttaagtaatgttggtggaacactaaacttaattcttatgaactatttttctgccaaagatatggcaggtgaggccatctaccacagtttcattataataaagtatgagttggctaggtgcagtgacttatgcctgtaatcccagcactgtgggaggccaaggtgggcagatctcttgaggtcaagagttcgagaccagcctggccaaaatagggaaatcccccacctctactaaaaatacaaaaattagctgggcatggtggcgcacgcctgtaatcccagctacttgtcagtctgagacaggagaatcgcttgaacctgggaggcagaggttgcagtgaaccgagatcgccccactgcactccagcctgggcgatagagtgtaacttcgtctcagataataatagtaataattaataataataataaaatgtgagttattgcaagccttgggctggtttaaaatttttccttcagagaacacaacatattaagcctataatatctcatttctctctcatcagacttgcaaagaattaaaatagttttaatacacttcttgcaagaatgcagggaaacaagcactcatgtactactggcgactcggcaaactgttagcacttctttagtggcaatctaacaaaaattttcaaaatttgacatgcatatactgtttgactcagcaattttacctctttcaatttatcctctaaatatccttgcacatacgcaaaagatttatatccagaaaaccaactaaatattcatcaataaaggaatggtttattcatcaataaaggaatggtttaataatcacacacacacacacacacacacacagagagagagagagagacagagagagagagaaacaagcatttataatgaaatactaagtaaccagtaaaaagaatgaggtagctagctgtgtactgacataagaaaatcactgacatggttaactgaaaacaaatgatttgcagagaactacaatacagcatgattgtataagtgcatgggaaatttctggaagcatatccaagatattattgggagagttaaaggagttatctgaaatgggaaggaaactctctttttgtcatctgccctttaattctatctgaactttttcactatgcccatgtttttgaataatataaaaaatagaaaaaaagtaaaactcaatatcttgaccaatgttacctaccatttgtaattcataaaaagatatgtacctctcattgaggagtaataaaaataatagttcctttagcaatcaaatctttgtgcttccttttgtttacttgtctgtaaaagtacttatatattcttgaaaattagaaggcttcactagtgtctcatattaaacaccaagttgacaaactcaacatatttttatgttttataaaacaaaccctatataaagatttggaaaatactgatgggggaaaaccttgaaaaaataccttcaaacattttcatgaacttccattctcatgttctaaaattaataatacacatataggaaattaaaaatgtattattgttactatcaattgataccaattgaatgaacgtaatgctgaaattttctagaaatgcatacataccattgtttgcacataactatgcattgactattagcataatagtacccaaatactgcatgcatcctgcatttacttaggaaacctaaactagctcttttagacaacagggaaggaaaaaacacaccacaaatgtttcttctcatttacgtttaggtcccagtaaaatagtctcccattctgaaatttggtactctaaagatatccactgggattactactgggttttggtgtagatttcctactgtcatactgtcttattgtatcaatgacagtatttaaatatcttaatttcctcctctaagaaactgagctgtgctttcaaaagctttgatgaatataactgaccctagatctagcccatagtaattttgttaaaagtttaccttaagaatggactatatttcagagggtcaggcaaaatatatcaagggaaaattgcagaattacaaggaaatatcatcttgtggagtttcatacatacaaataaagttataaaagcacactttgagaggagagaatagcttgataggctgaacttctacgaagattttagtatctttcagtgatagaaaagaagttagaaagcttaaaatatccagtaaggaagacttatttgggtcaatgtcacaacaatatgtgagcttggtttggaaggttggaaaaattttaatctagtaaaaatcatatagaaacatttttctcatcaaaaaacaaaaagatggataaatcagtaaattatttatggtgataaatagcctgagatgtgggagtaaacaatcgaatcaattgtatcttaacacattaacgtgttaagaaacacattaatatcatctaagacattcagtaaaatgtatatgtttatatagatgataaaagtgttaatgacatggtcccttaaatcaagaagatatgatttttattcaggagacaaaataaataaaagtggaacaaaacataacaccagacagaatatgatcaaatattaaactctattgtccagtcaatacatgttataagaaattccaggagaatggcgtgaacccgggaggcggagcttgcagtgagccgagatcccgccactgcactccagcctgggcgacagagcgagactccgtctcaaaaaaaaaaaaaaaagaaaaaaaaaaagaaattcctaaaggtgcaagtttgaaggctggagtattgaggaggtgaaactcaagttgatattattaagatagatattttcttgataagaaaggaaagggagaagaagaatgctcttctccatttcacatcccccgcaacagacacacacacacacacacacacacacacacacacatacatacacaaatggtcttatattttgttttcatattctataaagtttgtattaatagcatagggataaatgagaaaccagacatataaaagatattaatttctgattcccaaagtagcttttaggacctctaagttctttgggtaagaagaaaagtgagagaaatggaagtcggtgtgctaacaaagtttagttggtttgtgacataagacataaaatacaactttacaacctagttcatcaacactgcaggtactggacaaattgtttacaaatatccttgcagttccaatggaagaactgtgggtgtcttcagcacaggattctgtaattacctttaagaccaagagtaactgtgagtggacgaaccagtttggagaaaatgccttcaaaatcttaaacaactacaaattattatttcaaatattttgaagactcacatatatatgcaattatgtatgcatatatttataatacagtactgagtatatgcacaacaataattatatgttcagcaataaatccaagtttatctataacacacacctacatatgcatgttattttcatttttatatttctacacttcagaaatttacccatgagctgaatcagaagtgtcaaagcatagtaataaaagctacttacaagcagcctaattaccatctctagctatgccctgaaacttaaatcagacgtaacaaagacacattatttaatctgattaacactagcatctatccccagagctcttctgttaaaaatctctttctgtcaggcctgtatttaccattgtcaatcagactacattgtttgaatgtcattttatttttatttttttaaaaattgtataccatttaacatgttttatttcaacatactagatcttttaatgcttcttagaattcaaaatgaattatacaaaaatctttgtatttcatgtcatattatataaggaaatcaaatttggaagaataattcatgctgttttaaatttttacattacttatacattttaatagctaatcaactcttaagcatacttttttgttttattattttattttattttttattttattttattttatttttccttaagttgttggagtacaggtggtatctggttacatgagtaagttttttagtggtgatttgtgagattttggtgcgcccatcacctgagtagtatacgctgcaccatatttgttgtcttttatccctcgccactttcccactctttcccccaagtccccaacgtccattgtatcattcttatacctttgcgtcctcatagcttagctcccatatatcagtgaaagcacacgatgtttggatttccattcctgagttacttcacttagaataatagtcttcaatctaattcaggtcattgaaaatgctattaatccattcctttttatggctgagttgtattccatatatatatatatcacagtttctttatccattcattgattgatgggcatttgggttggttccacgattttgccattgtgaagtgtgctgctataaacatgcgtgtgcaagtatctttttcaaataatgacttcttttcctctgggtagataccctgtagttggattgctggatcaaatagtaattctgcttttagttccttaaggaatctccacactattttccatagcagctgtgctagtttacattcccaccagcagtgtaaaagtgtaaaagtgttccctgatcatcgcatccatgccaacatctactgttttttgattttttgattatggccattcttgcaggagtaaggttgtattgcattgtggttctgatttgcatttccctgatcattagtgatgttgagcattttgtcatatgtttgttggccatttgtatatcttcttttgagaattgtctattcatgtccttagcccattttttgatggaattgtttttttcttgttaatttgtttgaatttgttgttgattctggatattattagtccttggtcagatgtatagattgtgaagattttctctcactctgtgggttgtctgtttatgctgctgactgttccttttgccatgcaaaactctttagtttaattaggtcccagctatgtatcttcatttttattgcattcgttttggggttttttggtcatgaaatccttgcctaagccaatgtctagaagggtttttccaatgttatcttctagaatttttagagtttcaggtcttaggtttaagtccttaatccatcttgagttgatttttgtatatggagagagatgaggatccagtttctttctcctacttgtggctagctaattatcccagcaccattttttgagaatggtgtcctttccccacttgatgttttcgtttgctttgtcaaagatcagttggctataagtatttgggttcatttctgggttctctattctgttgcattcatctatgtgcctatgtttatagcagtgccacactgttttggtgactattgccttatagtacagtttgaaatcaggtagtgtgatgtctccagatttgttctttttgcttagtcttgctttagttatacaggttcttttttggttccatatgatttttagaattgtttttttctaattctgtgaagagtgatggtggtattttgatggggattgcattgaatttgtagattgctttcagtagtatggtcattttcacaatattgattctacccatccatgagcatgggatgtgtttccatttgtttgtgtcttttatgatttctttcagcagtattttgtagttttgcttgtagaggtctttcaactccttgcttagatatattcctaagtttttgttttgttttgttttgttttgttttttgcagcaagtgtaaaacgggctgagttcttgatgtgattctctgcttggtcgctgttggtgtatagaagagctactgatgtgtgtacattaatcttgtattcagaaactttgctgaattattttatcagttctaggagttttctgggggagccgttagggttttcaagataaatgatcagcaaacagggacagtttgacttcctctttactgagttggatgcccttcatttttttctcttgtctgattgctctcgctaggacctccagtgctatgttgaaaaggagtggtgagagtgggcatccttgtcttgttcccattctcagagggaatgctttcaacttttccccatgcagtattatgttggctgtgggtttgtcatgggctttagttacattaaggtatgtcccttgtatgccaaatttgcttagagttttaaacataacgtgatgctggattttgttgaatgctttttctgcatctattgagatgatcatgtgatttttgtttttaagtctctttatatggtgtatcacatttattgacttgcatatgttaaaccacccctgcatccctggtatgaaacccacttgatcatggtggattatccttttgatatgttgttggattcggttagctaatattttgttaaggattttagcatttatattcatcaagcgtatcactctgtagttttgttttttggttgtgtcctttcctggttttggtattaggatgatgctggtttcataaaatgaattagggagggttccttctttctctatcttgtggaatagtgtcaaaaggattggtacaaattctgttttgaacgtctggtagaattctgctgtgaatccatctgtcctggaatttttgttggtaattttttaattaccatttcaatctcgctgctagttattggtctgttcagggtatctaatttttcctgatttaagctacgaggattttaattttccaggaatttatccatctcttctaggttttctagtttatgtgtgtaaaggtatacatagtagccttgaatgatcttttgtatttcagtggtgtcagttgtaatatttcctgtttcatttctcagtgaggttatttggattttctcttttcttttattggttaatcttgctaatggtctatcaaatttatttatcttttcaaagaaccagctttttgtttcgtttatcttttgtacttttttgtttgtttcaatttcatttagttctgatctgatcttggttatttcctttctcctcctgggtttgggtttggtttcttcttgtttctctggttccttgaggtgtgaccttggattgtctatttgtgctttctcagactttttgatggaggtgtttggggctatgaacttttcttcttagcactgccttagctgtttcccagaggttttgataggttgtgtcattattgccattcagctcagaaattttttaaattttcttcttgattttgtttttgacccaatgctcattcaggagcaagttatttaatttccatgtatttgcatggttttgaaggttccttttggagttgatttccaattttattccactgtagtctgagagagtgcttgatataattttaattttcataaatttattgagtcaccttttatggcctatcatatggtctatcttggagaaagttccatgcactgttgaattatctcaatagatacggagaaggcttttgataaaattcaacagtcctttatgttaaaaactctcaacaaactaggtattgacggaacatacctcaaaataataagagccatgtgtgacaaacccacagtcaacatcatactgaatgagcagaagctggaaacatccccattgaaaactggcatgagtcaagggtgcgctctctcaccaatcttattcagtgtagtattggatgtgctggccagagtgatcaggcaagagaaagaaataaaggcattaaaatagtaaaagaagaaggaatctatcctgtttgcgatgacataatcctatatctagaaaaccctgtagtctcagcctaaaagattcttaagctgataaacaacttcagcagtcttgggataaaatatcactgtgcaaaaatcactatcattcttatacaacaacaacagtcaagctgagagccaaagcaagaatgcaaccccattcacaactgcgacaaaaagagaaaagtaccaagaaatatagctaaccagaaaggtcaaatatctctacaagcagaactacaaaccactgttcaaagaaatcagagatgacaaaaacaaatggaaaaacagttcatgctcatggagaggaagaatcaatatagagaaaatggccatactgcccaaatcaatttatagattcaatgtttttactattaagctatcattgacattcttcaaataactagaaaaaaactattttaaaattcatatggaacaaaaaatccaaataaccaaggcaattctaagcaaaaagaaaagagctggaggcatcatggtacccaactttaaactatactacaaggctacagtaaccaaaacagcatagtactggtataatatcagactcatagaacaatggatcagaatacagaacccagatataagagggcgcacctacagctatctgatctttgacaaacctgacagaaacaagcaatggggaaatgattccctattcaatatgtggttttgaaataactggctagccatatgcagaagattgaaagcatgccccttccttacaccatatacaaaaattaactcaagatgaattaaaaacttaaatgtaaaaccctgaactataaaaaccctggaagacaaccgtggcaatatcattcaggacagaggcatgggcaaagatttcatgacaaagacaccaaaagcaattgcaacacaagcaaaaattgacaaatgtgatctaatcaagctaaagagcttttgcacacaaaaagaaaatacaaacaaacaacctacagaatgggagaaagtgttcacaaactgtgcatccaacctaggtctagtattaagcatctataaggaacttaaacaaatttacaataaaaagcaaacaaacccactaaaaattaggcaaaggacatgaaaaaatactcctcaaaagaagacatccatgtggccaacaaacatgaagaaaagctccacatcactgatgattagagaaatgcaaatcaaaaccaaaatgagatactctctcacaccagtcagcatggctattactaaaatgtcaaaaaacaacagatgctggtgaggttttggagaaaaatgaacacttttacactgttgttgggtgtgctgaattagtccaacctttgtggaagacagcatggtgattcctcaaatatctattaagacagaaataccatttgacccagcaatcccattactgagtatatacccaaaggaatataaatctctcaattttaaagacacatgcgtgtgtatgttcattgcggcattattcacaatagcaaagacataacatttacctaaatgtccatcaataatagattggataagaaaatgtgctacatttataccacggagtactatgcagccacaaaataaaaggatcatgttctttgcaggaacatgtacagagctgaatgccattactgttagcaaactaatgcaaaaaaaacagaaaaacaaataacacatgttctcacttataagtgggacctaaatgatgagaacacagaacaacccacactggggacaatcagagtatggaggatggaaggaggaagaggatcaggagaaatcactaacaattagtaggcttaataccttggtaacaaagtaatctgtataacaatctcccatgacacaagtttacctatataacaaacatccacacgtacccctgaacttaaaataaaagttaaaaaaattctgtgaaaaaagagaaacagcaaaaagttaaaagcagggaaatgaagttaaggcacagaatttttattagttttcttgttgcttcttttattatgcaaatagtgtgaagttgttaggtaaaataatgagttataagatggcattttcaagcttcatggcaacctcaaaccaaaaaacatacaatggatacagaaaaaataaaaagcaaacaaccaaatcgtatcaccagagaaaatcaccttcactaaggaagacaggaaatacagacagaaggaagaaaagaccacaaaacaaccggaaaacaaattttaaaatggcaagaataagtccttacttatcaaaaataccattaagtgtaaattgactaaaccctccaattaaaagaaatggagtggctgaacagtttttttaaaagcacgacccattgatctattgcctacaagaaacacacctcacatataaaaacacacatagactgaaaataaagggatgtaaaaagatattccatgacaatggaaaccaaaaaagagaatgagtagatatacttatatcagtccaagtatatttcaagataaacactataagaagagacaaagaaagtcactatataatgataaaggggtcaattcagcaagtggatattacaagtgtaaatatccacacccaacactggagcaccaagatatgtgaagcaaatattattagaaatagatagacaggccccagtacaataatagctggaaacttcaacaccccactttcagcattgggcagatcttccagacagaaaatcaacaaccacaaaaaaaaatcagacttaatctgcactataaaacaaatggatccaatatgtttttgcagaacattttatctaagtgccagagaatacacattttttttcccttggcacgtggatcattctcagggatagaccatatgttatgtcacaaaacaagtctcaaaacagtcaaaaaattgaaataatatcaagcaacttctctgaacacaatggaattaaacaagaaatgaataacaaaaggaactttggaaactataaaaatacatggaaattaaatagtatgctcctgaatgatcagtgggtcaatgaaaaaattaagaaggaaattgaaaaacttattgaaacaaatggttttatggcctgtcatatggtctatcttggagaaagttccattcactgttgaatagaatatgtattctgcagttcttggatgaaacgttctgtatgtatctgttaagtccatttgttccacggtatagtttaaatccattgtttctttgttgtctttctgtcttgacaatctgtctagtgctgtcagtgaagtattgaagtcccccactgttactgtgttgctgtctattttatttcttaggtctattaattgttgtataaatttgggagctccagtgttaggtgcgtatttggtcaggattgtagtattttcccattggacaaggccttttaccattatataatgtctctttttgtctcttttaactgctgtcgctttaaaatttgttttgtctgatattggaatagctaccccttcccgctttttgtgtccatttgcctgaaatgccttttcccacccctttaagtttatgtgagtccctatgtgttaggtgagtctcctgaaggcagcagatagttggttagttcttatccattctgctattctgtaccttttaagtggagcatttaggccatttacaagcaatgttagtgttgaaatatgaggtaccattgcattcatcatgctttttgttttctgtgtatttttgttttttgtttttgctttttaacttgtatttttcttttataggtcctgtgagatttatgctttaaataagttctgctttgaagtgtttccaggatttgtttcaagatttagagttccttttagcagttcttgtagtggtggcttgataatggcaaattctctcagcatttgttggtctgaaaatgactgtatctttccttcatatatgatgcttagttttgccgaatacaaaattcttggctaataattgttttgtttgaggaggctgaagacagtgccacaatcctttctagcttgtagggtttctgctgagaagtctgctgttaatctgataagttttcctttataggttacctggtgcttctgtctcaaaatgcttaaggttctttcctttgtcttaactttgtatagcctgatgacaatgtgcctaggtgaagatctttttgtgatgaatttctcaggtgttctttatgcttcttgtatttgcatgactagatctctagcaaggccaaggaagttttccttgattattccaactatgttttccaagcttttagaattgtcttcttcctcaggtacaccgattattcttagatttggtggtttaacataatctctggcctcttggaggctttgttcatattttcttattattttttctttgtctttgttggattgggttaattcaaagaccttgtcttcgaactctgaatttctttcttctacttgttcaattctattgctgagactttccagagaatttcacatttctaaaagtgtgtccaaagtttcctgaattttttattgttttttctttaagctatctatttccttgcatatttctcccttctcttcttgtatcattttttggatttccttgcattgggcttcacttttctctggcccctccctgattagcttagtaactaatctcctgaattctttttcaggtaaatcagggatttcttcttggtttggatccattgctagtgaactagtgtgatttttggggggtgttgatgagccttgttttgtcatattaccagggttggtttcctggttccttctcatttgcgtaggttctgtcagagcgaagattgagggctgaagctgttgttcttatttttttgtcccacagggtgttcccttgatgtagtactttcccccttttcctgtggatatggcttcctgtgagccaaagtgcaatgattgttgtctctcttctgggtctaacctcccagtgagtctacccggctccaggctggtactgggggttgtctgcacagactcctgtgatgtgaatcatctatgggtctctcagccatggataccagtgcctgttctggtggaggtggtggagggtacaatggactccgtgggggttcttagctttggtgatttaatgctctatttttgtgctggttggcctcctgccaggaggcgttgctttccagaaagaatcagctgtagtagtgtggagagggactggtggtgagcagggccctagaactcccaagactagatgccctttgtctttcgttaccaaagtaggtagggaaggacaatcagatggggacagggctaggtgtgtctgagctcaggctctccttgggtgggtcttgctgcggcagctgtggggaatgggggtgagattcccaggtcattggagttgtgtacctaggaggattatggctgcttctgctgagtcatgtaggctgtcagggaagtgggggaaagccagtggtcacaggcctcacccagctcccatacaaactgaagggctggtctcattcccaccatgccccccacaacagccctgagtctgtttctaggtggagggtgagtcgggcttgaaaacttgccggaggcttcctgcctcccagctgcaaaagaaaagggctttagttcttccccgatctgtgaagtctgcaattcggagtcataccctcccctgagttctggccaggaggcttctcgccccattcaagttgttacaaagttcagctagagaagtccttctccctgtggagttttaccgcctgctcctctggccaccatcctgatagatctctgtgatgccaagcaataataggctgcttggggatccagcaagctcccagggtccttctgctgcttcctctacccctgtattcactctgcttggctgtctaactcaactcagctccagataaagttgggaacttctctcacaaacagaccttcaggttctccagtgggggtgtgtgttcaggagaggggtttctccctttcccacttccagagttggagcactcacagtatttggggtgtctcccgggtcctgcaggaacagtccacttccttcagagggtctgtgggtcctctcaggattgctgacttgttcctgcggtcaatcttgagctaaaattcacaatgcaagcttccgcatgatgctctgtctggagctgcaattctgtcctgcctcccatctgccatgatgcctggtctcctctgaatgtcattttaattctctttatataaaatatcacaaaccagacctaaaatttctctcaagaccttttctccattctaatattttctttatggttggtggcactacaattattacagttttatccgtttcataaacttgcagttattttgtatttctccctattcttaactccttatatctctttagtaacaagtcttttatgttactaacctttagattcactggaatttcacatcacttttgttggttcttttctttcctctcagatattttcttttcactcaattttctagacttgtctctttctgccaatctatggaatgcaaaggtaaacaagactttcaaaatgtcctcaaaagactaacaggaaaaaacatgtgtgtatgagtaagtgtatgtgtgtgcctggagatctactgagtttactatcctgcgttaattaactagaaaatctgaacaaaaatatatgaacaattgtctttcaacttgaacaagaagcataggagagttgacctctcagagtagtgaaatccatgaggtgagccttatgattatttgaaggctatttccaggctgcagcacacggactgtaatatggtttggctatgtccccacccaaatctcattaaattcccacatgttgtgcaaggaacccagtgggaggtaactgaattatggaggcagatctttcccatgctgttcgcatgatagtgaataagtgtcatgagatctgatggttttataaggggcagtttccctgcgcaagcgttctctttgcctgctgccatccatgtaagacatgacttgctcctccttgccttccgccataattgtgaggcctccccaaccatgtagaactgtaagtcctttaaacctctttttctttgtaatttacccaatctcaggtatgtctttatcagcagtgtgtaaatggcctaatacagagtgataacctttacatagcaaggcaatcttactgggttgattagaaggatattagagttgggagaagtcaagatagctagaattttaggaatagagtactagagaaaaggaaactgcagagagagagagagagagagagagcactttgaagacctccagatgggtctctgaaagtctgccttattactgctttgtgcatgcataagaaaaaaactacttcaggccagagaaagaattattgtaaagcattagactgaaccattctcagagctcacacagaagctgaggataatatatgtttcaaatattcagaattagaagaccttgcaatcatgcagcatcaagtagagtccttggaagggcaaagtcttagtatgggggctaaatgagctctggaatgaaagatggaaataatctgctttaacaaagataagaagcacacctcaaaatgattcaactaaactcaaggactttgcataccagagcaaagttcaccattatttaaagaaatataacaaaatccagcacctagcaatgtaaagttcacaatatctgtcacccaattaaaagttaaaaagcaggaaaaaaaaaaaaccgaaaagtctgacctataacaaggaaaaaatcaatcgatataaacaaagaaattatggtgattatagtactattcagtaagaatattaaaacagctaatacaaaaatgatccaagtattcaagaagacagagaaaaatgtgaatatgaggataaatattaaagttttttaaagatatgaattgaatagataaatataatatttgaaatgaaaagaacactggatagaattaaaagcagatgaaacacagtagaataaaaattaagtgaacttgaaaacatagcaatagaaatggtctgaaacaaagcacaaagacaaaatgactgggaagaaatgaacaaagcattactgacctatggaacaatatcaagtagcctaaaatacatattagagtcccaaacagaggaaagagaatgaaggccaaagaaatacttgaagaaaaatggacagtattttcccaaattggatgaaaaatataaatctaaagagatcaatggctcaattaaacacaaacataaaaaccatgaataaaagcacatcatgacacagaactttcaaccaataatactatacacagctagtggttcttcagaaatgaagaagaaatacagatgttcacataaaaacaaaaacccctagaactgccttacaaaaaaatgctaaagggagttatttgaattgaaatgaaaggacactaagtaaaaacataaaaacatgaaagcataagactcactgataaaggtaaatatataatcaaatttagtatatttcaatatcataatggtgatgcaaaatcactactacaaaagctaaaaaacaaaattattaaaaagtatagtaaaacaatttgtgaatggatacatcctatggtttgaatgatggtgtccttcccaaaatttttgttgaaactttatccccaatgcaacagtattaagagatatgccctttggtgggtgctagagtcatgagggcttttcccctcacgaatgggattaatattgttgtaaaagggatcaagattgaaaagagagctctcttattcttccaccttcctccatgtgaggataccttgacaatgtgccatcttagaagcagagagtagccctcaccagacaccaatactagtgccttaatcttggatttcccagcctccagaactgtaagaaataaatttctgttgtttatacattactcagtctgtgctattttgtaacagcagcagaaaaagacaaagacaaggcataatatgaaaagatgtaaagtgtgatattaatagtgtactacgcagagaagagggaaaagtaaaaatgtacaggatttaagttaagttgttgtcggcttaaaatagagtgtaacaactatgaaatgttgtatgtaaacctcatgataaccacaaaggaaatacctctagtaaatacacaaaagacagagaaaaaaatcaaagtataccaatataaaaattatcaaaccacaaaggaagaaaaaaaacaagaaaggaataaactaccaaatagtcagaaaataattaacaaaatgacaacagtaagtccttacttattaataattacttcaaatgtaagttgatttaaaaaacaagacccaacagcatgctgtctacaaaagactcactgtagctttaagaatacacatagtctaagggatattagaccaatatccctgatgaacatcgatgcaaaaatcctcagtgaaatactggcaaaccgaatccagcagcacatcaaaaagcttatccactacaatcaagtgggcttcatcccttggatgcaaggctggttcaacatatgcaaatcaataaatgtaatccatcatataaacagaaccaaagacaaaaaccacatgattatctcaatagatgcagaaaaggccttcaacaaaattcaacagcccttcatgctaaaaactctcagtaaactaggtattgatgggatgtttctcaaaataataagagctatttatgacaaacccacagccaatatcatactgaatgggaaaaaactggcagcattccctttgaaaactgccacaagacagggatgccctctatcaccattcctattcaacatagtgttggaagttctgcccagggcaatcaggcaagaaaaagaaataaaggatattcgattaggaaaagaggaagtcaaattgtccctgtttgcagatgacatgattgtatattcagaaaaccccatccgtctcagcccaaaatctccttaagctgaaaagcaacttcagcaaaatctcaggatacaaaatcaatgtgcaaaaatcacaagcattcctatataccaataacagacaaacagagagccaaatcatgagtgaactccctgcttcaaagagaataaaatacctaggaatccaacttacaagggatgtgaaggacctcttcaagaactacaaaccactgctcaatgaaataaaagaggacactaaaaaatggaagaacattccatgctcatgcacaggaagaatcaatattgtgaaaatggccatactgcccaaggtaatttatagattcaatgccatccccatcaagctaccaatgactttctccacagaattggaaaaaactactttaaagttcatatggaaccaaaaaagagccggcatcgccaagacaatcctaagccaaaagaacaaagctggaggcatcacgctacctgatttcaaactatactacaaggttacagtaaccaaaacagcatggtactggtaccaaaacagagatatagatcaatggaacggtacagaggtctcagaaataatgccgcatatctacaactatctgatctttgacaaacccgacaaaaacaagcaatggggaaaggattctctgtttaataaatggtgctgggaaaactggctagccatatgtagaaagctgaaactggatcccttccttacagcttatacaaaaattaattcaagatggattaaagacttaaaagttagacctaaaaccataaaaatcctagaagaaaaacctaggcattaccattcaggacataggcatgggcaaagacttcatgactaaaacaccaaaagcaatggcaacaaaagccaaaattgacaaatgggatctaattaaactaaagagcttctgcacagcaaaagaaactaccatcagagtgtacaggcaacctacagaatgggagaaaatttttacaatctacctatctgacaaagggctaatatccagaatctacaaagaagttaaacaaatttacaagaaaaaatcaaacaaccccatcaaaaagtgggcaaaggatatgaacagacacttctcaaaagaagacatttatgcaggcaacagaaacatgaaaaaatgctcatcatcactggccatcagagaaatgcaaatcaaaaccatagtgagataccatctcacaccagttagaatggcgatcattaaaatgtcaggaaacaacaggtgctggagaagatgtggagaagtaggaacacttctacactgttggtgagactgtaaactagttcaaccattgtggaagatggtgtggcgattcctcaggtatctagaactagaaataccatttgacccagccatcccattactgggtatatgcccaaaggattataaatcatgctgctataaagatacatgcatatgtatgtttattgcggcactattcacaacagcaaagacttggaaccaacccacatgtccatcaatgatagactggattaagaaaatgtggcacatatacaccatggaatactatgcagtcataaaaaaggatgagttcatgtcctttgtagggatatggataaagctggaaaccatcattctgagcaaactatcacaaggacagaaaaccaaacactgcatgttctcactcataggtaggaactgaacactgagaatacttggacacaggaaggggaacatcacacaccgggcctgtcgtggggtagtagggggagggatagcattaggagatatacctaatgtaaatgacgagttaatggatgcagctcaccaacatggcacatgtatacatatgtaacaaacccacacgttgtgcacatgtacccttgaacttaaagtaaaatttaaaaaaagctagaaaaaaaaagaatacacatagtctcaaagtgaagggataaaaaaagatattccatgaaaatgagacagagataagagatggctacacttgtatctgacaaaacagactttcagtcaaaatctatgaaaaaataccaaaacatcactatataatgataaagtggtcaattcaccaagaggatataacaattgtaaatatatatccattcaacattggagcacctgaatatgtaaaatgaatattaaaggtcactacagtactccactttcagcaaatgatagattatccacacagaaaatcaataagcaatcagtggacatgaataacactacagatgaaatgaacctaatgaacttaaagaacattccatccaacaggagcagaaaacacattcttctcaagtgcccataaaatattctgcaggatcaaatgttaggatataaaaaagtcttaacaaatgtaagaagattgaaattatatcaagcatcttttctgaataacaggagaaattttgaaaaattcacaagtatgtgaaacttatataacacatcccccaaacaacaaatttttcagagaagaaatcagaaagggaaataaaaaataatcttgagacaaatacgaaaatacaatatactaaaccttgacagatgcagcaaaagcagttctaagagggactttttagtgataaatgcctacattaagaaaagaattgtggtacaactctacaacaaaatgctattcagcagttaaaagtgatttactactgacacatgctacaacatggattaacctcagtacgaccatggtgtgcaaaataaggcagacacaaaagcctgtatactgtataaattctcccaaatcaaattctttaaaaaatacatagtgacaaaaagtgggtctacaatttgaaggcacacagctttggggaagatagtgactgcaaaggagcacaagagaacttttgacatgatagaaatgtgatgtaaaatcattgtatatgattgtaagattttatgaagctatacacgtacagttaatgttattgtatgtggttgtacataatacaataaagttgaaattctgaaaattaaaacaagtcaggatggaaagaatgatacagtaatatctaacagttttttaaattatctcatctatgctggatatcatgccaggtattccaagtgtattattctattacatacccacaatagccctgcaagagagaagtaatactattttatttacaggtaaaaataagaatttatagaaattaaataattacactaagccatacattccataatctttagacccagaatttgcacccagatttgtttgctatcaaaggtcatgctattcatattttgctagtatatctctaagtataaattaagaataataatacagcatattgtattataaagtaaaacaagaaaagaaaaatatctagtcaaacaaagaaaccaaaaaaaatgtttaataaaatgaatgcataaaattatcagaaagctcacctcacatttaggcccttttatctaccacaattaagttcaaaagcaacttacttattagcaagatttataaaacaaaatctacacaaatgcatgaacttgtctttatatgtcttagtattttgcaaagtgtaatatagattcttggtaaacattgaagatcagtaatattacaataataaaaactaaggacatatatgagaaaaaaattctgccagcaaatgaagacattttcaaggtaagttatgaataaaactagcaaacacttcaatttctttttgaattaagtacttagacaggaaaacgaattttaaatgtaggtgactgcgaataaatgaaatctcttacataaacaactattagcaaaaagctaaagtccttggaatatctgaacttgcataactgaactattcctgtctgaatactcatcgggtggtgagaaaattgattaacatagttattcgaccatttatactaatttgataaggctccagaagggtataaaattaaaatgtggtagtcttaaaacagaatatcactaaaaataacgatgggggaattgacaagtttctttaagatccctctgccattctaatgtcctctccattccagtttcatagattacgggagacaaaaagagaatttgcaggatcatcagaaaatactaaccttgaattggaataaagagaacaacaaaatacagaagtagggctgaaagaccttaactgcggatatccataagaatccaagagactacttacaaaggcataccacaatgaggatttctctggacatgtccacatataaagaggcacttcctcaatatgtggaattgagtcccaagagcaacaaacacctgattacttcttaagattcttgattagcagattccacattagcttcccatgtgaactgtattggtacaataacatatgccaaaccaagctctaatatattccctctagggtcttttcaattttttgatttttttttatttctctctttctccctggggaaacaaattaggttatgagtgtgtttctgagctagatctttacaacaaagacatggttattaacttttaatcaaaaccccataattgccgggcgcggtggctcccagcactttgggaggccgaggcgggcggatcacgaggtcaggagatcgagaccatcctggctaacacggtgaaactcctactctactaaaaatacaaaaaaaaattagccgggcgtggtggcgggtgcctgtagtcccagctactctggaggctgaggcaggagaatggcgtgaacccgggaggcggagcttgcagtgagctgagaccgcgccactgcactccagcctgggcgacagagcgacactccatctcaaaaaaaaaaaaaaaaaacccataactgtgaatggcatcccagtagctataaggataatttaagttagtatattgatggaatataacacagtcgtgcattgcttaacaatgaggatacgttctgagaagtatgtcgttaaatgatttcattattgtgcaaatatcatagagtgtacatacacaaaactagatggtacaacctactacacacctaggatatatggtatagcctattgctcctcggtgacaaacctgtacagcatgtgactgtactgaataacagaggcaaatataacacagtagtatttgtgtgtccaaacatatctaaatacagaaaaggtacagtaaagatatggtataaaagataaaaactggtacacctgtataaagcacttaccaggataggagcttgcagaactggaagttgctctgggtaagtcagtgagtgagtggtgagtgaatgtgaagggctatgacatcaccgtacagtactgtagaatttataaacactgtacacttaggctactaaatttatttcaaaattaagtaattgtgctacagtgttatgatagctacaacataactaggcagtagggcagtagaaattccccagctccattataatcttaggggactactgtcctataggtggcccactgacattcaggactgtatttataatcaagatttttttaaaaagttaactacattcaaggaacacatattccctctcaaccaaaatccaacagaagtccctctttaaaaatctgaatctattgtatttaaggggaaaagtaagttctgctgcttgaagacaaaagacagtaattggaaccataattataaagcccagccagctttgcaccacaattagacccctgaatcccaagagatctagctgaagcactccaaatgcttatcaagatacaaatatgtttgatggatttatgtcctagtaaattctaaatctaactagatttacctaggaattagatctaaaaataataaaaaaataacattccttagagcattaagacagtgtttctttcctcatgagttttgatagtttggtcaagttggattcacactatgatataccaggtttacacctcaggaaaggagcagttggttattttccacagagcagtcacattaggcctcctgggaaaatgaaatattttactaatctttataacatagtacaagctgtattttaattttaaactattccttgatgacatttgggtaaaaagacaaaaataagataaagagcttcataaactctaagatactatataggtgaaaattgtagtcactgttattgtttttgacacgtttactggtcaaagaccatatctatgcaatctttttccctacctcactcctgagaacaaaacaggttccatgtagaattttaatacttacacactgcagtatgtttttattggattggctgtgtttaactatgttaactgctctataccctgaggcacaagcacctaatttattttaaaaattacttaagcataagtaataggtatgtagtcacaataataaaaatcaaataagtaaatttaataaattgacatatgctttaaattaaaatatatgggcatgttacttattaaaaaagtaacacaaatgataaatccttgaggcgatggataccccatttaccctgatgtgattattacacattgcctgcctatatcaaaatatctcatacactccataaatatgtacacctactatgtacccataaaatttaaaaattaaaaaaggaaaggattttatatttcatgtgattaatatttagattctattcttgagtcctgcatagtgtgactaagttcatctgttaatggccaactgttctattacagaagatatccctgttagtgactaattattgcactgaccatgtgtagtaattggtttagcatttcaaacgcttggaaaaaaaagcttgttttttgttatagcactctcacaggacgtagcatttccctcgttcagtctaactttcaggttatttcaaattacagctttatagaagtatatactatgtctggcgtcagagacggtcagccaatcattttgcagtaatagtttcttggcatgttttttggtcacaaaggatatttgtttcatgtgactttaaatgaaataaaacaatttcaaggtctagagtgcaggtttctttctataatacagcatgagacactggtctgattcatgctaaaggaagttggtagctgtacctaccagggaccataagaaatatgtgctgtaggacaaacttacctatatattagtgccatgtagtactgtacatctatatcaccatcacccagaaagaacaactggaaactctgagggtggaaaaggaaaaagggacagagaattgtgtcttaatatagaacaataacacagaaagtagtaagattatatagatagttgttttggtcaccttaggtcacttacaacgacctcatatacatgtctgtagctatgtcagaagaaaaataagaattgcactacagccacgaagaacaaaaaacataattttccctattcacaatgcttttgagtagtgctgtatccccaggcttccctgttttatttatttatttatttatttatttatttttgcaaggctgaataagtttttcctaacagcagcaggttttttcatgaaccactagatgctaaactgtgggcagcttcttataactacccaggtcatacagggctagctgtgtgctgggtcaacaagcaaggttatgttcagctcagtgagtagctagatggtagtgtcataaatcaggagttctggggctttctgctagagtcaatatgacctcttgcaactgaggtctattcccattcagatacagactaaactctgataagtcacagatccccaaaatatcatgagaactttacaaacagtctctcatttctaacctcattttctggtagagttttctttgaactcttttctcattactaaagtaaggacttttaaactggaaaatagtcaatactttggatcctggggtgtacttgggaggctgagaaaattcataatatgtattttaaaatttttctgaaccttttctaccccaagatcctttacttaaaagaaggtaatccctccaaaaataagctacctactcatagtatcctttcagcttattcaaatggtgtaattttgaaatattcaacaaataaatgatggctactatttttgagtatactatcacagttggctaggactgtgtcatcaacaaatcccagcctcatctcttcttctaattttccaagtagtacttttctttggaaattaagatcagagttaaaagaggtctagaaagcaacacagttcacccaacatttgtatatgagagcaccttaaagacattttttggtgtttggaaactctaacacttagaaaacattagtaagggagtggtggcataaattcattacaagcacactttactatgtttctactggatatagtttttgaaaaatataaatatagtttttttataaatacaaaactcactcttcacacagattagcaagtactatagctttgattcagcaagttttatatttcagtagagagaagccatcacaggtaaagtttcgtctgcctcacaacactaagaaatcttgcaagatgacacaaaagtaaaatagaaactctatcttaatgctttttggcttgaacgtgtatgcatctttctctataaagaatgtcatcttacttatgtgttgctccaaatgtgtctttgtaatttccttacacacatgacagaacttatcaccatctgttgaacctagaggacacatcaaaaactgaagaatatgtgaatacacttataaaagtacatcaaaatatacatgtatatggatattcattgcagtattattcataatggtaagccatctaaatatttatcaacagtggaatcattaaataaattatgatatttatactttgttatgctttggatctatgtctcaccaaatctcatgttgaattgtagtccccagtattagaggtggggcctggtgggaggtggctagatcatgagggtgaacttctcatgaatggtttaggactaccctcttggtgctgttcttgtgagatcagtttgtaaagtaaaatgataaacagctattaaatatatacatatatacaaatatatgtatatactgatatagaacaattctcaagataattttgataccttgtgcagtgtgaaaatcagtctgcaaaatgctatatttagttttgcaaaaagttaaaaaatattatatacacaaaattttctcaccatatgtttgtattgctttaaaaaataattctatctgaatagacttttctcaaaagaaaacatacaattggtcaacaaatatatgaaaaaaatgctcaacatcactagtcatcagggaaaatgcaaatcaaaaccacaatgagatattatctcatcccagttagaatgtctatatccaaaaagattaaaaaataacaaatgctgggaaggatgtagaggaggaaactcatatactgttggtgggaatgcgaattagcacaggcaacatagaaaagagtagaaagagtactcaaaaaattaaaaatagaactaccatatgatccagcaatcccattactggatatttatccaaaggcaaagaaaacaatgtatcaaagagatacctatacccccatgtttattgcagcattattcccaataaccagaatatggaatcaacctaagtgtctaacaatgggtgaatggataaagaaaatttggtatatgtacataatagaatactactcagccataaatagaatgaaatcctgtcattcttagcaacctgtatgagcccagaggacattatgttaagtgaaataagtaaggcacagaaagataaatagcacatgttttcactcatatgtagaagctaaaaaagttgatctcatagagtagaattacggttgctagaggcttggaaagagagaaggagggagaaaaggcagagattggttaatggatacaaaataagaaataaattctagctttggataacactgtagggtggcgaggtaaactataatttactgtattttttcaaaaccctagaagagaggattttgaatgatacatgctttaaaagtgataaaggtttgaggtaattgttattctaattaccctgatttgatcattacacattgtatacgtgtatcaaaatatcacactgtaccccataaatgtgtacagttatgaattacttattaatcatgtgtcaattaaaaataaataaatgacactatattaagatgagctatatggataattaaattataaaatgtttttctttgcgattttatacgttaaaaataacattaataaccgatattttaaaatacattaacagtcactgaggagtcccactaggccagaaatccagtgtaccagattatagggatttccttttaggaaacttgaatgtatctgcaagtcataaacagttgaatacatttcctggattttctgaacaagtcccagaaagactccttcagcagtctctaaaggctagctgttagtgggtagaaaagatggtgcagatctcatcctgactcagcacatgctaagagctaaactgtctgtcaaaaggaattctttataaaataaaatttaaaagctgagacttaaagtgtacactaatgacctggtaattgtcttaatgacttttcaatgaagtgtgaaattctctgttaacatgtcaacagagtgtgaaatattttacaagcatggctttattataaaactgtgtacttgctgtgtagtctactagtaatccttgttgcttatccagtaaatatttctggttatattctgagcacttagccaattaacatttatattggctggtaatcttttttccattttttcatttgactgtttgtactgtttgtctatttgttaaatctggggaccagagaagactctcctagttttctttgatgacaaatatctcacttgggtgactccaagagaaaaaaacagtttcaggtacagaaaaattaaaatgcttaaccaagttatccagtaatgatattgagataataaatcagacttcctgacctccattcttgcacacatatcatgacttcattctagatatcataggataaggcaaaattaataaataaaacaaaaaatgcattttatttttatattatgcaattaaaacatgaagaaaattgaataaatgatataaatattatttgctgccccattgtcaggattttgcatgatacttctttagtaaatgggattttagcagaagtgacaacatgcaagttgacagcagatcttttacatgcaatcatattgtttgattttctctcccctgccctccactatgagactagcatgtccaagataggagctatttttcagctggtgttctagaaagagaagacataaggagcatagattcaaacactcatagacttgcaaaagagaaatattttgtgctgtaagacactgaaatttgggggtgtggttaactccagaaaaagctaaaagacatacttgcttactattgttttagatggtcaaagtttatttagttttatgcctatgtttattattcccttataactgtttctttgatacttgtccttccttctgggatcactttccttcataaagagaagcccgtagaagttcctttagtgaaaaagttattagtaaacttcaaagtttgtttgttggaatatacctctattctgctataatgttttagagattcttttgcttaggtataaaattctaagtcaacagttacatattgtcttgactcttgactctttagatattatttcactgctttctggcttacagtgctgctatcgagaagtcatctgacaatcttattgtcctaatttttttttttttttgcctccctggcttctttattgttttccttagaatcctaaaattttagtatcaaatgtcaaattgtggatttgtttgcatttatccttcttggaatccattagccttttgagacattgaaactgaagattcacatttcttatcaattctaaaaaatggtcaattatttttccaatattgcctttccccaacttctctattatctttatctgcttctcaaattagatgtgtattgaatcttctcactctagcatttatgacccttaatctctctttcatatttccatcattttttctatctactgcattgtctcatgattttcatatctaatctgcagcttttttattgtttctgtgcctaattagtgatttaactagttcattgaatttctaatttcatatgtacatatatacatgggtatatttctggagtcctatctggttcttcaaatctgcatagtcatttttttaaagtcacctactcctttgttatacgtttaatacttccttttatttcttcaaaaataataagcagatgtattgtttattctatatatgttaacttcaatagatgcagtttttctaaatctgcatgatatgatttattttcatcaagttctttttaaattatttattttttatatttatagatttacggggaacaagtgcagttttgttacatggatacattgcatagtggtgaagtctgggcctttaatgtacccatcacttgaatagtgaatattgtacccaatagataaattttcaacccttacacccctccctcgttcccatgttttggagtctctaatgccccttattttactctgtattttcatgtatacccattgtctatcttccatgtataagtgagagcatgcacattttaacccaaattatatttccagaaatcagaagctccagagacaaatcttgctccactgcttcctttcctctctaaatttgtattttctcatttttttctagccttaactgatttagcttactttctgacccattcaaccatgtatttacaatgaattttatctgccttccataaattttagatgttctacaccaggagtcttccctgtgtatctgatatgccatagttagagaatcaaaagacttaacaataacattcaatattaaaaatttctatattcctgggttaaacctcacttactcaggatatgtttttaaatatattaatgtagctagattactaatattttactaaaaggtctgcatctgttttcataaactagattggtctcattttggcttttatctgtaggttataatagtttcataaatgagttgtaaaatgttccttctttttttttacatgctttaaaacaatgttcaaaagataagaaataaatattcattaaaactttggtaggcctcgagggttttctttggggagtttctgatgactcatggattcactcagttcctatttattcttgatttggtttcaaaatattaaatattctatacatttgtacattttgtgtatatttttaaataaactggcaaaaacttcacatagtattatcttcttattttaaacatctgtgatttatttatacctatgtttcttaattatttttatactggtcttcagtgacttctctttttttcttcatcaatatttcaaaatgtctactttattactattttcaaatatacacctttattttgttcattctcttttttatttgtattaatcacattataaattcttgttctttcttttatcactttagtcctttttctttgagtttattttcatattgtttttctaacttcttgaattgcatgattaattctctgtattaaaacttactttctgttgcatacacttaacattatccactcccttttgagtacaattttaatttccacaaagttagatgtgaagtatttttattgttttaaaattacatttttcttattccatatatgctatttcctttgacccatgaattatttagaagtgttttcttttcaaatgaataacagtaagttggtcatatttttatttttttatttcgaatgtaagtgcattatggtcagagaatatatttgttgtgcgttgagacttgatttatagcctaatatttggtcaatatttataaaagttccatgtgtgtttgaaaataatgtatatttcctaattgtgggatataggattatatgtatattcattaaataaaattctttaaaatgtggttaagatttggtcgattcaatgtttttaaaatacttgatcattcaattaagggaagaacattacaatatttcacgattgtaatggatttgtcaatttctccttgtagctttgtcataattttaaaaatatatgaagctatatgtttatttgcatttatatattccaaagttatggtatcagctacatacaaatccagaactattatgtctttgagcagaatgtgaccatttgtcattatgtaataatcttttttatctctaataattattccatatagtctattttattttatactaatatagttacatcaaatgtattttttagtgcatgcctgatacacctttcccatccatttgttttcaacctttccacatttttaaagtttaagtgtatcatttataaacagtatataactggatttttttttatctacctgatgatctgccttatatctgtataaatccatttatacatattcattaatgacatgttgatttatttttccaatctgattttgtaatttttatttttcacgctatcctttttattgttgttttcctcctttatgccttctattgaattgatcaagctttgttcaggcccttttttctcctctcttagtttacaaccatttaataaacttctgaattttttgtgattaaccttaaatttttaaccgtcatattttaccttaaatatttaaagctaatgcacacctttaagttcctccaaaataatagataccttttagaactatttgattctattaagtacccttctatctttcatccattctagtttttctctccttatggagctattaggtatgttataattttccaatctgtcttccatatctcttcaacttctttcatatttgtcatattttcatgtctctgtgatgcactgtaggtcattttcaattatccaccttctgagtaaatagttttctatttaggtttttttcattttgcttgtccattgaatctcatttttttaacattctatgtagtattttatttcaaatttgactattattttttcataatgttttcttctttccatgtggtttctatttttttaatttttttattaacctgcacttaatttatgttttttcatattgacctattatctcatgttctgtgcttatcctcctaatttgttgtgactgctgactttaactgaagatacattattgttttgtgcatattgtcatttttcatttccttgttttgagctcattttcagcagggataatttttctatagaaaattcatgggaaatgagtgttgcttcttcttccacacgtccttgggatatgtctgacctgagatttatctccatgtatttttttttttaattttggtgactctctaactttatggaaacagtaccttcactctttaatagtgtatgtagttcatctttatagtttcagtttctcaatgtttagtacatttttccgccaagagtctaaggtaaggcaaataattttgtcctctctcaggagcattgggaaaaacttttctagtttccctgtcacttagagtacaactcttcaaaactcagttttattcgggggtcttaggtccaagctctcacctcatggaggattaaggcttaatttctgtctatgcatgatataaaaacccaagcccctaatgttagcacttctaagtttgactaacaaccctcttgtatacttcctaagtcaatgtctttcctctgcctttgaatcttctaagacataaatacatttatgtctaacatttcctttttttttcatattcaggggcagaatatgacccagttgtatttccccctgttgtttctctgtgcctttcaggaagactcaacttaacctgcttcttaagttggtccattttcttttctgacatatgtagaactggtattttttattgaatttaagtgttctctttccttttgttttctatttgatttctgatacatatatttgttttaataacatattcatctaaatttcatttttcacatagtgaaagatatgaaatcaacaaaagttgggcctgtcaaatgtatctactcttcagacaaatcatgtccacctccaccttctacacttaaataatagtactcaagagatgttctcccatcagatcaatgtctaacccaggtctgaacttgaacgatcattatcctgtttcaatcccctttaacatgtctcatttttgatatgcatttcttttgagtcctaattcattaaatttctcaaacttcttctcttggaatacatgttataactaaatttttacctcaaataagtgtactgccttgaaactcccctaataattccttaatactatttttcacagatctttctacttttgtctcatcaaaaatgtccagattttctgtaatcacttggtatagctgcccttaactgtaaattgctttccccattactcttcccaccttccacccagattctttatctgcaagctttcaataatctcctggattctggccccctactggagaatcatatacctgattgttgtctgagaacattcatcttttcctctgctagcttctactgggatctagtcactctttctggtctggttaaaacttggatactttctacttaagaaatttgctatgcagagaagttagatatgaagcaatctttatttccctcttatatcgttctattctggccattgagaattcagttttcctttcacaaaaatagggtctgttatgctaagagctttatctaccttctaagtaaatcttttaattatttttatttttctattgcccttattctgttattaaaattgaagcatacttttcaaataactctaaatccttcttgattccctagacaactctaattcccatagacacaatcccaggaatgagctttattagtttccctcatatatttttatttttaatcatttcattaacttgtttctctacctcaaactatgaaggcatgttttctttacaattcatttgttggtttagtaataaaacctaccgcttttcttcaggtaaagtctcaagttgtgtctgtaatctaaagtcataatttaaatgtaagaaaataatatatctagactcgatttaagaccatttgatgggaagatggcaattgagttttagtgtgggcccaatatatgaattcaaggttaccactatcacactttccttcttaaccccacgtacagaaaacaatttggagaagtcagtgtggcactctagcctccatgagtttggtactaacaccttaaagttagaataaaacacactagtcttctgaaatgcacatgcatttagtatacttgcttgtaaagagctgagaaacaatgaaatagaagtcaataatctttgtctaaacagctgatatccagaaagactcttctttgaattcttgattcagctattctttcttactaaggcctctgcaatactcatgcatctgctgaagatcacatgaagccccatacatatgcttcagccaatgtttgtatacttcagagtcaaataggcatagactgaaaacctcccaccatcaccatttgaccaaaaccatctgtaatataccatatcagactaaacctccctggcctgcttcttggttgaggcttgtggctggcctcacattgctgccaacccctacattgcagaaatgctcgattttccttaaggtggaagagactcacttttcactcaaggcagctattttaataaaaagcataacttgcatctggataaagctgcctaaactgtggtgactcatggtattgaacatgcatttttgcttaacaaattattattggattattgtcttaaatttggtacatttattacattacagtttctgcttagcaggaacctaggcatggtttgaatgggtcatctgtctcagggtgtcccacaaaaatgcaatcaagatgttgcctgaagctgcggtctcgtctgaaagtttaactgaggaagcatccacttccatgttcactcctatggtcattggcatcattcagttctttgtcagctgctggaatcaaggcttcacttacttgctgactgttagatgaaagttgccctcaatttcttgccacgtggacctccccaacatggcagcttgcttcattaaaacatgcaagacaacagccaatagggaaaatgctagcaaaatgaaagtcacatgtttttgtaacctaatcaaggaaatgacatcctatcactttttgtatatctatttgttagaaacaattgctaggtgcagctcaaaatcatggaatgagggaatacacaagggtatgaatattagaaggtagggatcattaaaagggtggcccaataaaagccattacaaactgccaaagtaaaatgtccagtcaacacactgaagttcaaagccaaagttgtctaccctggtcataaatatgttattttggtcgacaattctgttgtcccaaaatttatcagggatctcagtctaacacaccaaaattggggtttaagagagctctagtttgtatttttctgtccacaatctgaacatgtgaagagaaatgattgtaagacagatagcactcaaaatgttacttttgttactattatagcttatattggaaaatgtagcttatatctgtcatcaagttgatttcctattattgaattccacaggtttctctacccagtcttggtgctgttagactagcatacatttctctcacaggagcaggcccctttagagtatttgaaggatcagagcagaaaacctgctctctgtagatatgttcacttctaagaaaataatagaggaaatgctagggatgtataggctctgtttatttaaacttaacaataaaattaagctaatcttcctctcctgaaaaggaataagagaggttgttttcttcactatgaagctttcttcattgtaatggaaactttaagaaataaagtttttccacttaacaacagtagataaaaggaagaattattttacaacttaggctaaaattttctgttaatctgtgccacacctttacattctgtgactaaagatagaaaataaaaaactgtcttaatcaaagaaaaacaaaagattttttaaaaaaaatcactgggacctagaacaatagattaaaagtcaagaaacatgtggtctattccaacaccatgcacaagttaataaactgccaaagtttcaggttcctcaatataagggtaagtatgaactcatttatagggatacaaatgatttacattagataagtgattctcagtgtagaagaggaggcattactttctaggtagggaagtgacttctttttcccataatatgataaattggatatcctgaacaatcttccttgtgaaaataaatagaaaaccagaataggcttgcagtcacttattttaaaaataatgcaagttaaatgcctttccacaataaaaacttcaacgtttgatgacttcactggcaagttctaccaaatgttaaagttccaaataattataatatcaaataagcttttccacaacagcaaaaagaaggaaaactccacaaccaatgttatgacctagatggacctggatatcaaagtaaagacagtttgaaaaagaaaaggcagaagcccattttactcatttatataatgggaaaatcttaaaatattagcaaaacaaaacaataatacaatttaaaaaatgatatgaccacgttagatttattctcagatcaaaagattgggtgaatattagaagccctattgatcaatatagtaagatgtaatatgtttcattacattataacatttatgaagaaaataatatgaatatatcaacatgtgaataaaattgaaaaacattgaacatctgttcacaaaaaaattagggtaggaagagaaggaaacatttttaactgatgaaaatatctacaataactaagcttagaacaaacttaagagtggaatattatactcttcataatcaggatcaaaacaataattcctagttttaatatttctattcagcattttactggaagtcctagccagtgcactaaacattttaagacaaattagaggaggggtggggcaacaatgcagaatagaaagctccgccaatcattccctctccaccccttggtaggtagattaacttcacatcactgaagtggtgggaaaaactcttaaattactggctaaacactcccccattttccagaagtggtggcatggtgcagagagcatttctgaatgctaggggcaagagaacacaccaattgtgaggcattgaactcagtgcagaccttgttatagcagaaagtaaaactggaccaaactcagctgacacccattccaaattgagtgcccgcaagtcttgacaccacgggctaaagtgcttcagggcctcatataaacttgaaaggcagtctacaccatgagggctacaacacctaagggagtgctagtcttgaaatggacccagagccagtggattttggggggtatgtgtactactgagacactatctgggatggctaagggagtgctgccatcactcttccccaaaccccaggatgcacaactcatgattccaaaagagacccctcctttctgcttgaggaaaagagatgaaagagtgcagagaactttgtctcatatcttggataccagctcagccacaacaggatagggcacccgtcagagtcatgagattccctctccaggcactagtccttggatgatatttctagatgcaccctaggccagaaaggaacccactgccttggaaggaagaacccagtcctggcataattcatcacctgctaattgaagcatccttgggccctgaataaccagcagtgataacccaggtgctatgttgagggccttgggtgagactctgagtcttgctggcttcaggtgagactcagcgcatttccagctatagtggctacagggtaagactcctttcacttgaaaaaaagttcaaggaaaagtaaagatgactttgccttgcactttaggtaccagctcagccacatgggggtagagtaccaaacaggcacttggggtccccagtttcgggacttggctcttagatggcatttctggacctgcccttggccagaagggagcccacttccctaaaagatgagcctcaggcctggcagcattcatcacaagctgaatgaagaatccttgggatttaaggggagattggcagtagtctggcagtactccctgtgggtgtaaggtggcgatggccatggggtaaggatcctctgcctttggaaaggggaaagaaaaataggaaggactgcatcttgttgtttgagtgtcaatcagccacaatacaatagaacacagggtagatttccaaggtttatgactttagtctctggcttctggacagtacatcttgaccatcctaaggcctggtggaacttgttgccctgaagggaaggacataggcctgactagctttgccacctgctaactgtagggtgccagaagtttgaacaaacatgggtagtagccagggagtgattacagcaggcctcaggtgagacccagtactgtgctggtttcaggtctgaccctgcacaatcttatgggtggtagtcacagagatgcctgtgtcatcacacctacaactccaggctactcagtacagggagagaaactttgattgtttggcagaaagtaacagaagagaacaaatatctctcctgtgtaatccagagaaatcttcaagaacttgttcaagattatcaaggtggtacatctaagaatgtggaagaatcacagcattactgggcttggggtccccactaaagcagaaacagcctaaatcacaaaatctaagtcctttcgaatatctggaaagtgttcccaagaagaatgggtgaaaacaagctcaaactgagaagacaacaataaatacctaactctttgatgcccagacacagatgaatgtctacaagtataaaaatgatccaggaaaatatttcctcaccaaatgaactaaacaaggcatgagggatcgactatgaagaaacagatatgttgcctttcagacagagaaagctattcaaaatagctatgttgaggaaactccaggaaatccaagataacacagagaaagaattcagaattctatcagataaatttaacaaagatattgaaataactacaaacaatcaagcaacaattctggactgaaaaaaatgcagttagcccacttgatcatggtggataagctttttgatgtgatgctggatttcgtttgccagtattttattgagaatttttgcatcaatgttcatcaaggatattggtctaaaattctcttctttggttgtgtttctgccaggctttggtatcaggatgatgctggcctcataaaatgagttagggaggattccctcctttttctattgactggaatagtttcagaaggaatggtaccagttgctccttgtacctctggtagaattcagctgtgaatccatctggtcctggactctttttggttggtaagctattgattattgccacaatttcagagcctgttattggtctattcagagattcaacttcctcctggtttagtcttgggagggtgtatgtgtcgatgaatttatccatttcttctagattttctagtttatttgcgtagaggtgtttgtagtattctctgatggtagtttgtatttctgtgggatcggtagtgatatcccctttatcattttttattgcgtctatttgattcttctctcttttctttattagtcttgctagcggtctatcaattttgttgatcctttcaaaaaaccagctcctggattcattaattttttgaagggttttttgtgactctatttccttcagttctgctctgattttagttatttcttgccttctgctagcttttgaatgtgtttgctcttgcttttctagttcttttaattgtgatgttagggtgtcaattttggatctttcctgctttctcttgtgggcatatagtgctgtaaatttccctctacacactgctttgaatgtgtcccagagattctggtatgttgtgtctttgttctcgttggtttcaaagaacatccttatttctgccttcatttcgttatgtacccagtagtccttcaggagcaggttgttcagtttccatgtagttgagcggtttttgcttcaaagagaataaaatacctaggaatctaacttacaagggacatgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccacattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagcaataacaccacatatctacaactatctgatctttgacaaacatgagaaaaacaagcaatggggaaaggattccatatttaataaatggcgctgggaaaactggctagccatatgtagaaagctgaaactggatcccttccttacaccttatacaaaaattaattcaagatggattaaagacttcaacgttagacctaaaaccataaaaaccctagaagaaaacctaggcattaccattcaggacataggcatgggcaaggacttcatgtctaaaacaccaaaagcaatggcaacaaaagccaacattgacaaatgggatctaattaaactaaagagcttctgcacagcaaaagaaactaccatcagagtgaacaggcaacctacaaaatggaagaaaatttttgcaacctactcatctgacaaagggctaatatccagaatctgcaatgaactcaaacaaatttacaagaaaaaaacaaacaaccccatcaaaaagtgggcaaaggacatgaacagacacttctctaaagaagacatttatgcagccaaaaaacacatgaaaaaatgctcaccatcactggccatcagagaaatgcaagtcaaaactgcaatgagataccatctcacacaagttagaatggcaatcattaaaacgtcaggaaacaacaggtgctggagaggatgtggagaaataggaacacttttacactgttggtgggactggaaactagttcaaccattgtggaagtcagtgtggcgattcctcagggatctagaactagaaataccatttgacccagccatcccattactgggtatatatccaaaggactctaaatcatgctgctataaagacacatgcacatgtatgtttattgcggcactattcacaatagcaaagacttggaaccaacccaaatgtccaacaatgatagactggattaagaaaatgtggcacatatacaccatggaataccatgcagccataaagaatgatgagttcatgtcctttgtagggacatgcatgaaattggaaatcattattctcagtaaactatcgcaagaggaaaaaaccaaacaccacatattctcactcataggtgggaattgaacaatgagaacacatggacacaggaaggggaacatcacactctggggactgttgtggggtagggggagaggggagggatagcattagtagatatacctaatgctaaatgatgagttaatgggtgcagcacactggcatggcacatgtatacatatgtaactaacctgcacattgtgcacatgtactctaaaacttaaagtataataataataaaagaaaaaaaaataaaattcaattctatgtcacctaaaaaaaaaagaaaaaaatgcagttagcatactgaagaataaattcagaatctttaatagcagaaccaatcaaccagaagaaagaattagtaagcttgaagacaggcaaattgaacatacacagtcagaggagacaaaagaaaataaggaaagacaataaagcacacctacaggatctaaaaaaaaaatagcctcaaaatggcaaatcaaatagttactagctttaaaatggaagtaaagggagacataggtgtagagagtttactcaaggggataacagagaacatcccaaacctagagaaagatattaatacccaagtatatgaaggttatagaacaccaaacagatttaacccaaagaagactactccaaggcacttaataatcagactcacaatggtcaaggataaagagggatcctaaaagcaacaaaagaaaataaacaaataacatataatggagctccaatgtatctggcagcaaacatttcagtgtaaaccttacagcccaggacagagtggcatgacacatttaaagtgctgaagtgatatggtttggcagtgtcctcacctaaatctcattttgaattatagttcccataatccccacatgtcatgggagggacccagtgggaggtaatttaatcatgggggaggttaccctcatgctgttcccatgacagtgactgagttctcatgaggtctgatggttttataaggggctatttttcccttttgcttgccatttttccttgctgccaccatgtgaagaaggatgtgtttgcttcccgttccaccatgattctaagtttcctgaggtctccccagccatgctgaaatgtgagtcaattaaacctcttttctttataaattacccactctgtggtatgtctttattagcagtataagaatgaactaatacagtacattgatgccaggaatgagatgctgctataaggatgctccaaaatgtggaagtgactttggaactgggaaacaggcagagattggaacagtttacaggacacacaaaacagacaggaaaatgtgggaaagtttggaagttcctagagacttgtcccagcagtaacccacggaacttccctaacatctgccatacttctcctcacataacaaaaactgaatggctttgaccaaaatgatgatagtgatatggacaatgaagtccatcgtgaggtggcctcagacggagatgaggaatttgttggaaactggagtaaagtcacttttgctatgcagagactggcagcattttgcccctgccctacagatctgtggaactttgaacttgagagagatgatttagggtatcaggcagaagagatttcttagtgacaaagcgttcaagaggaaacagagcataacagtttggaaaatttgcagcctaatgatgcaatagaaaataaaaatccattttctggggagaaattcaaagcagctgcagaaatttgtataagtaactaggagccaaatgttaatcaccaagacaatggggaaaatgtctccaggacatgtcagagatcttcatggcagcccctcccatcagagttctggaggcctaggagagaaaaatagttccctgggccaaacccagggcccccctgctctgtgcagccttgagacatggtgccctgtgtcccagctgctgcagctccagccatggctaaaaggagccaacatacagctcgggccattttttcagagtgtacaagtcccaagacttggcagcttccacatggtgttgagcctgcaggtgcacagaagtcaaaaattgaggtttggaaacctctgcttagatttcagaggatgtatggaaatgactggatgtccaggcagaagtttgctaaaggggcagagctctcatggagagtctctgctagggcagtgcagaaaggaaatgtggggtcagagcccccacacagagttaacactggggcattgactagtggagctgtgacaagaggcccaccgtcctccaggccccagaatggtaaatccaccaacagcttgtaccatgtgcctagaaaaaccacagacactcaaagccagcccatgaaagcagccaggaggggagctgtaccctgcaatgccacaggggtggagctgtccaaggctgtgggagcccacctcttgcatcagtgtgacccagatgtgagacatgaagtcaaagaagaccatttaaaaattttaggacttaatgactgctctattgaatttccaatttgcatggggtgagctggccctttgttttagccaatttctctgatttggaatgtgtgtatttacccaacgcatgtacccacactgtatctaggaagtgactaacttgcttttgattttacaggctcataggtggaagggacttgccgtgtctcagatgagactttggacttgaactttcaagttaatgctggaataagttaagactttgggggactgttggaagggcatgattgtgttttgaaatgtgaggacatgagatttggaaggtaccaggggcggaatgatatagtttgactgtgtccccacccaaatcacatcttgaattgtagtttccataatccccacgtgttgtgggagggacctagtgaggggtaatttaatcactagggtggtttccctcacactgttctcatgatagtaagtgagttctcacaagatctgatggttttataaggggcttttcccccttttgctagccatttctccttgcagccaccatgtgaagaaggacatgcttgtttccccttccaccatgattgtaagtttcctgatgcctccccagccatgctgaactgtgagacaattaaacctctttcctttataaattacccagtctcaggtatgtctttattagcagaatgagaacagactaacacatgaagaaaatgaacttttaccctagaatagtataatagtatatctactaaaaatatccttcacacataaaggagaaataaagacttttccagacaaacaaaagctgagggatttcactaatattaggcccatcctacaagaaatgctacagggagtacttcaactaaaaaaaagtacattaatgagcaataaataaatgatcacctgaaggtacaaaacttactggtaatagtaagtacacagaaaaacacagactattataacactgtaactgcagtatgtaaactacttttatcctaagaagaaagaattaacaataagccaataaaaaataataactacaataacttttcaagacacaacagtacactaagatataaatagaaacaatgcaaagttaaaaagtggggggacaaatttaaggcatagagtattagttttctttttgtgtgtctgtgtgtttgtttatgcaaacagtgttaagttgttatcagcttaaaataattggttataaaatagcatttgcaagacacataaaaataaaaagcaatagactaaatcataaaaccagagaaaaacaccttcactaaaggaagacaggaagggaagaaagaaggaagagaagaccacaaaatgagtagaaagaaaatggcaggagtgagttcttatttgtccataataacatcgaatgccaatggactaaattctcctatcaaaagacagactggctgaatggaagaaacaaacaagacccatttacctgttgcctacaagaaacacacttcaactataaagacacacatagactgaaaataaagggatgaaaatagatatcccatgccaatggaaaccaaaaaagaacaggaatagctatgtctaatctatgtcagacaaaatagactttaagacaaaaactataaaaagagacaaagaaggtcactatatatgataaaggggtcaattcagcaagaagatacagcaattttaaatatatgtacacccaacactggagcacagatatataaagcaaatattacagccaaagaaagtgatagatcctaatacaataataactggagatttcaaaaccctactttcagcatagaacagctcttctggacagaaaatcaacaaagaaatacaggccttactctgccctgtagaccaaatggatctaatagatatttacagaagattttatccaatggctgcagaatacacattcttgtcctcaacacatgaatcattctgaaggatacacccatatgttatgtctcaaaacaagtcttacgacactcaaaaaaaaaatgaaatcatatatagcatctcctacgaccaaaatggagtaaaactagaaatcaataataagatgaattttggaaattatacaaatacatgcaaaataaacattatgctcctaaatgaccagcaggtcaatgaggaatttaaggaattaattgagaaatttcttgaaacaaatgatagtggaaatatagcataccaaaacctatgtgatatagcaaaagtagtactaagagggaagtttacagctataagtacctacatcaaaaaagagaaaaacttcaaataagcaacctaataatgcatcttaaaggactagaaaagcaaaagcaaaccaaacccagaattagtagaaaaaataataaagatcaaaaaaatgaaaatgaaatgaaaaaagtacaaaatatcaacgaaacaaaagctgactttttgaaaagttaaacaaaatgaacaaacatttatctagactaagaaaaaagagagataatccaaatgaataaaaccagagatgaaaaaggagccattacaactgatactgcagaaattcaaagaattgttactggctactatgagcaactatatgccaataaattggaaaatctaggagaaatggacaaattcttagagacatatgacctgcaaagattaaaatgggaagacattcaaaacccgagcagagtaataacacataacaacatcaaagtcaaaataaaaattttcccagtaaagaaaaattaaagatcggatgacttcattgctgaattctaccaaacatttaaagaagaactaatatcaatactcaaagtattctgaaatacataggagaaaatacttccaaactcattctatgaggccagtattaacctaataccaaaacatatatttaaaaaaacagggaaatatccctaatgaatattgatgttaaaatgctgaacaaaatattagcaaaccatagtcatcaatacattagaaagatcattctattaatgtgaaaaagcacttgataaaattcaacataccttcatgattaaaaaccctacaaaaatggggctagaagaaacatacctcaacataataacagccatatatgacacaacgagtatcatactgaacgggaaaaaactgaaatcctttcctctaagatctgaaaaatgacaaggatgcccactttcacctctgttattcaacatagtattggaaagcctagctagaccaatcaaacaagaaaaaaataaaggccatccaaattggaatttaagagtcagattatctttgtttacagatgatatgatcttatatttggaaaaacctaaacattcaacaaaataagtattagaactgataaacaaattcagtaaagttataagatacaaagtcaacatacaaaaatcagtagcattctatatgccaacaggaaacaatttgaaaaagaaatcaaacaagttatcccatttacaatagccacaaataaagttaaatacctaggaattaacttagccaaaaaagtgaaagatcactataataaaaactataaaacgctgctgaaagaaattgaaaaggacacaaaaaaattaaaagatattgcatgttcacaaattagaagaatcaatattgttaaaatgtccatactacccaaagcgatctaaagagccaatgcaatttctatcaaaataacaattacattctttatagaaatagaaaaacctatcctgtaatttatatggaatcataaaagaccaagaatagccaaagttatgctaaacaaaaaggaaactggaaaaattgcattagttgacttcaaattatactacaaagctatagtaactaaaacagcatgacactggcataaaatcagacacacagaccactggaacagaatagagaacctagaaacaaatccaaacacctagagtgaactcatttttgaaaaaggtgccaaggccataaacatatacacctaatatgtatccacaaaaattaaaaattaaaaaatgaaataacaaacatacacactgggaaatgacagtctctttaataaatggttggtgctgggaaaactgtatatccatatgcagaagaaagaaactagatctctaccccttgccatatacacaaatcaaattaaaatggattaaatgtttaaatctaagaccccaaactataaaactactacaagaaaacattggagaaattctccaggactttggagtgagcaaagatttattgagtaatactccataagcacaggaaaccaaagcaaacatggacaaatgggatcaaaccaagtaaaacagcttctccacagcagaagaaacaaatcaacaaaatgaagagacaaccaacagaatgggaaaatatatttgcaatcttcccacctgacaagggattaataaccagaatatataaggagctcaaacaactctgtaggaaaaaatctaataatctgataaaaaaaagggcagaagatttgaatagacattgctcaaaagaagacatacaaatggcaaatagacatatgaaaaggtgctcaacatcactgatcatcagagaaatgcaaaccaaaactacaatgagatatcatctcacctcagttaacatggcttatatccaaatgagaggcaataaaaaatgctggtaatgatgtggagaaaaggtaacccttgtagactgttggtaggaatgtaaattagcacgactactatgaagaactttagaggtttctcaagaaactaaaaatagagctatgacacaatccagcaattccacttctgggtatatacccaccaaagaagaaattagtatatcgaagagatatctgcactcccatgtttgttgcagcagtgttcaccatagctaagatttggaaactgtttgtccatcaacagatgaatggaaaaagaaaatgtggtacttttacacagtggagtactatttagccatcaaaaagaatgagattcagtcatttgtaacagcattaatggaactgagggttattatgttaagtgaaataagccaggcacagaaagaaaaacataacatgtgcccacttatttgtgagatctaaaaatcaaaacaattctatccctggatatgagagtataatggttatcagattctgcaaagggtaatggggtttggggggcagatttaggtgattaatgtgtaccttaaaaatagtttaaatgaataaataaggcctagtatttgatagcacaacagagtgattatagtcaatgataatttaattgtacatttaaaaataactacatgagtagaattacgttgtttgtaacacaaaggataaatgcttgaggggatggatactccattttccatgacatgattattatacattgcacgtgtgtattaaaacatcttatgtaccccagaaatacataaaccttttatgtactcccccaaaatttttaaatttcaaaaagttacattattttaaaaatataaaagttacattattattattttaaagttacattaaaagtgtacagattggaaagcaagaaacaaaactcttattatttgtttacatgagaaacagaagaatatacaaactatcacaattagtgaaataattatcctgtattttacatgtaaatcaatatgtacaattatattttatataccatcaacagttggaaaatgtcatttctaaagctataattgcaataataaaataacaaaaataaaaaccacagcaataataatgtacctagaaataaacataataaattttaaatttaagtaaaatattaatatttgttgaaatttatttctaacatattaataaattaaaatgcataccaaattcatatacagaaatacttgatattataaagatgtaatttctcccaaaattgatctatggattcaatatgattcactcagaaaacttgagttattctaaaatgtatatagaagaatataggatacacaatagccaaatcaattttaataaagaaaatataagttgacaatgccctatcagatattattataaatctacaataatttagatggttaagtgacaatccagtatataattagaaagagtacactgtcccaaaacatatgcatgcatatacataagctttagaagacagcattagagattagtggaaaaagcatttttcaagattgagtcagcacccaattacatgaagtcaatctggtgggtcataaaaaaactaaaaaatatgcaaaaggttaccaatagaggaaactaaataaagtgtatttggaatctctctgtatttttttttaaactgtatttgaatctacaattatctcaccaaaaaaagaattaaaactagaatataaaacaatgtagtttatcacacataagtataagcgatatttaatttaagaataaatttgagcctgtatatgtataaatgaggatcagtgctggattacaatgagaaatgcattacttactataatatgagccatggacaaaaacttggaaatggctagacatgtaataagttttctgagacaagtgttaattaatattgcaaaaataataaaaaatagatttttacttcacatcatacacaaaattaattccagatacattaagaacttaaatatagaggcaaaactatttaaattttagaagaaaatataggagaaattttaaacagaagcaaaaaagctacaagctataaaaaatttaattcaattaaaatttaaactttacttctcaaaagatatcaaaaaggaagggataagactggacaaaaataatctatttataaattatatgataaataataattacaatccaacatctctctctctctctctcctgaaaatcaataaagataagcaactaaacagaaaattgcaacaaaatatataaacagatttttttaaagaataaacactaacaacatggatgagtcttataggataaagttttttttttaatttccaactttcatttaaagttcaggggtatatgagcaggatgggcaggtttgttagataggtaaacgtgcatcatggtgatttcctgcacagatcatcccatcgcccaggtattaatcccagcatccactagctattcctccagactctctccctcctcccaccccctgccctccaacaagcctcaacgtgtgttgttccaccccatgtgtccatgtgctctcatcattttgctcccacttataagtgagaacatgcggtatttgcttcactgttcctgtgttagtttgctgtggataatggcctccaactccatccatgtccctgccaagaacaagatctcattcccttttatggttacttagcattccatgatgtatatgtaccacattttctttatccattttatcagtgatgggcattttggttgattccatgtctttgctattgggaataatgttgcaatgaatatacacatgcatgtgtctttataatagaacaatttatattctcttgggtatatattcagtaatgggattgctgggtcaaatggtatttttgcctctacgtctttaaggaatcaccacactgtcttccacaatggttgaactaatttaacactcccagcaacagtgtaaaactaaataatatactgtttaggaatacatgaaagtgtgacattttacatagagaatcaaggaaactataaacacaaaattcaaaacagtgatttctttggatttgaaagagggaaatgcaattcagtaggaagagataggaggcttcaattgtttttataatttcctttttctgagtgaacagtttttactttaccattattctttaaactgtacatatatggataacacggtatgtacatgttatatatttattaaaatattacaaatatatataatgtatgagataaatgcatagattagaaagctcccccaatttgtccccacataattagtcattaggtgaaataaaaattttagttttaatgaatggtggatgaaacctcacaaaatgcatataaaaggtaaagtactgtgctgctataactagggagctttttaatagtcttaaacacaagtaaaatattgttcatgaccctgggaaatgtgggagatgttttaggtcagactcatgctggaattgctttctccatcaaaaatcagtaggatagaactcttcccatatctacaaggcagctgagctatacataaggcagaaaaaaagatatgtagcattaaaaatagtgaacacatcagacagccataaaatcacaccaaagaagcagaaaaactgttctggtattaaggaggtacatgctacctatgaatgcttaatatccccttgaggaaaaaaatagaatagaaataccatttttattccttagaaatataatagaaattctatttctaccttttagaaatataatagaaattctatttctaccttttagaaatagaatgaataaacatccaacatttttaagagaagagtctgtgtaaataagaaaagagaggcagaattatctgtgctttatattaatactttgttataattaagaggctagactaataaatctggcaaggaactcaaaaggaaaaggactgaagtatattcaaggattacaaattcaggtctaaaattgatccatgacataaacttttcttggcctcacatgtctagaaggtgctccaatggctaatgaagagaaataattttgtacaaaaaataacattatgtactatttgtagatttccacatatatgtaatgatgtatgcatgtgaatattcattttaacttgaattcagtaaattaaataattctctaactttatattgtggatttcgtgatttttaatttttttttcacttcttaaaaaatatagtgactttatttccactattttatagtcctcagtattgcagcttataagaatcctcatctatttgtctattaataatagacaaacaaagagccaaatcatgggtgaactcccattcacaattgctaccaaaagaataaaatatctaggaataccacttacaagggatgtgaaggacctcttcacaaagaactacacactactactcaaggaaataagagaggacacaagcaaatgaaaaaacattccatgctcatggataggaagaatcgatatcatgaaaatggacaaactgtccaaattaatttatagattcaatggtataccaatcaagccaccattgactttctcacagaattagaaaaaactactttaaatttcatatggaaccaaaaaagagcccgtatagccaagacaatcttaagcaaaaagaacaaagctggaggcatcacactacgtgatttcaaaccatactacaaggctacagtaaccaaaacagcatggtactggtaccaaaacagatatatagaccaatggaacagaacagaggcctcagaaataatgccacacatctgcaaccatctggtctttgaaaaatctgacaaaaacaagcaacgggaaaaggattttctatttaataaatgatgttgggaaaactggtgagccatatgcagaaaactgaaatgggaccccttccttacaccttatacaaaaattaattaactcaagatggattaaagacttaaatgtaagacctaacaccacaaaaaccctagaagaaaacctaggcaataccattcaggacataggcatggggaaagacttcatgactaaaacacccaaagcaatggcaacaagagacaagattgacaaatgggatctaattaaactaaagagcttttgcacagcaaaagaaactatcatcagagtgaataggaaaattacagaatgggagaaaatttttgcaatctatccatctgaaaaagggctaatatccggaatctacaaagaacttatgaaaatttacaagaaaaaaacaaccccatcaaaaagtgggtgaaggatatgaacagacacttctcaaaaaaagacatttatgcagccaataaacatacagaaaaaacctcatcatcactggtcattagagaaatgtaaatcaaaaccacaatgagatgccatttcatgccaattagaatgatgatcattaaaaagtcaggaaacaacagatgctggaggggatgtggagaaataggaatgcttttacactattggtgggagtgtaaattagttcaaccattgtggaagacagtgtggcgattcctcaacgatctagagccagaaatacgatttgacccagcaatgccattactggtcatatacccaaaggattataaatcattctactataaagacacatgctcaggtatgtttattgcaacactgtgcacaatagcaaagacttggaaccaacccaaatgcccaacaattataggctggataaagaaaatgtggcacatatacaccatggaatactatgcagccataaaaaaggatgagttcctgtcctttgcagggacatggatgaagctggaaaccattattctcagcaaactaacacagaaacagaaaatcaaacaccacatgttctcacttataagtgggaattgaacaaagagaacatatagaaacagggaagggaacatcacacactggggcctgtcagggggtggggggctaggggaggggtagcattaggagaaatacctaatgtagattatgggttgatgggtgcagcaaaccaccatggcacgtttatacctatgtaacaaacctgcacattctacacatgtatcccataacttaaagtataataataaaaaataaataaatttttaaaaaagaattctcatctataaacacaaaaatatttcaagaaagtatgttacaaaatagtacatataagcaataatttgacagaatcttattaactctagtaattcatacccccaaaaatggattttaaaattcaaaaataacattttgccttatttaacatatgttacaacttatcatttaaaatattattatttatttaaatatttcatcaatgatactgtgtagataaaatattacacaaaatatactgtagaaaatgttttggtctttgatctgaacaataaataaaaacataggcacttctatgcagagacagggaagcaatcactagtcagaacaataaacttgtataagcaacatatgaaaatatggcaatgataaatcctggcattttaaactgacaaacacttatgtgaaagtctgcagcttcaatattttcactcaagttcaaaagttacatgttttcctggcccatactgaaacttcacaaacacaatatggttgtcaggggcatttcaatcttcagttggctattgcagaatcatactcattattttcaaatactaaaattaaataacaattatgataccacctagtaaatcaaatacaagaaaaaataaactctctttctcattgttaccatgagaccacaacaatataaattagtgattctcatttagtaaaattaactaacacaagaaaataacactggagtggcagaaaatttcaagagaagtcaatttttctagacaatttttaaaatttagccaaatctcagaagaataaatataactcaatttcacataaaccaccaaatcacaaataacaaagtaattataaccaataggtttataaacacctgaattacagataaatcaatctttattttgggtagtaggaggtattattgggttttaggtagtattatgtaggagggcaaaccaaaaataacaaaatggtcaaattccagaaacatgatttcatatgaaaagaggggataaattaatgaataatgaccaccagctggtaggaaagatcagaatcaatcatcctaccatatcatccataaaaaaaaatatatcatttattttccctcttcacataaatatgaaattgaagggtgtagaggttctcaaatggatactactcataaaatcaattttaatgatttaacatagaaattatggtaggtgggggagaggccaagatggccaagaggcaacagctgtggtagaaggctcctaccaagaagaaagaaaacggggaataaattttgcactggcaactgaggtatccaggttctctcattgggacagactagtcagttggcatgaccacagagagcaaggaaaagcagggtgaagcaatggcccaactgggggtcacacggagcaaagggagctcccactcccagccaaaaaggtagtgagtgattgtgttaactcaccctcgaaatcatgctttatccatcaatctgtgcagcccacagatcaggagataacccttgtgagcccatgccaccagggccttcagtcccaagcacagagctgtgcagattctctgcagcagccactccactggaaactgcctacgactaccaagtttctggaggaaagggtggccatcatcattgcagatgcctgctatctaacacaactgagctcctggtgggaggggtggcagccatcaccgcagctccagtctgctgtttttcctctgccagtgctggggagactgtgtggtttggaaccaggaggaattccccacagcgcagcacagcagctatggcagattgtggacagactgcctctttaggctggaccttgactcatccctcctcactgggtggggccttctttgggaatctcagcaactctagccaggggtttacagagggaactctaatcttgggacagagcccctggggggaggggtggtcatggtctccacagatcagtggatttagtctttacccctgtttgcactgaagaatccaggcagtccagatgagtgggattcctcccagtgcagtgcactccctcagcaaaggggcagccagagtacttcattaagcgggtccctgatcctgtgcctcctgactgtgtcagactcccaacaggggttgccagataccttacacaggagcattgttgcaggcatcaggttgatgcccctctgggacggagctcccagaggaaggaacaggcagccatctttgttgttctgcagcctctactagtgacccctccaggtgtggaagggacccaggcaaatagagtctggattggacccccagaaaaccacagcagcccaacggaaaaggggcctgactattaaaagaaagacaaatgaacagaaagcaacaacagcaacagcatcaaaaaagaagtccccacaaaaactccatccagagttcagcagcctcaaagactgaagctacataaattcatgaagattagaaagaaccaatgaaaaaatgctgaaagctcaaaaagccagagtgtctcttctcctgcaaatgattgcaacacctctccagcaaggctacagaactgggctgaggctgagatagatgaattgacagagcaggcttcagaaggtgggtaataacaaattttgctgagctaaaaaagcatgttctaacccaatgcaaagaagctaaaaaccatgataaaacattacaggagctgttacccagaataactagtttagagaggaaaataaataacatactgaagatgaaaaatacaacatgagaacttcacaatgcaaccacaagtatgaaaaactgaatagacccagcagaagaaagaattttagagccaggaaactatcttgctgaaggaagacaggcagcaagattagaagataaagaatgaaaaggaataaacaaaaccttcaagaacgatgggattatttaaaaaaaaaaaacctatgactgattgggggtacctgaaagagacagggaaaacagaaccaagctggaaacatattttaggatatcatccaggagaacttcctcaacctagcaagacaggccaacattcaaatttttcaggaaatccagagaatcccagtaagacacttcataaaaagatcaaccccaaggcacttaatcatcagattctccaaggttgaaatgaagaaaaacatgttaagggcaccagaaagaaaggccaggttatgtacaaaaggaagcccatcagactgacagaagacctttcagcagaaaccctacaagccagaagagtttgggggccaatattcaacattcttaaagaaaagaattttcatcccagaatttcatatttggccaaactaagcttcataagggaaggagaaataagatccttttcagacaagcaaatggtgagggaattcatcactaccaggactgtcttgctagagctcctcaaggaaacactaaatatggaaaggaaaaaccattactagccacttcagaaacaaaccaaagtataaagaccaatgacactctgaagtaatgacatcaagtctgaaaaaaaaaaaaacacagctagcattatgatgacaggatcaaattcacacataacaatagttacctgaaatgtaaatttgctaaacatgccaattaaaagacacagaatgacaagttggataaagagtcaaaacccatcagtgtactgtattcaagagacccatctcacatggaaaaaaacacataggctcaaaataaaggaatggaggaaaacttatcaagcaaatgaaaagcagaaaaatgcaggggttgcaatcctagtttctgacaaaacagactttaaaccaacaaagatcaaaacagacaaagaagagcattacaagatggtaaagggttcaattcaacaagaagacctaaccatcctaaatatatatgcacctaatatgggagcaccaagattcataaaataagttcttagagacctaccaagagacttaggctcccacacaataatagtgggagactttaacaccccactgtcaatattagacagatcatcgagacagaaaatttacaaggatattcaggacttagactcagctctggatcaagtggacctgatagatttctacagaattctccattgaaaaacaacagaacatacattattctcagtgccacatggcatttattctaaaatcaatcacataattggaagtaaacactcctcagcaaaagcaaatgaactgaaatcaaaacagtttctcagaccacagtacaataaaattagaactcaagattaagaaactcactcaaaaacacaaaactacatggaaactgaaaaacccactcctgaatgactgctgggagataatgaaattaaggcagaaatcaagaagttctttggaaccaatgagagcaaagagacaacatgacagaatctctgacactcacctaaggcagtgttaagagggaaatttatagcactaaatgcccacatcaaaaagctagaaagatctcaaattgacacctaatatcacaacaaaaagaactagagagccaagagcaaacaactcccaaagctagcagaagaatagaaatcaccaagatcagaccagaactgaaggaggcagagacacaaaaaacccttcaaaaaatcaatgaactcaggagctaggttttagaaaaaaataaaatagatggaccattagctaaactaaaagagagaagaatcaaatagaaacaataaaaaatgataaagggtatatcatcactgattccacagaaatacaaacaaccatcagagaatactatgaacaactctatgcaaataaactaaaaaatctagaagaaatggataaattcctggacacatacaccctccctagattgaacaaggaagaagttgaatccctgaatagaccaataacaagttctaaaatttaggcagtaataaatagcctaccaaccaaaaaaagcccagaaccagatggatttacagctgaattctaccagaggtacaaagaagagctggtaccatttcttccaaaattattccaaacaaatgaaaagggacagactcctccctaactcattttatgaggccagcatcatcctgataccaaaacctgtcagagatacaacaaaaaagaaaacttcaggccaatgtccccgataaaatcaatgaaataatccttaataaaataccagcagaacaaatccagcagcacatcaaaaagcttacccaacactattgagtcaacttcatcccaaggatacaaggctggttcaacatatggaaatcaaccaacataattcattatataaacagaaccaaagacaaaaaccacatgactatctcaagagatgcagcaaaagccttcaataaaatttaacatcccttcttgttaaaaactctcaataaactaggtattggtggaatatacctcaaaataagagcaatttatgacaaactcacagccaatatcatactgaatgggcaaaagctggaagcattccccttgaaaaccagcactagacaagaatgtcctctctcaccactcctattcaacatagtattggaaattctcagagtaatcaggcaagagaaagaaagaagggacattcaagtaagaagagagaaagtcaaaccatctctgtttgcagatgacataatcccatatctagaaaaccccattgtctcagtccaaacgtttcttaaggtgataagaaacttcagcaaagtctcaggatacaaaatcaatgtgcaaaaatcacaagcattcctatgtggcaacaatagacagagagccaaatcatgaatgaactcccattcacaattgctacaaagagaagaacacaactagaaatacagctaacaagagaagtgaaggacctcttcaatgagaactacaaaccactgctaaagaaaatcagagatgacacaaacaaatagaaaaacattccatgctcatggataaaaagaatcaatatcgtgaaaatggtcatactgcctaatctatagattcaatggtattcccattaaactatcattgacattcttcacagaattagaaaaactactttaaaattcatatggaaccaaaaaagagtgcatatcatcaaaacagtcctaagcaaaagaacaaagctggaagcatcacattaccagacttgaaactatactacaagcttacagtaaccaaaacagcacagtactggtacaaaaacagacacacagaacaaagaaatggaatagagatctgagaaacaagaccgcacatctacaaccatctgatctttgacaaagctgacaaaaacaagcaatgaagaaagaattcccaccattaataaatggtgttgggagaactggctagccatatgcagaaaactgaaactggaccccttccttacaccttatacaaaaattaattcaagagggattaaagacttaaatgtaacaccccaaattataaaaaccctacaaagcaaatctaggcagtaccattcaggacataggctcaggcaaagatttcatgatgataacatcaaaagcaattgcaacaaaagctaatattgacaaatgggatctaattaaactaaagagcttctgcacacaaaagaacctatcaacagagtaaacagacaacctacacgatgggagaaaaattttgcaatatatatccatttgatgaggggctaatatccagaatctgcaagaaacttaaacaaatttacaagaaaaaaaacaaacaacccattaaaaagtgggcaaagaacatgaacagacatttctcaagagaagacattcatgaggccaagaaacatgaaaaaaagctccacttcactgatcattagagaaatgcaaatcaaaaccacagtgagataccatctcatgccagtcagaatggtgattattaaaaagtcaagaaataacagatgctcgtgaggctgaggagaaaaaggaacacttttacactatggtagaaaagtaaattagttcaaccattgtggaagacagtgtggcaattcctcaaagacctagaggcagaaatatcatttgacccagcaatcccattaccggggatatacccaaaagaatactactcattctattataaagatacatgcacatgtatgttgatttcagcactattcacaatagcaaagacatggaatcaacccaaatgcccatcaatgataaactggataaagaaaatatggtacatatacaccatggaatactatgcagccataaataagaatgagatcataccctttgcaggagcacggatggagctcaaagccattattctctgcagactaatgcacgaacagaaaaccaaccaccacatgttctcacttgtaagtgggagctgaagaatgagaaaacatggacacagggaggggaacaacacacaatggggcttgtggaggggggggggggaagaagagcatcaggaaaaatagctaatacatgctaagcttaatacctaggtgatgggttgataagtgcagcaaaccaccatggcaaacgtttacctatgtaacaaacctgcatgtcatgcgcatgtatcccagaacttaaaaaaaaattaatttttaaaaaatattgtaatgtgagaacacaacacgggaaccactcaaaatacacctttctatgcaaaatttagtttggatatattttagcattttaaataagcattttgcaaccgagaccaaataacaatcatctcttcaggttttccactatgtactaacatcagatctatgtaggaacaaatgttattcttgtttgtctccttcatatcaaatgtcctgaagcctttgtgcttctctggaacaaggctaagtttttgaaggcacattgcagtataaaaatcatcaataggttagagatggacccagtcagtgatatggtacagcctcagagccaggtggctggactagaggaatccgccctcccccttgcatagggtgagtagaggacagagtaaacaacttctagaatgtagtatttcagcttcttatccccatgaggtccagcattgtggatcacatcacctataaacagatctttggctttttttcttgaataagctattcacgtaattcagtatgtaatgggtgttcacaaaaacatcatctttgcccttgaaaacaagctacgtgtctgggcaggaagtacttacccagcgagaaacaacacttctttcagagacaacttgaagaaagtgtctctatagctccgcataaaactatcttgggtgcttctcattctcaaatttcagcatatcagaaaagtccgggtggttgacctctgggggtatctgacccagcaagaaaacttacatcaccctttggtttcccacgttggtttctctgacccaggaatccggaatcacttgccttctggcaaaatgcggagtgaggtacttaatcaccagaaataagaagtgcttctttgcacacttatctggctgatctaaaagcagtgaatcattgcagcatctcaaatacatcagaaagtcatcacatctgtccaggaaattgttaaaatctgtaaccactgacgtgaacctcaagtcaggttcacagtaattcagatggcttatactgaaaaacccgtacacttccccgtctggttggccaacatactcaggatgggattgtaccacttgttcagcttttcttgttctctgttccagtgtgcctcgagaggtgtagcaatcttccaaagcttctctttgggtattattattaacccaccttacatttattattattattattattattattattattattggctactgcttttggaggcttccacaatcaaataaatgaagacatttgccatcatcaggttacccaacaactttattcttcaacgttcaacactcatgtctcatatcttgtccaagactagttccagctcggtggtgcgggggtgggggcacggggtgggggtgggaaatcgctgccatacccacttttcccacgccgctccacaccgctcagccctgagaaggccacagctcagcctctatgggcggtcgggcggtggggacagctctagttcacctcaccttgcctccagcactcgccactgcagccgatgtgcctcagtccgggttccgtcttcagctcctggcactggtgccactggcaccctggggtacctcgcccggcccccttactttttttttttttttttactttttgaaataaagtactggttaacaaccctactaggtacgttggtacatggaatagacattctcttcgagaatggtaacaacaacaattcttagaagtgataactttatgccaggagacacaaaaattcccccaagaaaggtctcaatcaatagcctaatcttccatcctaaaagcctaagaaaagaaaaaatccaaagcaagcacaaggaagaaaataataaacattagcatgtaaataaatggaacagagactaaaaatagataaaatcaatgaaaacaaaggttatatttttgaaaagctcaacaaaatttacaaacgtttagctacactgaccaagaaaaacagagagaagattcagattactagaatcagaaataaaaggggacatgactaccaacattatgaaataaaaagcattggctgggcgcagtggctcacgcctgtaatcccagcactttgggaggccaaggcaggcggatcactagaggtcaagagttcgagaacagcccggccaacatagcaaaaccccgtctctaccaaaaatacaaaaattagctgggcatggtggcacagacctgtaatcccagttacttgggaggctcaggcatgagaatggcttgaacccagaagtagaagttgtaatgagctgagattgcactactgcccttcagtctgggcaacaaagtgagactctgccaaaaaaaaaaaaaaaaaaaaaaaaaaaaaaagaaaatacaatatgcaattgtataccaacaaatcaataaattagatagtttatgtaaatggatacattttccagaaagacacaaacatacgaaactgactcaagaagatatttttttaaaagtccaaatagaaatacagcaaataaagagatcaaattagtaatgaaacaactaccaaaaaaaaaaatcccatgccaatatttcactcataatttcttcaaacatgtaaaagattaccaccaatgcttctcaaacttctccaaaaaggtagaataggaggaaacacttttcaattcactttatcaggccagttttacccagataccaagaccagacaaacattacacacacacaagctaaagactaatatcctttatgaatatagatgcaaaaatccttgacaaaatattagtaaaccaaacccaacaacatataaaaataattatacaagattatacaatataaccaagtgaaatttatcccaggaattgaaagttgataacatttgtagaccaatcaatataacatactgtttcagtctgtgctgctataacaaaataccacaggctgggtaatttataaaaaacaaaaacatatattttttcgtagttctgaaggctgcaaggtacaaaatcaaggtgacagcatttagtatctgatgaggactgctgtctggttccaagatggtgccttgttgctgcatccttcagaggaaatgaatactgtatcttctcatggcagaagggagggaagggactgaagggcaggagagtgcctccatcaaacttgagcgttttataaggctgctaatcttattcatgagggtggagtcctcatgacttaatcacctcccataagccacacttattaatattgctgcattgggaataaagtttcaacatgaattttggaggagacactatctttcaaaccagagtgtgcaccgtattaatagaataaaaggcaaaaccacacgatcatctcactagatggagaaaaagcatctgacaaaatccaatgcctttacatgaaaaaaaaaaaattcaatgcactaggaatagaagaggacatccagaacctgttacaaggaatctatgaaagtcccacagctaacatacttaatgattaaagactggaagcttttgccctaagataaagtataagataaggccatcaatggatgaatgagtaatggaactgtagtatatgtacacaatggaatactattccaccataaaaacaggcaggaaatcctgccatttgcaacaacatagaagaacctgaaagacattatgttaactgcaataaaccaggcaaagaaagacaaatatgacatgatcttattcatatgtggaaactaaaagagtttattttatagaacttgagagtagaatggtggttaccagaaagggggatttgggggaggaggttgaggtgatgttggtcaaaggattacaaattgtatttagataggaggaataagttcaagagattaattgtgctacatggtaacaatagtcaatacagtataactctcagcattggaaaatgttaagagagttaatgttaagtgttctcatcacaaaaataacttatgatgtaatttgaacattatgttcaagttatcacaaaaataacttatgaagtaattatgaacattaactagatttagtcattcaagaatgtatatattgctcaaaacatcacttgtgcataataaatacatgcattttttctgtcatttaaaagagaaaaaaaagaacaagacaagaatgtccacttttaccactgctactcaacattgtactgaaggttatagccaagcaattagataatacaatgaaattaaaagtatccaaattggaaaagaagtacaactatctctgtttacaaatgacatgatcttatatatggaaaatcctaagaaatccattaaaaatataagctaataggcaagttcagcaaagattttgtatacaagatgaatataaaaattcaaatttatatctatgcagtaacaatgagcaatctgaaaagaaattaagaaacaattatacttgtgatagcatcagaacaataaaatacttaggaatgagcttaacaaaaccagaacaggatttgtttgcttacaaccataaaacatcattgtgtggatgatggaacaaatatatacaacaaagtagggtggaaaagatcacagtgcacaaaataatacaaatgagataaagaagttcctttagtttcctatatgcctgggtcagtcgccacctagccctgctctattctatttctcatcctttcaattttctatacttccattcatacatccacttttttcattcatgtaacaaatgtttcttgaatgcccactatataccaaacattattctaagcatcagttttatattggcgaacaaaacaaaggtccttactcctatgaaaattactttctagtggtaggagagagacagaaaatgataagcatcatgtaaattacacaggtgggagaaagtaataagtgctaaggaaaaagaagaaaaactaaatgtgaaagaaactggtagtgtggggtaagggtcaggtagatgggttggcgagttaagacgacatttaaataaagacttcttcaaggaggtgaagaagttggtcctggagatatgggttggggtggagatggagagggctttcagacagatgcaacaaccagtacaaagtccttaatgcagggatacgcctagaatattcaaggagtatcaaggatgaaaatgtgggtggagtgaaatgacttgaaataaagtaaagagaacaaatagtaggacattaagatagagacataacataagggtcgtaaagattgtgtaggaccttgtacttattgatatgactttgttataaaccctaagtgaaatgcagatccattggagaatgttgatcaaaggagtaatgcaatataacttaactttttaaagaataacaattcatactgtgttgagaatagactgtgggtcaagaatgaaagcagagagataagttagatactatgacaataacacaaatgagaaattgtaccttagattagagatacagcactggatatggtgagaagtggacaaatttaaatcagtgctatttgctgatggattagatgtagggtatgaagggacacttccaaactcattttgtgaggccagcacaaccatagtaccaaaccacacaaagataaaacaagataagaaaattacagatcaataaccctgatgaacataggtgccgaaatcatccacaaaacacttgcaaattaaaatcaatagcacatttaaatgattatatactatgaccaagtgggatttatccctgggaagccaggatggtttaaaatttgcaaactaataaatgtgatacaccacattaacagaattaataaaacgcatattatcctctcaatagttgcagaaaaagtatttgaaaaaattcaataccctttgatgataaaaatgctctacaatctattagtagatataggcacctcaacataataaaggtcatatatgacaagcctacagctaacatcatactcaatgttaaaaaaaaaaaaacctgaaaggttttcctctaagatcaagaacaagacaagctagaataggcaaatctacagacagaaagcagattaatttttgcctggggctgggtagggggattgtaggaagatggtgagtgactgctaatgagtacggggattttggggggagtgtgataaaaatgtaaaattgattgtgatgatggttacagaactctgtgaatatattaaaaaccactgtattgtacattttaaatgggtgaattttgtggcaatcacttcacacatgttaggataaccagtatcccattatctaaaaagagagagagaaagggagagagagagagagagagagagagagagagagagagagaggtataggtgaaaatgtggagaaattcaaactttttcacactgttggtgggaaagcaaaatgctgctgccactatacaaaacagtatgtaggttcctcaaaatattaaaaatagaataatcagatgatccaacaatcctacttctgagtacatatccaaaagaactgaaatgaagatctcaaacagatatttgcactcctgtgtttattgtagcattattcacaatagccaagatatggaaagaatctaaatattcatcaacaaataagtgaataaagaaaatatggtaaagacacacagtggaatactattcaggcttataacagaaggaagttctgccatttgcaacaacatagatgaatctggaggagattatgctaagaaaaataagccagtcagagaagggcatatactgcatggttccactcatatgagatatttaaaatattcaaactcatacaagcagagtagaatggtagatgtcaggagcttatgggggagacaaaatgagattttgctcaatgagcataaagtttctgttatgctgaatgagtaagtcctaaagatctgctgtataacatagcacctatagaaaacaatagagtattgcacacttaaaattttattgagtgtagatctcatatttagtgttcttaccacactcatacacacaaaggacactagaaaacttttggaggggatggatacatttattattttgattgtagtaatggtatcattggtgtatgcatatgtccaaactccatgaaattatatacattagacacatgcagtttttttgtgtatcaactatacttcaataaatctgtttttaaaaaaggaggaatcaaagttgccctgctatttctggcctgataagctagaaggatggatgttcataaaactgtctattctattattttaataaatctccctttttctaaaataaaccttgctcttctttgcctatgtcacatgttacaaggtggactattttaagttccaccaatctggaaaatgaacaagggagtgaagactcttccgtctaagaattccttacatttacctcattcccaacagattcctcgcttctctaacctcctgaatagaatggagttgacatcaattagataatttgagagactcgccgtatcgactaagcaaagagtttaaacgtgttggagacacgattccaccgaactgaagagaatcacacatctgtttacattgagaaagcctcctactgctaatgcttcctgagacttttccatcagaggacatggaccaagaaaagcagtggaacataagcagtgtccaaaatgtgctgtgtcccttaggcatttaccagcctgagtgaaatagaaatagcaaaagaaaaatgcttctacatttcagaaaactgtatttcattccagtgtaagggccagaatatagtctgttccactgctttatttcaaaagatctaaatgataagacaggagtagttctttaatgtttaatgactatccatgtttcaagtctaagcataataatgagctctctccaaaatgcaaaatttatgtaatcataacttctttggaaagaataattaagaaaattcaagacattatattagcagctctttcataataggggaaaaagtaatataaggaaaaaaaggcagaaattactgaactttttttttaaaaaaaggacaaatgtagagggttttcaaagcaatgttaacaatattgccctttatttaacataatgcattgctatttcaaaaggcattcatgattgtgctattatctgaaagaagaagaaactgaggctccaagaagttatatgactctcctgcttaaggtcattcaactagatagcaaacaaaaaatgacaagaatctaagccctaaaaattgtgcttacagttttttgctattatatcaatgttacctttcaattttacaactaaaacgaatgaggaaagcaggtagaagaatagagctttatttctccttaatggtatcagaaggaaactatgtaggtttcaagttattgtatgattatacataataaaattcacttacctgtggagtaatttatgattgacaaccaattcatcaattaacgaaaacagaggtaatattctagcaaaggaacatggtttctagaaaaatcaataggttactgtagcatcttactgggaacagaggtgcagaaatatctatactgcagacactttggaaaacagtacaatgttcacaggcctgaaattggtacggtagtttcaactatcagaatcaatctgatctgatggctcctgctagtgattgatagtcactgtaactcttctcacaaagtaccagttttggggagatgtaaaacacaatgcctggcattgatttggcaggaaagtatgcctttcttttgctgagcacagctatcttaggtacactgcagacacaaatagcaattgcaaagtcatcatgataatttgcatgagtgcttatctttagagatgttttgagaacatcagtaggtgggaagtgacttcatttaccctacatgagaactaagagaaaggtggcctttaggtatctaagattttcaaatattgtgtagatataagacacagataccaaataaatatttggatttggggatttaaataagttcatggaaaaagggaattaaaaggtaaaagtagaaactataaattatatttttcaacataaggttcatgaagttctagatacttttgtaagtgataacaccagccatttagttcatctctaaaagctgagggtcctgggaatctaaccatgttaatgtgatcttatttacattattaactgaagaaatatgggtgccttttacagacttttttaatattaggaaacaaatgaagtcagaagaagacaaattatgactttaaggtggatgcttaatgacttcccatcaaaactctaccaaaattgccattgttggatgagagaaatgagcaggagcattgtactggtggagaaggactctctggtgaagctttcctgagcatttttctgctaaagctttgaataactttctcaaaacactctcataataagcagatgttattatttgaccagccacaaagtcaacaagcaaaatgctttgaccatacccaaaaactgttgctacaacctttgctcttcacggtccacttttgatttgagtgaatcacttccacctcttggtagccattgctttaattaggcttcattgtcaggatcatactggtaaagccatgtttcatctcttgttataattctttgaagaaatgtttcaggattttgattttacttgtttaaaatttctatttaaagctctgcctttttttttttttttttttttttttttgagacagagtcttgctctgtcgcccaggctggagtgcagtggcgggatctcggctcactgcaagctctgcctcccaggttcacgccattctcctgcctcagcctcccaagtagctgggactacaggcacctggcaccaagcccggctaactttttttttttttgtattttcagtacagacggggtttcactgtgttagccaggatggtctcgatctcctgacctcgtgatccgcccgcctcagcctcccaaagtgctgggattacaggcgtgagccaccgcgcccggctgaagccctgctcttctcctcagctatgctgggtgcaacaattttggcacccatcaagtggaaggtttgctcaactttaatttttcactcagaattgtgtgagctgaatcatgtgagatgtctgtggtactggctattgtttctgctattaatttttgattctcttcaattagggcatgagcaagatgagtgttttcctcacaaaatttgtaaagttggatggcaaatttatgtggatggtctgctgctgcaggcttcatgttcaacattacattgtcccttcctaatatgagttatctatttgtaaactgctgatttctttgggggattgtctccataaacttttcataaagcatcaataattttaccattcttccacccaagtttcaccataaatttcatgtttgttcttgcttcaattttagtagagttcatgttactctaatacggtctcttttcaaattgcattatccttcttaatgcctcaaactaggtactattcaaaaatattctaactagttagtacaagttagttttggtgcataaatattttaaaatccaagcatagttttttctataatatgcattttccatgaagtttttgaagatcccttatattacagtagacttcttccactgcattagtttcacaggctctcctttataagaaaacaatacaactgattctatcagtaaagcagattttttttttcaattaaaagagagacagttccctgattcatccacattgcctcccagatccccctaaaaattataatacatattttttaaggagttggctgagattacaggtatagtctctggccagggaacaaaatagggctaattgcactgtgaagggagcaaacacttggcatcagctttattaatgatgtatcaatagggctatgtgtccacacttaaagcataagttcaaacataccaaggatgtcattcaactacaaggagaatagattcctgccagctgttgatactttctctttcaaatgtctaaaaaaaattttttttgatgactttttgctaaactctttgtgatacctcctccaaaaagaaaatgatgccaaatggaagtaagactctaatttgacaaatggtaggactttctggtcttttaagaaaataaggaagacctttgagagtttagaatcttagaaaagtttatggaaaaatattgtgaattcccttcctattctgagataatgtgagcatgtcttggtttaaggcaatgttttcgacaaaatttcctttcaagatccattctagtactataaatccatcgttctacttgatataatatcaatattctacataatggggttatggttttgactctacaaactctcgtcaaagtgacaacaagaatagcttttgaaaaatgaaacatttttaatgcagaacatttgatttggacaaagtaaattatatctatttccatattagccagtctgcttcacatgcagaaaaattctattccttggccactggcaattactagaaaagaagtcacttgaagaaatcaagaaggtcacaaagctataagaaatctaagaaaatgtacttctaggtcagagtaagccttggggtttactgctccagacaggtagctaggtgtagaaacgtcaggttctacatacatgagcaaaagtaagactgtcagatggcattagaattaagtgaaaataaagaaacagagttttacccttttcatgaaagaaaaaaccatccatcttgttttttaaatggtattaccattgaaagcatttgaaatcccatctaatttaagcctcaaatgaaactgagacgtttgccttttgtcaagttcagaaatgcattgtcttctcaaaggcgcaataagaaggagacagcgtagaatctctttctcttttaaaactatgtaaattgagaataaacaattttttaaaatgatggtgctgcttttgggctgtgaataattttcttacaactgctgagccatctgttaaacagagaggtcttgcttgttcaaaaagataaacgtagtttttcaaaatttcaatagacaggttttgtttgaaccctccaagcaacaaatactccaataaataaaagtccatggtattcatgggccgattaagtagaaaggaaaataagctatcttttgaaaattatattaaacactgctttccatacagaaacgacaacacaatcacacctctgaggtctttcagctgaaccatctatggccaagtaagagaatgttatgttttggtgttcctcttgaccttgaaaaactagtccttaagtgaaggaacccggggggactatacaatcaatggcgtaattcctagatacacagccttctgactatcaaattctttatgtagcaatcccaatttcaacacaacaaactaccctcttgttactagctcaatgtgtactaaaataagactattttcatttagttttagtgcattacttttgactctccagcttttgtcacttgcagggttatccattgctgtagaaatagtgcataactatggcacagttacattcaaaactataagatgtttagtgtcttagttctatgcattattacattgttcattacaaaataaaatataattctagttgagtcagtagtatctgttgagcagctgcaatttcctcgctaaccacatgctctactcttaaataaaatgacatatactctacttaattcagagcccaacttttatagtcctttgagtttcaaattaatgagatttaactatatttatctattatcagccaatatggcggttagcactatgttaaaaagaagacaatcctataatcaagctgtccatctaaagaagagcaaatttgttgtatattagcaagaaaatatatcagctgccttcattagattagagacagaaatggtcagggctaaaaacaatacaaggaagtgaaatgcattcccgcaaaaatacatacttttccaacaacaattatattttctatcttgatcattgtgctctcctatgcttctcaaacttagaatgaatcaagttaaggacacagagagtatcagaaggagagcatcagaaatccagggtctggtgaagggaaggagagatagaggagaacaaaatcacttggtgaccatccagcaggcccgagacaaaaactccttgtctgagaaatttagaagtaattagacttacctattatctaaagacacctagtttcaggcctgttttcaacttaaaatttatgagtaactagaatttatacacatctccagaatgcatgcatgccggaaacgcactgtgcaacccttgccaatattaaggcaccaaaatgtctacaaatataatcatttatcttgcaaattaccctccaggtcctgcttaaaggtccataaatacccccagggaaaaatccagggtggtgctctcagtccccttgctgaggcaccccactgcactcctgcagtgttctatctctttaataaaactttcctttttcaaacctatactgttattaagttcttcttaccaatccacaagtcaattacttccctatgctgggactctgacaccacacccagcagtataaagtcatagaaggcaactaggacaatttccaatgaagcgtttttagagaaaagtaataggcttttgttggctcattgaaatatgacattttttaagttcttaggctaacaagcatttgagagtacaactaagaatttgttagcagaggggacacaattatgattcccatgtttcttaatcaatgaataacatggcggcatgagatagagaactactgaagggcatattttttagatagagtctcgctctgtcacccaggctggagtgcagtggcacaatctctgttcactgcaacctccacctcctgattcttctgcctcatcctcctgagtagctgggattacaggcatgtgccatcactcacagctaattttttgtatttttggtagagacagggttttaccatgttaggcaggctggtctcgaactcctgacctcaagtgatctgcccgcctcagcctcccaaagtgctggggttacaagcatgagccccctcgcctggccaaaatttttttttgttccatcttgttttcatttcggaatgcctgccaccaacttggtgacttgagtcacagtaggtgctcagaaaatggttgttgaatgaatagattaaaggcatagaaaagaaaatcaatgacgatggtaagagatgggaaaaataggaaagaaagaaagacagaaaccccagtttagtttggcctatcaaagaaaaatgaaataagccacgtggaccttcacacctcctgaacagtgtcacagtatttttatcatcatcctgtaaccacccaataggttcaccttgcctgctgcctagacagagcccatttatcaagacaggggaattgccatagagaaagagtaattctagtggaggtggctgggggggtaaaatggactctgtgagggtcctttcctttggttgcttaatgcactatttttgtgctggttggcctcctgccaggaggtggtgctttcaagaaagcatcagctgtggtcgtgtgaagaggaacaggcggtaggcagggactcccaagaatgtatgcactttgtcttcagttaccagagtgggtagggaatgaccattaggtgggggcagggctaggcgtgtctgggctcagactctcctttggcgggtcttgctgcagctgctgagggggatggggtgtggtttccaggtcaatagagctatgttcctaggaggattatggctgcctccactgtgccatgcaagttgtcagagaagtgggggaaaggcatcaatcacaggcctcacccagctcccacacaacccaaagggccggtctcactcccaccgtgccccccaccccccaggccctgcaacagcccgagtctgtttccaggcagtgggcaagcagggctgagaacttgccccacgctacccaacttccagctgcaaaagcaagaagggctttcattctttcccaacctgtagggtctgcacaccaggttcatgccctcccccaagctctggacaggagacttctcaatcacttcaaattgttacaaagctcagctggaagtttccttctccctgtggctttttcccagtgcctcaggcctcctacctccccaaggacccctgtgaggcagggcagaaatggcttgctaggggccccagtgagcccacagggcttttcccgctgcttcctctacccctgtgtttcacttggctctctcaattgactccgatccaggtaaggtcagaatcttctcctgtaatctagaccctcgggttccctagtgggggtgtgtgatctgaggtggacaatccctctttcccacttccatggtttggacactcacaatacttggggtgtctcccaagtcctacaggagcaatccacttccttcagagggtctgtgggttctcttggctgtcctaatgtattcctgcagtttttctgaagcaaaagttcacaatgcaagcctcaacatgctgctctgtccatctgagtgggagctataatctagtgctgccttccatctgccatgatcctctgtcgttgtttgctgacgatatgactgtttacctagaaagccacaaagactcctccaggaagctcctagaactgataaaataattcagcaaaattgccgaatacaaaattaatgtacacaaatcagtagctcttctatacaacagcgaccaagcagagaatcaaatcaagaactcaaccccttttacaatagctgaaaaaaaaagatacttgggactattaggaatatacctaaccaaggaggtgaaagacctctacaaggaaaactacaaaacactgctgaaagaaatcagatgacacaaacaaatggaaacacatcccaagctcatgtataggtagaatcaatattgtgaaaatgaccatactgccaaaagcaatctacaaattcaaccagttttcatcaaaatatcatcatcattcttcacagaattagaaaaaaacaatcctaaaatttatatggaaccaaagaagagccaacatagccaaagcaagactaaacaaaaagaacaaatctgggggcatcacattacctgatttcaaagtatactataaggccatagtcgccaaaacagcatgatactggtataaaaataggcacctagaccaatggaacagaatagagaactgagaaattaacccaaatacttatagccaacagatgtttgacaaagcaaacacaaatataaagtgggaaaaggacaccctattcaacaaatggcactgggataattggctagccacatgtaggagagcgaaactggatcctcatctctcaccttatacaaaaatcaactcaaaatagattaaggactttaagacatgaaactataaaaattctagaagataactttggaaaaacctttctagacattggcttaggcaatgacttaatgaccaagaacccaaaagcaaatgcaataaaaacaaagataaatagctgggacttaattaaactaaagagcttttgcacagcaaaaggaacagtcagcagagtaaacagacaacccacagagtgggagaaaatcttcacaatttatacatctgacaaaggactaatatccagaatctacaacgaactcaaacaaattagcaagaaaaaacaaacaatcccatctaaaagtgggctaaggacatgaataaacaattctcaaaagaagatacacaaatgaccaataagcatatggaaaaatgctcaatatcactaatgatcagggaaatgcaaatcaaaacgacaatgtgataccaccttactcctgcaagaatggccataatcaaaaagtaaaaaaataaaagattttggtgtggatgtggtgaaaggggaacatttctacactgctggggagaatgtaaactagtacaaccactatggaaaacagtgtgcagattccttaaagaactaaaagtagaactaccatttgatccaccaatcccaccactgggtatctacccagaggaaaagaagtcatcatacaaaaaagacacttgcacacacatgtttgtagcagcacaattcacaaatccaaaaacgtagaaccaacctaaatgcccatcaatcaacaagtggataaagaaactgtggtatgtgtgtgtgcatatatatatatatatatatatatatatatacacatatatacatacacacacacacacacacatatatacacacacacacacacacatatatatatatatatatacacacacatatacatatatatatatacacacacatatatatatatgatggaatatggctcagccataaaacaggatgaattactggcatttgcagtgacctggatgagattggagactattattctaatgacttcattctaaatgaagtcactcaggaatggaaatccaaacatcgtatttttgcattcataagtgggagttaagccacgaggatgcaaaggcataagaatgacacagtggactttggggactcaggaggaaagggtgagaagggggtgagggataaaagaccacaaattgggtgcagtgtatactgcttgggtgaagggctcaccaaaatctcacaaatcaccactaaagatcttactcatgtaaccaaacaccacctgttccctaataacctacagaaataaatttttaaaaatttcattaagaaaaggagaaagagtaattcactcagagccagctgtgggggagactggcgttttactattactcaaatctgtctccctgagcattcagggatcagagtttttaaggacaacttggtgggtcaggggaagccagtgagctgggagtgctgattgtttaggtcagagatgagagtcgaagctgtcttcttatgctgagtcagtgcctgggtgggggccacaagaccagatgagccagtttattgatctttgtggtgccagctgattcatcaagtgcagggtctgcaaaatatctcaagcactgatcttaggagcagtttaggaagggtcagaatcttgtagcctctacctgtatgactcctaaaccataatttctaatcttgtggctaatttgttagtcctacagaggctgtctagtccccaggcaagaaggatgtttggggaaagggctgttatcgtctttgttttaaagtataaactaagttcctcccaaagttagttcggcctacacccaggaatgaacaaggacagcttggaggttagaagcaagatggagtcggttaggtcggatctctttcactgtctcagttacaaatgtgcaatggtggtttcagtccccaaatgatttttaactgaaaagtaaatcatttttccttccctcaatgtgtataaacagtactcaagggatattctaattccttcataaaatattagtttttatcaattataataaatgtctgttgtttagaatttactcccaataatccattaaaatttctaatcttccctatgtgttagtcttaaagattaaattcagtgacagaatgataaggaatctgcatttccaatttaactttttcaattgaaattgggattcagacttttggtaaaaagcaaagctcactgaccactgtcaccattctgacaggcagtagctatcttccatgaaccaatgtctcaactagcctgacatattctctgtaaaaagcccattataccttcagtaaatagtttataaattggaaaacataaatcttcaatcagtgaatctggctcaagccttcctagaaccaaaagaaaaataaaatgtgaatgtgtctatgtgcttacattttgaattaaatacacctccctttaaattatccctattgaagtaatagctagccaatttttctacatatactaagtgtgtttatgattattttccttaagaatatataaaaagtatcaggtaagagaaacctgcaaacattacagatatataaggaagcataatctgtgaatttgttcctaaccatattttcatcaaagcatttgaccacagcaagacatcaagctttgccttatgtcaatagtttttaaaaccagtaatctaaaacaaacaaaaaagttgcagaagaaggaaagtattaaataaggaaactgagaggagatgttcaatggcctcaaagcataataattaagaacacaccttgaataaaacagtcctgagccagaatatcaaatatgacattgactaggtttaaaattaaaacaaggtgtctacttatatgtcctttctatctccattagtgagctggggacagtgatgtctactttgcaatttaagatatatatgtatatagaaaggagcagatagagatgtatagatacatatcacaaaatgattggcacccagtggatgttcaattaatagtagttattactactactactactatgactactactactgctattgttattaccacagcctgtttgttatacctggtagagaataagtaacatagaaagcaaatggtatgtccaaaaggagcagttaataaatttgaatctatgcacattcaatccttgtgtttaaccacttgatttatttctctaatttaactgattacattttaatatcttatgctggtatacccctttataattttcacagggctttcaaaaactcctgtcttattctgtttgtatttctatcaaggaacacccaaggctgggtaatttgtaaagaaaatacatttatttggctcacagttctgcgggctgcataagaagcatggcaccagcatctgcatctattgagggcctcagactgcttttcctcttagcagaagtcgaaggggagcaggcaaaggaaagacgccatgtggagagttcatagggtgagagaggaaatgagagagaggaaagagaaggatcaagacctttttaacaaccagctctcatgggaactaagagtgataactgaaggagggcaccaagtcattcattaggggtctgcccccatgacccgaatatttcccattaggccccacctctaacagtggcgatcaaatttcaacatgaggtttggaggggttaaatatccaaatcatagtgcaccaattgctatttgaattattttcaacaattttttggtctattttatcacactgaccaaatattattctgaggcagctgcagtattatacgtagcattctcaaattatgaaataacagagatggaaaattatttaggttggtggctcatttgacatcaaaagaaagcgaggcctaagaaggttgaaatcgcttgcacaaagctacttagaaataaatgaaattctaaaacttttgcaataaataaaacaattaacaaaagatatcataaggaaatattcaaagttcaaccagtacagcaaccattctaaatgatatttaatacaaaaacaaattcaaaacaacaaaaaaaaatgtgggcagtttctcagcacatgcttgctatgcaatgtggacctgagactaagtatgtcaatatccatagcacaagcaccgcatcaccccagaacacagatgagtacattctgtgtcaatcccacatatgtttccagagccacattttgagctatgtttaaagtcattgatgatctttaaattgtgcacactgcattacaggatgtagagagatgtttcataaacatctgacttattttgactttcgatattgatgtaattacattttgaggagagtttcttattcctatagtatagaaatgccaaccaataattctcttttggggcatgactttataatagagcactcttcaattttttttagttgtctgatccttccagtgatacaaaatattcatgacatgtttacctcattctctttggtttaaccccgggaaaaaaaatcaccagaattgatacaaagctatcattcttttcaaattcagtttttaaaattgtaagtaaaatattattcacaacagaaaccaatgtagataacattaccacattatatatataaacatttaggtgattaattcatagactacctaaatactcttaaatattaaaatttacatagtagaatatttacagttttcacttcacaccaagcactaggtttagcattgtaatattgttatcatgattaatcctaatgatcactctcttagacaagtgtttttttttaaattatatcttgacattttacaaataaacaaactgaaagtttaagtaatttgatcatagtcacataataggaatgtgaaccaagtttggactgactctaaattttattctcttttcactatggtatgcttcccctctaaaaaacacattcaaatattgtttataaaaatttaagaaaagcaaatgcttctcaggattgccccagatccgatatcaaataaaagtaaaattttgctgtggtacacactctcattatggccagaacactcctccatcctgttctctctgtagatgccacagaatatttggtggttgtatacatatcagaggcagcagtcacaggagggacactggagattgtccatccctggcaaggatgaacaataaaataccagcaaaaggaaaagtcacttgcattgcatagcagttctacccttctcttatatagcctttcctttaccactcccatacattgtgtttttactttatttcttttctcttcctcatttgcctgctcagacacatcacatttaccagtgaactccctccaaataaaagtagagagtattgagataaatacataaaaccatagtaaaatatgaataacattctctactctcattttatcctgatattttactatccaatagtgactggtatatgtgtttctgattcagttcctaatatacatgaaatcccaatttgcatgaagaaaaatatctttcgaataatctcagcaaatgttctgcaagctcctagtagggtaccaggtacacagtggttcctcaataaatatatattcataaagacagtgatgatgcatataataattttgatggacttgttacatttcaaggcagctgtagttcatgacactagagtaccatttaagttatctcagtgactactaatcagtgtctcctattaaaagcatattgtttattaagataaagttaatgtaagaaactttaaagtgctactttgcacatttagattttcttggtgtttaaaactctactttagctttacctctaaggagtctaaaatgtgagatgacagctggcacaggatttcagagaaaacagatcaaataaaatgagaatgttcccagcatgttggacttttcaccaaaattaatgtcaacaatcagccaaaattgtgaaatatatcagaacacacatctgatgattcacagggaaattagcaccactcaagatttccttgagcaacaattcctgttacccagcctcaaacagtacacaccagtgtgtactctgacactctgggaaatcactaatggcatctaggacctctccagcatcatatattagggcaaaggcaggccccaatgagctagcctccaagaatatacctgggttgcttgttcataacattctccacttccaacatatatttaagggtttcttaagttccccacttaagtaattttggaatttactcttaaagaaaaacatttaacaataatttaaaccaatgtgcttttagattatatgatctgtccaggaagtgaaaaaatcattattggcaacagtttttggctgggtttaagaaaggaatacgttgacatttgcacatatatcaatgcataatattaaattgttatgattcaaattcactgatcaggaaaggctatgagtaaaaagaacttctggtgagtcaatgtcagctctcttttgtctggtattctggagaatgggagttcactaacaatataaaacttctccaagctaaagagctctttcatgactctcaaaagtaagctgggattctttcaagatcaaacattctcctaaaatcttcacaacttcgtgaacttaaaaatggcatgaaaaaaatttttatttccagtctttttacaaccctgaaattccagaaaaatgttaaatatgatattaaacattcataaaatatgtaaagatattctattgttgaggttgagattaaaaaagaaatggaaatagttctcttatcactagcaaataaacagcactgctataatgcaattaacacaggcattaaaatatttgctattttaataggtaaaaagcaatatgctagttaaatgaatttagacactcatgcatagtattaagtgatgcttttataatatttgcaaaaccttaaattggagcattttttctctaaaatgtagatgcccttgcattatagcttttcacagaaaccttgttatttatgagcatctggttaccttctcccatctctatagtctgcctggacttggcataattgtgatacgaacatagatggcagatgccttgacttttgatgtagttaatcatgactggaggcattccaagacattgttcctgaagaaatgtggcagtgtgtgggctcttgtgtaatggtaaacaaagcaatgaagttcctgcacagtttctctgcttattaaagattttggggtatatttcctctgtctttaattgctattaagtagacctcttttgacaatattgagagaaagaaaaagctgtcttctgcatactatgtttaatgctgctcaataattaatcatagaaaatcaattgcctgtattttatacctgattgtagaaatttggtggaattcttttgcatgtgaaatgttgataaatcatcaactcaacaagtatctgttctcgtttctgacagtgagaaaaaccttacaaattagaaaatagaggaaaatatggtgagtgtgcttcccaaaattaaaacaagaaaagcaatcaacttcagagtattcttgtttatgtaaaatctcattttctttcaacaattttacttaaccagttaaaatatttattctttctcccaatgcaatcattctctccactaattggcagaacacagtaccatcaatgcagccaaaaacagaggttttactctgactttcaggcttttctgtggaagttagcaacattcaatgtcaaattgataatagaatagaagagaatggaagattataacaccaaagccagagacaatattcttggtagaatgaattcaaaaagcaaatgtgtactaaacaaagtggagacattcctcctaaatcattggtgttgataggcattatttcaagcttagccttttcatacagcaatcatcctgcaagttgccttttagagcattccttatctcatacaaagctgtgtgaattcaaagactgaaacaaacaaacaaaaatggtccagaaaaactaatgtaaaatagaagatcagcatgcagagataccacttcagtgtggaagcatcttaaaaagaagtgtcagtagcccagaaatgaataacaaatattgctcagtgaatctggccattaaaccaggagttgtcaagttcaagaagtttcacatttttcaaaaattgtagcaatttgccctaatattaaactgctaattgatttggaaattttttcttccaggttgcatctctctttccatgtgatgtacagctctttgtgtttccttttttcatttttaataaatgctctgatacaaaaacaatacaaaaaacatattgtttccattgatctttgctgcaccagcctaatatttctttctgttctttaaatattgagtgtttttagagctctcctcctacttgtcactttgcttcctcctagaagcaactcatttctctgtcatcttctccagttgcttgttcaacatttgctaacattttcctctttgaaagatatagccaccttcaggattcaaattaaaggcagcatcacgtaaagaatagccaatcttgaaggctatgacctacacatttttgcctggtaaattctggagtataaattcatatatctacaaatgcatttagtaatttatatagtcttatcttctgaaatataactttatacattgcttggaatttagggtagagtttgtatggcatgcctagcagggcaatagatgacacaacttcactacagacaacaatattgcacaggataggtggtctcttttcacttcacaaactaattaattcacaaaccttctaattgtctttcaagaaacaaatggttataaaacaatgtcttttgcttaattttctcataataaaatatattatctaattagaaacttttttgctatatctattttcttgaaatttgtacttccttcacattgtgcacttgcaagaaagtgaaacaataaagcaattaggtggggaagaactatgaattctaatattgctatattattatgtattccatagctctttattcactagcttccctggaatctggctaagaactaagaactaatgctatcccacttttgagaggaagtggaacacaagtttcattccctctgacctggcctactcagtaaactatacccctgcagtgggaattagaatgtattccccatcctgcctgccactacacacacatatatcaagcatgagtagctctttttctcccctccatgacactaaacttatatttaactaggtctgccacacattgagagaaagattgtttggttttgaagttggacttgcctttaccaaatatgtcagtagttcatctctgtttctgaaattggatttgcataactccccctctgttaccattaaattaaactgctaagacataacacatattgaattctgttcagagacattctgtcattactaaaagtgtgatcctctctttaaaaggtaaaagaaatcatatgcgtgagtgtgtacacgcgaacaaaacgtgtgtgggagtaaaatgtgaactgcagaggttgcctgccagcagcccattaattgaagcttcccttgtttttccaaattcgaaataattcccatctgccttggcttactctgagcatgaaatccaagtcccttagcaggagatcgggggagctacagactagatcactgaggcagtttatgaatgttagttttgccccatggggaatatgaaacagaggtttcaaagtactctgcaatgcttgcttgtccctgaaacaacatgcaattgcagataagatgataatctgctgcactgattaccaactacacatttgcacaagtgggttggttatgtgcaaatattttctttcagaaacagtgcaggtgccctgtagccttttgctaccctgactaaaagtatcattaagttctgtgccgctgttatgatttaattcctgtacatagcagtctgtcacctccattcatatagagttcctcaattttatattcccagggctatcttataaaattgcaccacccctcccttcagccacccatttgcttttccttgatagaaagatgggatctcactcctgagtcagcggctttttaaattattatttaccccactgcacattcaggctttccgtaataatagctcttcaattgctgtacacagagtaaatccgtactttctgctcatttctttttggggccctatctccatttataacttttctaaacttaatacaaacagataatgatgtaccatcattttattgctcatgacaggtgagtttttaggacctctggtctttcaactttctcttttcatcagcatactctatataatacctcttccatccaaatttttttatttcatagtcttttgcctatataagtttattctgaaataacacaccataccgattatatatctacttaaaactaggttctacttttgatcactcatgtttaccatatgtatttctctcatattctgcaacttttcatcttgagctaattgttcaatttatttaaaaaatatgtttttctgtgaagaataatgcctcagaaagtattatcttaaaaaaatgaagtccatcagtaacatgcccagaaattgtcagaagtcatgcacaactgtacttctctctgtttgagacggaatctgctgctaaaggacatccatggaagtaggaagaggaatatcctgaaaattacagcgaatggttaactgaaagaaagacagattggtaagccatctgtggcctgactagctttgggaagaaactagatcagctggctatctgtcgttgctctaatttacaattcccagaaaataatcacactgccatttctcggcctgttctcatgtctctgccacctaatatccgcacaaccataggcaagtaacttaacccagatattctctgtgcctctttgtttttgtaaataaagtgctgataatggtcattcgtacctcacaatgtcacgtgcgggtttactgagataaaatatggcacgactctaaaaacaatgaataatgtacctgacaaaatgtctaccacactgttaaatattaggtgctcacactgtcttggttactcttactgtctaatatttaatgtgaagtagtctgttaatcttgtggcatttgcgtttttgctttactggatattatatttttgttaataaattgtttcttctccaattaaaatcaagataggcatcttcctaaatcacacaccttggcaggcttcactttttatttcacaaatcctatgcatagatgcttatacaaaacattagtactttatgtacaagtctattcaacacttatgcctatcacccaccaagatatgaagaattcagtcaataattaaaattgaaagcctatacttatcctttgtatgtgtgggaagagggtggttttcatccggacaattcaaatcagtcttcttatttatattaaatataagccactctttttacccatgaatatcaagcagaccatacagatttccaatcagagaaagaagtactaagcctgcttcagtgtacaggatttttttcagtccctttctgcagtctattccactgtttatcatattctgttctttctcatttgaccagccagacattgagtgtaacaccgttgcttgtttcaccatatctgaaaaccaaaaaccaaacacaaaccaggcatgtctcttgtagatgactatttagcatggtctagcagagtgagtcacctaagctaacaaatagctgccatctttatgcacagcaaacaatgactatcttttactcatttatcatccaattccataaacaatattaggctcacaatgcatgctacaattagatcgtttaaatatagaaagaatgtgcctaccacctgccttcaaagactaacacaataaccacatcatctaatccagctgctgttttctgttcatgagttatttaaaaagaaaactccagcatgatataaaacatgctttaatcactatacctaattatcaagaacagtaaataactttcacattaattgacttcaacatagcaaagttaataattaatcattacagactgaaattccagcatgatattgtcaaacaggacaaaggcccagaaactgtgaccttacccaccactgattccacccacatttcccacgggtgttttggagaaaatgtctgtcactagacatcagctgtttaaggtgagatttcactgggctttaagctaatgcttgtaatatattctgaattaattggatgaatagcattaaatattaataaaatattatagtttagttgtcttaatcttattaatcttccagtccataactcattctctctgcctgtctctctacccgactcgttttttttttgtttgtttgtttgtttgtttttgttttttttgagacagagtctcactcttgtcgcccaggctggagtgcagtggcgtgatctcggctcactacaacctccgcctcccgagttcaagtgactctcccacctcagcgttctgagtagctgggattacaggcacctgccaccacgccaggctaatttttgtatttttagtagagacggggtttcaccatgttggccaggctggtcttgaactcctaacctcaggtgattcgcccgcatgggcctcccaaagtgctgagattacaggcatgggccaccacgtccagccctgactctcatttttactcttactacatctcctttttttcttaagaatcagaaaacacttttattcgtaatttactgaatgtttctgttttatgtcttaaatgacaagctgttccgtagactgcattaactaatccaaagggttcaatgactacctttggagctttctccacgtaactgaaagaactaacccaggaacaggttttgagcaggaatgtcaagggttagatagttgtactattttttcaaaatgtaggtatttttctattgtgatatgcctctcattcctcagtgagatggaatttttaaaagcttaacgtaatataggtgtacttttaacgtaaaagcttttgtttatctaactaccctagttggccttcaattctagctggatgatgatctgtacataaatagctggaaagagaaataggctacattttactcagatttactgtatcccacaacacaattataattgagcttattctaaatcatttttcaattataatttaatttttcaatcataaatttttttgagatggagtctcgctctgtcacccaggctggagtgcaatggcacaatatcggctcactgcaacctccacctcccgggttcaagtgattctcctgcctcagcctcttgagtagctaggattacaggcgcatgccctcacgcccgggtaatttttgtctttttagtagagacagggtttaccatgttggtcaggctggtctcgaactcctgacctcatgatccgcctgcctcagcctcccaaagtgctgggattacaggagtgagccactgcgcctggcctcaatcataacttaaaaatagagactggcatgaggagatttgatagtctcctaattgtaagccccctggcttggaagtagtgtcaaggctttaatgatcaaatacttggagatataatgatattacactttattgtcaccaattggacatctgtatctttctcctacatttttcaggtctgtatttcctgaataaagccttggcattgtacaacaatgactttttctcaatcactttcagttcaataagttgctttcattgttttctttatttcctttcatataaattccagtaggagagtatgagaaatctattatataaaaccaagtttttaatgtttctgttcaaaatgtttgaaaacttcagaattgaaaggggatggggaaatgggtaatgttactttaggaggcctaaggcctaagatatatagaaaaaatataagctagcttgaggaagttgttgtagtatatcggctattttttataaaggagtgcagagtgaagatgagagaagcttaataacccatgcttcagtgttggaaggaggaaataagtgagctgacagcataaatattaagaaaattgacaataatctcagacttttgaaactgaaggaactcatgatggagtgatgcctgatcaatggctattctattataataaacttttcttcatttttacattctggctaacatcatttataaaagaggccctggtgagggaagatagggttagataaggtcacagctaagagtaattagaattaacaataatcaaaagtttgacaattgaattatgatgccagaaaattcagaaccagaaacaggagagtgacttgtaggggctagacagtctgcaactcacagctactttcaaatgacaagaagcttgatggaaggcttgcatgctttggatgacatcagaattaaaacattgcatgtaagtattagaacataaagcgaagcccctcctttttagatgaggaaactgaaatccattgagaaaaagtcatttctgcaggtgattcaattagctactggcaaaaccaagataagaactctctcttgactcgcaatctagcactctttctacattacacaggaaattaaaaagttgaagttaggcagaattcattcattttttccaggtggtattatttgttcaaattatactttgctgttccttttaatagtaataagcaattagttgattagtatttaatctacattagggtggtgtgatagttaatattaggtgtcaacttgattggattgaggaatgccggatgactgatgaagtattgtttctgggcgtgtctgtgagggtgtttccagtagaaattgacatgtgagtcagtggactgggagaggaagatgcactctacatgtgggtgggcaccattcaatcagctgcaagggcagctagaacaaaataggtggaggaagcatgtattcagtttgctgagcttcctctctctctttcctctctctctttcttccagagctagatgccttttctcctcctgctcttagacatcagactccagattcccaaattctttggcttttggcactagcatcagtggccttcgatgggttctcgatgaggcccttggcctcagactggggtctgcattgtcggcttccctggttgtgaggcttttgaacttggactgagccatgctactggcttttctaatttcccagcttgcagatggcctgtagtgggactttgcctttgtaattgtatgagccatttctccctaataacctccttttcacacacacacacacacacacacacacacacacacacacacacagagagagagagagagagcgagctatacatatatatatatatcctattggttctctccctctggagaaccctgactgctacactacgacaggtggggaaagagagaggtcaatgttacataattgaaagagcactaaactagggagacctaggttctagttccaggtatttacacaaactagcagtgtgaccttagaaaaactacttaacctcactagatccaaccttccaaattacaaaccaagaggcttgaactaaacagtatctgtgatagttagttttgggtttctcaatgtcaggaactacatcctttatttctgacatatgccttctccttcctttagtagtagtgcctagtctggggctctgttttactggttactgagtcaatgctgacagaaataaggattaacagttatcatacgatgtcaagggatgcagataatcaagaaatccactgattccaaaggtaggtaatttgaggtctaaaataatacgtaaatgccttatgttcaacaagtacagggggaaagattgaagctttgctgaggagggtgttctttcaacacatctctgcttctgatcctttatctttagcattctctgtattggtcaagaatgtttggtttcgggtgtccagaatcctacttgagaaagcttgagcagaaaggggagtttgtttgttcctttaactgggaagtctagcagtggagttcacctctaatatgactatatcaaggacacaaacaagattagggcccttccatctctactttctgcttgttgctacatactggaatagctggccatttccacagaccagctcttccaaatatgaaggatgtggacaccagtatttcagccctcccatactcactatttgcaatctgagagacaaaaaggccatactaccagcatcagtgagaaaaatccctggggaagactttgattggctcagttggaatcactttcatctcttgtatagttatcatggccaatggccagtaagatagagtattattattgtcacaccctggccacatgaggaaattgcttttgtttctttaagccttggttttacttttttaattatataatgaacttaattgctcttaccacccaacctgagaaccataacaatgacagtaacgtacatccacttttgtgcttctctgctagttcatctcctacttccctctacctaagaagacactacttgatttttattttatcatttccttatgttttcaagtaagttttatctcatacttatatattacatattacaggattatactattaatgagatcaaacctctctgtatacatttattagccatatgtattttttatcatttgcgagatgacttttattgactttgcccatttttctgttcatgttctttgttgtttttgtattgattgatctatgggagttttatttacattgtgagtagcaggtctatgacagctatgtgttgcaaatgtcttctctcagttagtaggttgtcttttcactatatttaaggtatatgttaatgaaagttcattgttaatatatttaaaataatcattattttactttatggttagtattttatatgttttcattaaaaaatctttcatcttccttaaggtgatagttatttaaagttcacacaaatagtactaatgtttgcttttggcatcaaaccacttaattcacatggagtttattttttgtatatagtttgaggtagagatttattttattttttccatgtggataactccagatctatttattgaatacttcatcctttcatcacagatcttccccaacatcagtgttaaattgcaaagtttccagtacgtatgatatacctagtatttaactacttgccaataaataatttgaaaactttcctccaaacatataaaagctggattcactttctatatatgaggcacttgcaataaatgagaacatttcaacagttcattcaagtggaaaaagaaaggttctgtatgtagtttccactccatcatttatcaggtaggtttgtgcttcataaggtaaagtcatgtgaaaggagtgatcgagacagtgaattttctttgtgtttgtgctgctaaccacagtcagttcatgaaatatttggaagaagataaacaagataagatatttaattttgttgaatgctgtcagatggctaggtcataaaacttgctaaagaaattcactgagcatggactttggaattaaaagagctctaatgggctaaaatttttggatccccatggttcataatattgtactttctcactgatgtgacaagatatctgactgcactaaacttgaaacttcagggaaaaacaaacgcactgctgatacattcaaggaagtatgtatttgaacttgaactgaccatgaatttagcaaatattatcggaagattgtatgcatttaatattacagaatggcactaaactcattttttaaatgtagagctatttgtagaaagaaagttgcaattttgaaagagaggcaggagttttaataaatataggtcatgcttcaaatttctttagctaagaaagaaaataaagttaaaagacaaatgcagaaaggtatgtatagcatatatttgcaattcatgatatacaacatgttcatattttaatatactaagaccacctatatatcaacatgataaaacatcaatagaaaaaaatggacaaaagatatgaaagggcaattcacagtagaagaaatacaaatggcaaacatgaacatgaaagtatatttaatcttactagtaagaaaagaaggcttttgaaatatgaagtgtcattttcttcaattggaatagctaaaatttaaaaggttgacaaattccagtgtagctgagagtagagataaataggacctctcatgaatcattgataggagtggaaattagtataacctttaaatagggcagttttggcaatacttacaatgcacatacactctgattcaataatcccattgagagacaattctcccgtccatgggtctcttgcattactacctatcttgacagcgaggcactgacaattctttgttcttgaccacttttccaaggatgtttatgtagtggaagatggaggtattgcctccctctagtataaagggacagattttcttacaacttgagatgacagagatagtgtctcaccccagagcaaacaggaagcatgattactgcccattataagattcaggttccctaaactctgggtttttctcctataatataattcactatgcatgaaagtgtcacctggtcctctttcagtcactctggaaattagtacttaaggaattggtacacgcacgtacacacacacacacacacacacaatgctgatactctgggctactgtgaatgttgtgaatagtaaactgttctctatctttcaccagggaattttatgtcttctaccaacatccatgaaactgtgggaggctaacatgtttcctttgcaaataaggcaaaatctcagattcttcacccttattgctagttattactttgagaactttatcttgatatggtactagcacaataattcaaagataattgcaaaaatatgtttatggcactaatacttctattgcagaaaaactgaaaacaacctaaatgtccatgaaaattgctcattaaataagtcattacctgccaatgatagaatactgtgaagccataaaaaatgaatatatcgtcctatagttattgaacatgatagatatctgtgacaagatattaactataaaatcaagttattgaacagtgtagtatagttctatttttgttagtaaattaatttctttctggcttcctctctttcacacacacacaaacacacacacacacacacacacacacacgtcccacacgcatttcaagatagatatatatcaatatgttagtaatggttaactcagaatagtggattatagaatgattttaagtttttctgcttatctatattttctgattttcctaaaattatcatgtgttatttgtacatttaaaaaataaatgattcatgctaaaaaaattctgcagctgcctttggaattcatatctcaggaagtatctgaattatcacacatctgacccattagtgaagctcatttcaaagaggaactgattgagctgaaagcaaactacacccactacataggcataatatctgtcaaattttggagaggaaaatataattgcacaaataattctaaaacttctggctatgtgaccaaactctgggctatgtctgggtccatctggctctatgaaagcatattttcctttatgtaacttctgaaatcactattaaggccactagagatggaaagctggagttactgctttgagtaaatttacccttggttccagaataagtcctctgatcacagcaatattctcattgatttgtaactgtgcattttgtataaacacaatttttaaaaaataatttaactgatttttatcactgcttaaatgcatgttttaaaatatggaaggttatacttcaccatgatctttatatataaattacataaatatgtctttcttttttcctcactttaaatcctcaagctcacaaaagtaatagaatatataaatatactattctctagtattatcaaaatgcttagtttttcaaacttaacattctatttcatacttccttttctgttctcatgttattccttttgcttacagtccctccaccaccctttttaacctagataactggttaatgtttaagactcagtttagccatcatcccttccaagaaattcacctcaaattccaacatgtgatctgctctcctcactgataccatgacacccatcatatatttgtgtttacttcttgaacaaacatttatatataaaacaatgtacttgatgatcaggatataagtgagcaacattagtcatgactcttaccttcatgggacttatggtttatcttgtcagttaccacattaaaataaaattcactattttatctttctaccctttctaagttataagctccttaataccaaggcctgtgtatattcatatcagtccccttagggactagcactatcctgaaatataataggcacacaacttgtgtttgttgaactaaactgtctgattattccaaagacaaaaatgtcatttttccaaatcatcagtgccttgactctcttatgtgatctgtccctactctctgctacggatttttataaggataagagatcctatcccattaggataagtggggagtgggagatgttggaggaaaagaaggtataactcagaaatataaagaggttaactcaaaactgtagcacgttttctacttgctcttcctgcattctcaccacattaactctatactatcatgtattctcaaatcatgtcttctctcacatagacgaattaaagaaaactatgtgtgtgtgtgtgtgtgtgtgtgtgtgagagagagagagagagagagagataaattggacatcttcctaaattctgatgtagacgagccttacatatgaatcaatgagtcagcattaagtagcactcataacacacctgagatgccaaaaatgatacaggcacccaatccactaaatgaaatcgggtcaatattaggatcaatttggcattttcacttgacttccattgtcctcaaaactcagtttcaatccattcaccccattcacctgcgtttttatgttccaaatgactggcttccacattatcacacatgagagctcttgggatggtattttaccaattcacttttggaaactaaaatagcaatggctaaggtagtcaatgaaagataatactgtatgttacctagtagtattagatgcagtgagatccaggaagttgtcactctgtgttagagtgacaaaaacgcaaggaactggtctgacctactgacatgacaattatttagatataattgttcagatgatttacagaactaataccctgagtagatctttattatttaacccttccatactccattccttgcttcacccagctccctctccctattgcttaccctcaccctccccctctcccaacacacacacacacacacacacacattttcacaatctacaaatatttctctactcaagaagatagtgtggctcctgtatttatcttcacctgcttcttctctattatttgcataataaaaaaataaatgttaaatgttttttaaaatgtgtttcttgtccattttactttagtgttaatcacattttccactttcctcttgtgttatgaaggaaaattaagctccctcctccaaactgtagccactgttgtttctcagccttttggctgaaatcatgtgcaaattgtaccacctacaagattatctttgccacaacaggtaagcacctttaaattctattcttgtaccaattaattcttataataaatagaggtgactcagtctctgtaatgcgaataaagtaactctattatgccctatagctatgcatctttattttaaagagctgaaattaaaataaagcacagttaactaaattgtatttcaatctcataattattagaactttaatcaaattacttggtcattttttctctctttgccaatattgtaaaagctattttgtagaatatgtttcagcctactttccagcaacttaaagaaaagatgaaataggtacttgtcctctggaagctctgtagctacctgtgtgtattttttatgctatgcaaaaatgagctcattttttctatgaatgggctaggtaaatgcaggtagatttgacattttaagattgtcatcaattctgagacttgttaccttccttgttcctttaagaaatcaatttcattcaaggtccttttccccctagaatttggcactggggtttcaaatgtatgctatcaaaggcaagattaaataggattgtatcaagttgaccaaggttcatgctaggaaccatttcagatattgtctaacattgaaaatacaattcttcaattatacttcccagacaaaattaaattaccttgaatacatggtctagttggcttactcctgataatacaatgctaaatgatgaaatccatccttatagcaaagtggatctgataaaacatttaatatatcataaaaaggaagaaaggtaaatgaaaagcaaaagacccaggaactagtaaaatgtgatctctcaaacagtttgccgtctaaagaacctcacttaccccttctacgctaatggatgtaattacgtgttgacttgttgaatttatctttcacttacctattattaatataacacatttatttgggctctttgctacttttaaggctttcaggtttctgaagtattattttcttcatgcctattgaagtttaatgaattctgagtacctcacttattgtaggtaggctctgaatggactcatattctgctttgttatgagatttccatgaggtggggtggatttcaacaattcagtgtgaacattctgaatcatcattttttaaatttatcattattattttggagatggagtctcgctctgttgcccaggctggagtgcagtagcgcgatcccggctcaccgcaacctccgcctcctgggttcaagcaattctcctgtctgagcctcccgagcagctcggactacaggtgcacgccaccatgcccggctaagtttttgtattttagtagagacgaagtttcaccgtgttgcccaggctggtttcaaactcctgagcgcaggcaatccacctgcctcggcctaccaaaacgctgggatttcaggcgtgagccaccacacccagcctgaatcatcatttttaaaataacaaaaagtagcacaaatccactgaagaaaatttagaaaatacagaaaatctaaaaggggaaaaaaaaaactaaaaattacttgaaatctcaccatgaattcattaaataaacattgttaaaaattgtgtgtctttagtattttctatacatgtatgtgtgcataaatatcataaaatcacattcaaattctttgttttatatcctgctttatgtaaaattaaattatatacatttctcatgtcattacatattattttaatacatgcttcttgatggtgtcaatattccatcatttgaatgcatcataatttatttaaataatccctcatctttgactatttagactgatttcaaatgcttgttattaaaataatgttgtggtcagcatccttttaaatatgtctttctatgcatctctgattgtttctttagaataaattccaatatgtggaattactaggtcacagagtataaagccatttaaggatttttgtatacatatcgctacaaactctgaataaactaggtatcgatggaacatatctcaaaataataagagctaattatgatgaacccacagccaatatcgtactgaatgggcaaaacttggaagcattccctttgaaaaccagcacaagacaaggatgccctctctcaccactcctattcaacatggtattgcaagttctggccagggcaatcaggcaagaggaagaaataaagggtattcaaataggaaaagaggaagtcaaattgtctctgtttgcagatgacatgattgtatatttagaaaaacatcgtctcagcccaaaatctccttaagctgataagcaacttcagcaaagtctcaggatacaaaatcaaagtgcaaaaatcacaagcattcctatacatcaataatagacaaacagagagccaaatcatgagtgaactcccattcacagttgctacaaagagaataaaatacctaggaatactacttacaagggatgtgaaggacctcctcaaggggaactacaaaccactgctcaaggaaataagaaaggacacaaacaaatggaaaaactttccatgctcatggataggaagaatcaatattgtgaaaatggccatactgcccaaagtaatttataaattcagtggtatcccgatcaagccaccattgactttcttcacagaattagaaaaaactactgtaaatttcatacgaaacaaaaaaaagagcccgtatagccaagacaatcataagtaaaaagaacaaagctggaggcatcatgctacctgacttcaaactatactacaaggctacagtaatcaaaacagcatgatactggtaccaaaacagatatatagaccaatggaacagaaaataggcctcagaaatagtgccacacatctacagccatctgatctttgaaaaacatgacaaaaacaagcaatggggaaaaaattttctatttaataaatggtattgggaaaactggtgagccatatgcaggaaactgaaaatagaccccttccttacaccttatacaaaaattaactcaagatggattaaagacttaaatataaaacctaaaaccataaaaaccctagaagaaaacctaggcaatacccctcaggacataggcatgggcaaagacttgatgactaaaacacccagagcaatggcaacaaaagacaaaattgacaaatgggacataattaaactaaagagcttctgcacagcaaaaggaacaatcttcagagtgaacaggcaacctacagaatgggagaaaatgtttgcaatttatccatctgacaaagggctaatatctagaatctacaaagaacttaaacacatttacaagaaaaaaaacaagcaaccccatcaaaaagtgggcgaaggatatgaacatacacttctcaaaagaagacatttatgtggccaacaaacatatgaaaaaaagctcatcatcactggtcattagagaaatgcaaatcaaaaccacaatgagataccatttcatgccagttagaatggcaatcattaaaaagtcaggttacaacagatgctggagtgggtgtggagaaataggaatggttttacactgttggtgggagtctaaattagttcaaccattgtggaagacagtgtggcaattcctcaaggatctagaaccagaaataccatttgactcagcaatctcattactgggtatatacccaaaggattataaatcattctaccataaagacacatgcacatgtatgtttattgcagcactattcacaatagcaaagacttggaaccaacccaaatgcccattaattattgactggataaagaaaatgtagtgcatatacaccatagaatactatgcagccataaaaaatgatgagttcacgtcctttgcagggacgtggatgaagctggaaaccatcgttctcagccgactaacacaggaacagaaaaccaaacactgcatattctcactcataagtgggagttgaacaatgagaacacatggacacaggaagggaaacatcacacacaggggcctgtcaggggatgggggactaggggatggatagcattaggagaaatacctagtgtagattatgggttgatgggtgcagcaaaccaccatggcacgtgtatacctatgtaacaagcctgtaccttctgcacatgtatcacagaacttaaagtataataaaaagacagatgatagatagatagatagatagatagataggtgatttgtcaaagttttgtctagttttattatcttcacagattattaagcaagattgtggagaatatatgtaaaagtattgacagtggtaagggagagtagtccagataatttgaaatggataagccaagtaccttcacaaactgtgattacactaaggaagcttgtaggtaaaaatgactttggaattatttatcctgatagcgactgcacttggtgtgggcggagaaaacccctttggtactgtctgtattaaaagatactttgacaggctattaccaataaggtgttttgctgaaaatttagataaattagacagttagatgtgtgttaattgtactctcatattcgaaagagcaagatttactatagccaagatcctcatagagaacgaatgtaaatgatggcatgatttttaaccttaatattattgtaaataatggacatctttcttaaaatacctaggcttaaccactgacttgcattagaaatcatattttaaaagatgatatatacatagaataagattaataaatataaacttttacctaagattcctttctcagtaattatgaaccaatatgctaattattaatctttgttcactttgtccctaacctcaggattaatgagaatactgcttgaggatcaaaaattttctactgcaacattacaactctttgtcccatttaaaatgaaaattcttgcaaataccacttgatatgttttcctaaagaataactgtctttaacaaaagatcaaactgcttccaaatcttatcaaagaggaggcatgaagttatctttccagcatccccaattatgattattaattactacaattttcctctatcattgtaaaactctgtgcaaatctctttgcttgcatggcattctttcattcaaaggactgtaattttcccttcctcagtactaattatttgccctttgaaaaaatattttatttatacttacatattttgaatcaaactatttcctaccaacacaacacacaatatcacaaacataaaacttcagactattttttaaaagtttgatgttcaaaaccaagtttaccgtagcttactttaaaaatcacatttatacacaacttaaattttgaactcttgtcggacctataatagtttcaacacagcatgttgaaaaacaacagcatgaacaagaaatttcagggcacccagaaagtgtaggtacatcttaatagccatctgtctatccttctaaatcaaataaagcacacatatttatctgttcactcttcctcaatacggtgggagatactttatgagtagagataagcagtatttagctatgtttatcttttcacttaagggtagaagatgagagtgaattggctgtgaaagcaaatattgtttcattaggttatacaagattgctaaaagtcacctgaataagtgagggcactacagttaaagcaccaaatctcctatgatctttgaccagtagtatttttttttaacagtgtgtcatcacagtgtaaaatatgagttaatcttgatcaaaaagcactcactaatgatacaaaagttctgatacatcacgtatgggatgctctaataggtacatcacatcaattcaaaatggagcttgttggtggtaaaaatatgattaacgaaatgcaccaacactcaacagaactgagatgtttagctactgtaaagatctaaaccatcactgatgctttagttccagtatttatcccacaatccagagaagatatggttctcatttttgagtgagttgtggtgaccatgaggctatatagtaactttggagtcagcccagaggattccctgagtcctccaaacctagtgtttgcttgcactgattcttaagtgccacaacctgtctccaggaatctaaaactacaacatccagaagaaagccaagttgaacaagaaactgtggatcttctttactctaggccaacagtggtagacagaggcaaatccatttaatagatacttgctaagtacctatgatgtcccaggtactgttctagcactgtagacaaaagatataaacaaaacaggcaagatccttggcctatgaaacttacattctgattctgcactgatgctctataattgaaaaataataggtaaaaaatatcacagcaaatgttatcatttcattgtttgttttctgagaagacggctcttctggaatgcaatttaaagatgggaagacatgatataatcagcaaaaaaagggcaatttcaaagttctgagacaatttaaataaaaggctctttttggaaaaaaaagtaaagggagtgaatggaaagaagctttgtttcataggacaaaaataaaataacgtggaatgtagtagaagaaataagaaaggtctgtgtcaattttctaaagctaattagtattataattattgagcacctattctgtgccaggcactatgttaaggattcaacagtaaacaaaacatactttgctgtctccagtctgtaatcaacatgaagtatgttgagcataatgatggaggtgatggggcctatgggagtatacattagattttgaacaagtctgaagggtaaagggaacctttttgagagagtaatatctatctgagatttgaagaatgggttgggcaaggagagaaggtgaaagaaagagtgtttcaagccgaatgtatagcaaatgtgaaggcctaaactacgagaaagggcatggcatgttccagggacagaaagatcagagtgcctggaggttggaaaatcagattgtgcagactctaaaaataaggtgatgattttggatgttatccactgaagggaattagtcatgtgaatgttattgcatttacattttttgaaaaacgatctttctgtctagtgtgaagaatggactggaaaagaaaatgatatgatagaagctctgagaagacctacttttaaattccatatcaaagaacatcatatctgaattctctaatattggtggaaaggagaacattaatggaatttagaattatgagagttacatcaaagttgctttagataccctccccacccctgtgattcttgaagggtaagattgggatacacctggagccctctctcttatatcggatttgagggttcttgttcctggggcccaactccttaatccaaaatacattaatctacttctgaactaagaaattgaggagacaagatgtaagtcactgtcaaaatttattaattcattcaattaataaaggtgtcattccagttattaaagatatacctgtgaacaaggcaacaaggtcccgctttccctggacttatattctagtgaggggagacaaataaaaagtatacaattccagatagagataagtgctatgtgtatagtcctaagaagttaacagaaaattggaaaatgggcttagctggcaggaacagaaacaagggtagaggggagtaaatgttatgagaaattaggccaaccgcaaatggctcactagctcccaagcatcctattacaagcacctggctcacagcccacctgcatccaagcagtctgtcttcaagcattcagcctaagcagcaccaccttataaaactcccctccagcccgtgcctcttggcagacagccttctttcttctgtcttgccttttgctcccttgcaatgtatctcctcctttcctctaaataaatctgcctttctaaactcattactgtcttggtaaatccctttaccatccatgcactaccttcagatagtcattgaccatgacattatgaagaagtacttaatatgaagaaataagcaatagagagtgactgccaatgatagatggtattggataaacatgtgtttagattcagtggtcaggcaaagaatctctatggcaataatacttgagctgtgatctggatgaaaagaacattatcctagatcagagggcatagttttctagggaggaagaatgaaaagtgaaaggatccctaggagagaataagttggatgtgtttgagggtcagaaaagtcaacatggcaggagctttacaaggagaaaaatggcagagtatgaggttaaacaggtatatagtgggaaccagataatgtcagataatgtaaagcattctagataattgtaagtattgggggccaattataagtatgatgggaaaccccaacaactcaatactaattaagcacaatcctaaatgtacagattacatccacctaatagagcatcatccactcttaacctggaatatctagctgatacctatatctaggcaaattaaggtctctatgaacaataaagagatcaattattgccacttgtgagtttaatttagcaatagtgagaagtgtgtaatagggtttggactgaacttacactgacttcacataaactcaaagagtaatcagagagtagctatatatacaatcatttaaaagcttgaacttatggcttggaaatacttaacaggcttcacttcaggaaatccttgagagtaatcaccagtagagtgagcaaaggcatttgtctatcaaacggtgaaatttcaaaattatcaagaatcggtctttaaattgtttccagatttttgggcataaaattatgactgttcaatatgttttctgtacaaagataagacagcctatgagttttcatagcaaaggcaaatattatcaaaaaatgaattcttaagagcttattttgcttctgaatcaataagaaaaagaactcttttcttttggttaaaaagagtttgtgactataagcgtctatattaaatcattttctttcttgagagtaataatagagtgagtaagccagaatagaaacaagtaaaaaccagaatttcttgcagttggaattgccatggctctatcttacattcttcagaaagttcacttctgtttagtcagtcatttaaatgctcttttccttacttgtcttgattcttttccataatgattatctttcatgtgactgttaagcttctgcattgtgacagtctaaactagtgttttgatagttccccctttcaaagaaggcaaaaagaagacaactgtcaaatacatgacaggagcaatacaaactggggataccgtgccccattaaacccagaagaggttccatcatattacctgattactagttaataagaacttttgaaacaactcatttggtaggctttgggactgcttaaactgggaggttttagtttgtccaatatatgcacatatcaggtactcaacaaatgcttgagtatataagcataaatatgtgcttatataaaataattaagtaataggagattaaggtaaatgaggttcaacaatgttaactaatttgtccaattttcacaattagtacactttggagctataatttcagcccaagtctaattccaaaatgcatgctatctccactacatcattgattatcaaatgagtaagtgaataaatgaacaaaacagaatttcataaatgaaagaatatttatgactagaaataaagcgttttcttttataagtaaagttcaggtgctctatttgacaaacttagacgtttaatatatcacaagctaagcacacaaattacaaggattatcttacattataaaaaactcttgctcataactaaatttctgtcaaaaatcaacttatgcttctgtcatttttatatccaaattaaaaagaaatatagaaagtctctatttcttcccgatttaatctagcagagttgtatatttccagaaatttatccacctcttctagacttctagattttctagtttgtgcatgtaaaagtgttcataggagccttgaatgatcctttgtatttctgtggtataaattttaataatttctgttaattacaaataaatgtaattgagtttatttgaatcttctctcttcttttcttggataatcttgctaatggtgtatcaattttgtttaccttttcaaagaactagctttttgttttctttaccttttgtattgtttttgtttgtttgttcgtttcaattccatttaattctgctctgatctttgttatttattttcttcttctgggtttgagtttggtttgttcttgtttctctagttccttgatgtgtgacattaggttgtctatttgtgctctttcggacactttgatttaggcatttaatcctgtgaactttcctcttgataccatttttgctgtatcccagaggttttgataggttgtgctaatattattgttcagctcaaagaatttttttagatttccatcttgatttcatttgtaacccaaaaatcattcaagaacaggttattttatttccatgtatttgtatagttttgagggtttcttttggagttaatttccagttttattctaccgtggaataaaattaacacttgatatagtttccagttttattccattgtggtctgaaatgatacttgatataattttgattttcttaaatatattaagacttgttttgtggcctatcgtattgtatatcttggaggatgttccgtgtgctggtgaaaagaatgtatattctgcacttgttgggtagaatgttctataaatatctgttaagtccatttgttctagggtatagtttaagcccattgtttctttgttgactttctgtcttgactacctgtctagtgctgtcagtggactattggagtctcccactattattatgttgctgtctatctcatttcttaggtctagaagtaattgtttaatgaatttgggagctcccgagttaggtgcatatatttttaggatggttatattttcctgttgggctaatccttttatcattatacaatgtctgtctttgtccttttttactgttgttgctttaaagtctatttttttttttcgaatataagaatagctactcctgcatgcttttggttttcatttgggtggaatatctttttccactcctttaccttaagtttatgtgagtccttatgtgttaggtgggtctccagaagttagcagatactttcttggtggacttttatccattctgccagtctgtgtctttaaaatggggtgcttaggtcatatacattcaacgttagtattgagatgtgaggcactgttctattcatcatgttagttgttgcctaaataccttggtttttttttttcattgtgttattgttttataggccctgtgagttttatgctttaaggagcttctattttggtgtattttgaggttttgcttacagatttagaagtctttttagcatttcttgtagtgccagtttggtagtccatttgtagctacttggatggagttggagacaattattctaagtgaagtaactcaggaatggaaagccaaatatcttatgttctcacttataagtgagaactaaactatgaggatgcaaaggcataagaatgatacaatggactttggggactcagggacaaggatgggagtggggtaagggacaaaagcctataccttgggcacagtgtccactgcttggttgatggcatcaccaaaatctcagaaatcaccacgaaagaactccacgtaaccaaaaaccacctgttccctaaaagctattgaattaattttttaaaaaaggaagggtgcaaaacaaagacacaagtgatcagaataaatttttaaagtctgctgttagccattgcttcaaaacacgcagaacatagtatatttgattgtatattgcaaactatacagatatttctacaaatatacagtttcataaaactttgtcatactattcactatttgagcataatacttttcattcatgtgcatcttcatatataatatattcaattagatttgcagttgatgttttacaagtttaattgtctgtgtctatacttgattgtttatctttgtgtcctgtcataatttcaaatgattggggactgatcaaagagtacgatatgaccacaggtacagtaaaacaaacattgggtgacatttacacagggctgcaagagggaggaactccctcacagcaggagtctctctacagactgtggtgaagggggctgtctcatcagaaggggagaagaacaaggaactcccaggggagaaggggatcagggagtgggcttatgtgtttaggttatattactcagaaacatggtggggagttactgggtcagagactcctaaggacccaccgcagcttggagttttataaccagaaggctctatcttatcactggtgagcacatgtggggtaaggtttcatagggtatgcaaataaggtgggctccaaattgctaaaaatctgcttttggagataatttttaaaatagttggatgtataaaaatttgaatttggtgttggtgggcttatgagctaatgggttttatccttcagtgaagaaataacataggggccaatatacagaggccatctttggctcgttctgtctgtaaaataatggtaaaatatttgtgtatattcatagttgctacttatgagttttcatggtttcaatttcaatatccctacatatacacatatgtggctatttagagaatacagtcagatgtagtcacattctcaaagtcttcatacctaaataaaaaataagtgattcaaactaaaggacatctttagtatagtaaaaatttccagtgatttgaaaaacataattgtattatttatgatataagcagtcatgtaagttcagtttcaaagacaatggttttgacatgaaccatatatacacacttatgtatttaaagtacagttgacctttgaacaacatgagcttgaacttcaggggtccactcatacattgatttctgcatctgtcacccctgagacagtaagacaaagttcttctcttcctcctcctcctcagcctactcaagatgaggaggatgaagatctttatgataatctacttccacttaattaacagtaaatatattttctttatgatttccttaataacattttctttcccctagcttccttttttgtaataaaacagtatataatacatataacacacaaaatgtgtgtcaatcgactgtctatgttatcagtaaggttattggtcaacaataggctattagtagttaatattttgggaagtcaaaagtcatatttggatttctgactgtgcaggaaaggtcagtgcttctaattttctttttttttcagtagacaatgatgtcgtttatttaaaatgtttactccaagaaatatatatataaaaaaataagacaattacagcactaaaccaggcaccttcgaccaaatcacaacctcctctttgattccccttcacactaagcctctttcaaattctttttcctgagctggaagaccagtcagatgcccgcagggtcgcgccaagcacgttcccagccggacaactgtgtacctttctctaggagtgcgtgacacccttcccccacaactccttgttttaaaggatttaacctattaggaagcccatttttcaatctaagccagaaggaggtgcgggacaaggcagtcttcactttgaaggtccttttcctgctccagtccctgggctagggttctagaagaggctggctgccggatttacatgaggccaccgaagatccgagtccagctccgcccagggcggctcctgcaaaggctgggacctcgggtggtgcgtcctcaaccctctcggtgaccacgactcaaaggagagacctcaagggtgccaggagcacaggtgtctgggctgcattccaggaaagagacttctccagggaaatggatcaggctgtcacatggaagcttgagtcagagatggtggttatggggtgatttggacaaattaggttagtttagcaaagctctgaagtagcagaagcttctcccctggactactgattgaacacagaacaagagatgtgcgtggcgtcagactaagtcttagagagatgcaggccagtctcctcccacagggccttgggactggcaggacagatactgctacatgccctccaagggcaggagtcacggtaaggagcgactggggtggaaaatagggaaaaaagcaacaacaactagatcatttttggcattttaacatggagacagtgacaagtggtaacaatagcaaaagaaaaaaaaaaaaacttgaagagaccaataattaactttcccatccacccaagtctcacacttaagttctagtcccatctcccccataagcaccactgaactaaatatctattttaaagcacccaaaccagtccagaccctctggaaaccaagagccccagccacagctgtcgcctctcttgggtccgggcgagaggagggttccgggaaaggcacctcataactcaatcagcgcagcacacacggcggcggcgagctcgggcacaggcacttgacggggacgcgggtggcagtcacagcatctgtgctgacacgcgaggaaggggactcttcggtaatcccaactatttggtaccagagccaagcaaacgtgactaaagggagctgggtcagcagaacggtaccccgagtctcagcaacaggacggcccgcgcgaggcaggatccaagcaggggagaaaaagagaccaaagcacaaggcgatcgaggctggcacagaaaaggctgatccttcttgcaaggactggagaatgcatttgactgctggctgatcaatctctaattggcgagtgcgcgtcacaaggctcagccctggctccacagggagccacgaagctgacttaactgatacaaatgttcccacctctgccccacccccaagtccccatggttccaccat
